United States Patent 6,812,339 (POLYMORPHISMS IN KNOWN GENES ASSOCIATED WITH HUMAN DISEASE, METHODS OF DETECTION AND USES THEREOF) - sequence listing, part 90

SEQ ID NO: 57844 - DNA, 601 bp, Human
ctctttgtctattttagatgcaccatctgaattcaagttagaatcttttcccaatcactgtttgttagtcaagcttgcagactgtgacagtgctagatgttttggtctcttcttccttgcctcctcctcctccttttctgattctgttgcagggatgttattaagaacaccatccacagcacagtgtgttcaaacatccatgcaaaacatttctcttagacctaagttctagagaaagcttatttttctcctcaaaaaacgattttcattatagaaaatatgaattttgttatgttgcatrtatttctgattgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacc

SEQ ID NO: 57845 - DNA, 601 bp, Human
tctcttcttccttgcctcctcctcctccttttctgattctgttgcagggatgttattaagaacaccatccacagcacagtgtgttcaaacatccatgcaaaacatttctcttagacctaagttctagagaaagcttatttttctcctcaaaaaacgattttcattatagaaaatatgaattttgttatgttgcatatatttctgattgctttggtttccaggaagcagaaagagaaagtaggagagagagaaagagagagagagaaagagagagactgagaagaaaagagggagagaaaaraaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagttga

SEQ ID NO: 57846 - DNA, 601 bp, Human
agcttatttttctcctcaaaaaacgattttcattatagaaaatatgaattttgttatgttgcatatatttctgattgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagacygagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaa

SEQ ID NO: 57847 - DNA, 601 bp, Human
attgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctcycgggttcaagtgatactcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaat

SEQ ID NO: 57848 - DNA, 601 bp, Human
aggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatwctcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatg

SEQ ID NO: 57849 - DNA, 601 bp, Human
gagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggygtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggacggagccttatgtaaattaaacaatgctgac

SEQ ID NO: 57850 - DNA, 601 bp, Human
aaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagtygagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggacggagccttatgtaaattaaacaatgctgacacccaaggaactgaagatctttagtgaccttgatctgggag

SEQ ID NO: 57851 - DNA, 601 bp, Human
ctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggayggagccttatgtaaattaaacaatgctgacacccaaggaactgaagatctttagtgaccttgatctgggagatttttaaagcaacttctcctactcatgaagtcctttcattcattgattcaacggatatgtattgagtgtcaactgtgtgctagatgttggggacatgacagtgggcagctcaaagaaaatgcctgccctcatggagcttccactcttgtgagggataaaaataaacagatagatattaatataatgcccgtgtggtaagtgctgtcaagaaaaacaaaggaggggaag

SEQ ID NO: 57852 - DNA, 601 bp, Human
agcaagttaagatgtggtcactctggattagggtgggcctgaatccaatggctggtgtcctcataagaagagggatatttggataccgacagaacacacagggaagaataccaggggaagacagaggcagagattggagtgatgcgcttaaaagccagggagtgccaacggtagctggcagccagcaggacctaggagggaggtgtggatggaacagatcctccctcagaatcttcagaaggaaccaaccctgccagcaccttgatttgggacttccagcctccagaactctgaaataatwaattccttttgtgtgaagtcactcaggttttggctcttccttttggtcatgctaggaaactagtagaaccaccaggtattaaatatttataatttgccatgcacagtgctaagttaaggtgtgcactaagatactttatcccataaaactctctcagcagcaccaaaagcaaagtattgttggcatctccattttataagatgaggagaagattgaggttcagaaaacagtgaatttctcaaggtcgtacagcttgtatgtggcaaaacttggacacgtaccaggttttctaactctaaa

SEQ ID NO: 57853 - DNA, 601 bp, Human
aaagtttctggaagctccagaaactgcttgagacaattaataagagatcatttccatttaaaggaacatttttgaacgtgggcatcaccagccagggcaatggctacttttctgctcttttcctctcccatggcaaaacttcacagcatatggccgggcgcggtggctcatgcctgtaatcccagcactttgggaggctgaggcgggcggatcacgaggtcaggagattgagaccatcctggctaacacgatgaaaccccgtctctactaaaaatacaaaaaattagccgggcatcgtggygggcgcctgtagtcccagctactcgggaggctgaggcaggagaatggagtgaactcgggaggcggagcttgcagtgagccgagatcgcaccactgcactccagcctgggcaacagaggagactctgtctcaaaaaaaaaaaaaaaacttcacagcatatgtggaggcagaaaggtctgcccaagccacttgatggaagcagggccgtgtttgtcctgcttattgggtacatcaccagtgcctagcatcatgcctagaacaaaattcccaatagagcttgtagacctgatggaagaactgg

SEQ ID NO: 57854 - DNA, 601 bp, Human
ttgagaccatcctggctaacacgatgaaaccccgtctctactaaaaatacaaaaaattagccgggcatcgtggtgggcgcctgtagtcccagctactcgggaggctgaggcaggagaatggagtgaactcgggaggcggagcttgcagtgagccgagatcgcaccactgcactccagcctgggcaacagaggagactctgtctcaaaaaaaaaaaaaaaacttcacagcatatgtggaggcagaaaggtctgcccaagccacttgatggaagcagggccgtgtttgtcctgcttattgggyacatcaccagtgcctagcatcatgcctagaacaaaattcccaatagagcttgtagacctgatggaagaactggaatcgtgactgcagcatgaatgcacaccaagctcatctcgccaagcaaatgttagtggttgtataagaaatagaaaaaggaaatgactgttctctctgtggctatgtgcaaggtggataggaaaagaggaataggaccaggatctaaaactgaatttaaaatattccagcactgatttgctcaccactgaacacttggcacttagggcttgatgatgggtgtgttta

SEQ ID NO: 57855 - DNA, 601 bp, Human
tagcatcatgcctagaacaaaattcccaatagagcttgtagacctgatggaagaactggaatcgtgactgcagcatgaatgcacaccaagctcatctcgccaagcaaatgttagtggttgtataagaaatagaaaaaggaaatgactgttctctctgtggctatgtgcaaggtggataggaaaagaggaataggaccaggatctaaaactgaatttaaaatattccagcactgatttgctcaccactgaacacttggcacttagggcttgatgatgggtgtgtttaagggcatggatttargggacaggtgactaggtgtcacttcctagtggaatacggacgagtcacctagctttgttaagccctcccttcttcatctgtaaaatagggatagcagcagtttccaccttacgtatttactgtgggaattaaataagataatgcatattggaagtaatcagtgggcatgtacatggttattgttataaagtccaaactgtcccaacgttgccctttttttccttggcacaaacactaggcctttgagtatcacaaattctttgtccagccaccctacttggtggctggatctctgtgatt

SEQ ID NO: 57856 - DNA, 601 bp, Human
gtagcaagtcattccaaaacatagaagcttaaaacaacagccatcctatattatctgtcatggtttctgtgggtcaggagattgggaatgatcactggttggttgtggcttgaggtttttcctgcactggctggagcacctggggctgcctggtcatcaagcttatcaggtagtaccagggtttcttcatggggtcttgttccctggtctagcattgtgtcttggggtagaaaggaaagaaactgacagaagctacagcctcagaagtcttgcagggtctcttcaccacattctgttcatyaaggcagccgcagtgcctgcccaggttcagagactctggctctgattggaggagtatcaaatatttgtagacatgttttaaaacctctataaagtatcacttccttcgtgctatggggacagctctcaaaatgtaactccaagagaggacagagagatttatatcgaaaatgaaagcttgattagaatattaagaagaaaaggaaagttttctctcatcctattaatgactgctgagaaagtgttaggaaaatcaggatggaaggattctgtcagctttacctactgacatctcctagcc

SEQ ID NO: 57857 - DNA, 601 bp, Human
tgactcctcagagtaccctaattcaaattcttgggagggggaatccgattggcttggctcaggttgaggaacttacctctgatccaatcagctgtgaccagctgtatccactgcccaatcagaaggttcttctaataacacagagttggaagaagtgaaaggcatgctagggttttcatttccaaattaaactgcagtcattttttatcatgtggttactcttattttccctgatcttcttgaaacacttgttgcaaaacaagggtcagcaaactattggagcccaggctattgcttattkttgtaaataaagttttattagactacggccacactcattctcttgatccagaccgtcccgcaaagcctataatatttcctgtttggccctttatagagaaagtgtcctgactcctgctctagaattcagttcgcttctatgtctaaatttttgctatgccttatgcatgcccgttctgttttccgttaatcagtatagggcatgttgttgagggcagggcaagacactgggaatcttcacacacccctgtttattgatttttaaaactatctgtacaaatgcaatagtatctcctacgat

SEQ ID NO: 57858 - DNA, 601 bp, Human
ttttcatttccaaattaaactgcagtcattttttatcatgtggttactcttattttccctgatcttcttgaaacacttgttgcaaaacaagggtcagcaaactattggagcccaggctattgcttatttttgtaaataaagttttattagactacggccacactcattctcttgatccagaccgtcccgcaaagcctataatatttcctgtttggccctttatagagaaagtgtcctgactcctgctctagaattcagttcgcttctatgtctaaatttttgctatgccttatgcatgccygttctgttttccgttaatcagtatagggcatgttgttgagggcagggcaagacactgggaatcttcacacacccctgtttattgatttttaaaactatctgtacaaatgcaatagtatctcctacgatgcggagcacatagcattgctgatttgcaagaagatttcaactgctacttgagattgttttaggtgccgtgtagttgcactatgaaataaaattaaatcacgttatgataaggttatttctgtgtctccttttactctttctaattacttgaacaagcaaatctcatttgatg

SEQ ID NO: 57859 - DNA, 601 bp, Human
actgaaggtgtctagggcccctccttctctcgttttggttgggggaatgggagatagttgcagatattcaggattgttggatggtgccttgaccggtggtgatgggtcagggagagtgtattagtccgttttcatgctgctgataaagacatacccgagactgtgtaatttatgaaaaagaggtttaatggacctggggaggcctcaatcatggtggaaggctaaagtcacgtcttacatggtagcagtcaagagagaatgagagctaagcgaaaggggaaaccccttataaaatcatccratcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgaaaactcttcttctttccatctccaattcctctgctcacttgtcttccagctaagtcacctccctgccccctccc

SEQ ID NO: 57860 - DNA, 601 bp, Human
ctgaaggtgtctagggcccctccttctctcgttttggttgggggaatgggagatagttgcagatattcaggattgttggatggtgccttgaccggtggtgatgggtcagggagagtgtattagtccgttttcatgctgctgataaagacatacccgagactgtgtaatttatgaaaaagaggtttaatggacctggggaggcctcaatcatggtggaaggctaaagtcacgtcttacatggtagcagtcaagagagaatgagagctaagcgaaaggggaaaccccttataaaatcatccgrtcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgaaaactcttcttctttccatctccaattcctctgctcacttgtcttccagctaagtcacctccctgccccctccct

SEQ ID NO: 57861 - DNA, 601 bp, Human
tcacgtcttacatggtagcagtcaagagagaatgagagctaagcgaaaggggaaaccccttataaaatcatccgatcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgaraactcttcttctttccatctccaattcctctgctcacttgtcttccagctaagtcacctccctgccccctccctgcacatgtcccggccccagctctctctggaatccaggagcaggaagtccctgtctccacctgactctacatcttaggaaagtgactcccttgagtcattgtttctgtgttagtaagcattgaggaaggaaaatacatcccttgggtaccagggagagaacagagggaggcaagaaataaactgaaggtgcccatcctagcacttggagccctgtcttgccatgcac

SEQ ID NO: 57862 - DNA, 601 bp, Human
tacgggagctacaattcaagacgagatttgggtggggacacagccaaaccatatcagagggtgtccactgtcaaggacagctcagcaccaagcccttcttactgggctctggagtttctcagctgaaaactcttcttctttccatctccaattcctctgctcacttgtcttccagctaagtcacctccctgccccctccctgcacatgtcccggccccagctctctctggaatccaggagcaggaagtccctgtctccacctgactctacatcttaggaaagtgactcccttgagtcattrtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattgtgctggggaagaaagaggttaaaaagagttctcttgctgtggaagtgtgtgacagggaccctcttcctaaggtgtcccaaatccctgcatctgcctggcctttgtcactgtggctgtgat

SEQ ID NO: 57863 - DNA, 601 bp, Human
tcacctccctgccccctccctgcacatgtcccggccccagctctctctggaatccaggagcaggaagtccctgtctccacctgactctacatcttaggaaagtgactcccttgagtcattgtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattttgctggggaagaaagaggttaaaaagagttctcttgctgtggaagtgtgtgacagggaccctcttcctaaggtgtcccaaatccctgcatctgcctggcctttgtcactgtggctgtgatgagagagaagatggtgaggacaggagataggaatgctgtgagctggcaagctcagctcggaagcttcagtgcatgggtgcatgatctggaagcttctgtgcatgagtttagccagaccttttgctgctgggataagagctgagtggggtgtgcagagctgccttcctgctgctaagctta

SEQ ID NO: 57864 - DNA, 601 bp, Human
cttgagtcattgtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattgtgctggggaagaaagaggttaaaaagagttctcttgctgtggaagtgtgtgacagggaccctcttcctaaggtgtcccaaatccctgcatctgcctggcctttgtcackgtggctgtgatgagagagaagatggtgaggacaggagataggaatgctgtgagctggcaagctcagctcggaagcttcagtgcatgggtgcatgatctggaagcttctgtgcatgagtttagccagaccttttgctgctgggataagagctgagtggggtgtgcagagctgccttcctgctgctaagcttattctatatgtcaccccttctagcctgagtcctctgttgcatcctctggtcctccagctgagttgagtgtagcatctaatttcctcaatcacctgaactctggccctgat

SEQ ID NO: 57865 - DNA, 601 bp, Human
tgctgggataagagctgagtggggtgtgcagagctgccttcctgctgctaagcttattctatatgtcaccccttctagcctgagtcctctgttgcatcctctggtcctccagctgagttgagtgtagcatctaatttcctcaatcacctgaactctggccctgattggttcccttaccctcctgagccttaatttcctgcaatatgggattcacaatggcacctacttcctatgatgttatgcaatacaaatgagtaacaataagtgaaaacctggaattgtttggtcagtagaaaagtgytcaaaaatgtaatggtggttagtattgttgcctgcaaaatatctgacacagtgcatgcagtgaatacttcaatctgattctttcttcctccaggaagccttcctagaagtccccaaaccaggttaggactcttcgtaatggggttctgccttgtgcttcctacagggcttcttgagacaatctgctggtcattgttctgtctggcataatcacaaccaaagaatgttcaaagaatattcccccggttgggagagtgggagagggggtgacacgcagaaaataccgatgtgtctgtgagcc

SEQ ID NO: 57866 - DNA, 601 bp, Human
caatatgggattcacaatggcacctacttcctatgatgttatgcaatacaaatgagtaacaataagtgaaaacctggaattgtttggtcagtagaaaagtgttcaaaaatgtaatggtggttagtattgttgcctgcaaaatatctgacacagtgcatgcagtgaatacttcaatctgattctttcttcctccaggaagccttcctagaagtccccaaaccaggttaggactcttcgtaatggggttctgccttgtgcttcctacagggcttcttgagacaatctgctggtcattgttctstctggcataatcacaaccaaagaatgttcaaagaatattcccccggttgggagagtgggagagggggtgacacgcagaaaataccgatgtgtctgtgagccacactggttaactggccctgaatatgaccacagcacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttctta

SEQ ID NO: 57867 - DNA, 601 bp, Human
ataccgatgtgtctgtgagccacactggttaactggccctgaatatgaccacagcacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcattyaacaaacatttattgaacatgtactatgagccaggagctattgcaggctcttgagttacaccagtaaaccaaaacagcaaagatacttgccctcatggggcttaccttctagctaggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagc

SEQ ID NO: 57868 - DNA, 601 bp, Human
cacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcatttaacaaacatttattgaacatgtactatgagccaggagctattgcaggctcttgrgttacaccagtaaaccaaaacagcaaagatacttgccctcatggggcttaccttctagctaggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagcctgggcaacatagtgagaccttgtctctacaaaaaataaaaaataaaaaaatta

SEQ ID NO: 57869 - DNA, 601 bp, Human
atctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcatttaacaaacatttattgaacatgtactatgagccaggagctattgcaggctcttgagttacaccagtaaaccaaaacagcaaagatacttgccctcatggggcttaccttctagctrggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagcctgggcaacatagtgagaccttgtctctacaaaaaataaaaaataaaaaaattagccggacatggtggcacttacctgtagccctagctacttgggaggctgaggcaggaggatc

SEQ ID NO: 57870 - DNA, 601 bp, Human
accctgtgtctgaaaatataaaagtgtgaagtcaatagaaaacattacctgttgtttcagagtcaacagaaggcacctatacaaagctaagtgtggctacaaatgaacaccagctgctcataactggcccccagactccttccaactgccctgacatgcttgctctctttcccaggtcatgctttcagaacgaaaaggcacagatgagctctatgctgtgaagatcctgaagaaggacgttgtgatccaagatgatgacgtggagtgcactatggtggagaagcgggtgttggccctgccygggaagccgcccttcctgacccagctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggc

SEQ ID NO: 57871 - DNA, 601 bp, Human
gacccagctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggcctttctctgacagcaagsagtgacttggggacaggagctgggtgaaaaggttcacagcttgtggatctagatggttccattcagccctctagacctttggataaatgcacaagtacatctctgcaggttgcctgaggcctttgcatgggcctcattggagggaggatgttgcctgagaacacagccctcgaggactctcagggaaggtacacagtgtcctgggaaggagctagtgagttcagagccatggctgccaaggtgagaagggagcacttgtccatttgtccattttctgctcttgactgtgatttcaaccct

SEQ ID NO: 57872 - DNA, 601 bp, Human
acttctttgtgggctaagcacatatattttaatgttgcataaattaaatttattttcaaagacttataataatgcctactatatgtgaggcacaaggcaaacaattttaagtctcttgacaacttagataggttctgtcatcattcccattgtgtagaccaggggactgaggccacacagctagtacatttcagggccaggatttgaacccaggcagtctggctttaaggagttttgcatttaattgctatgctctgagatctttttaaaaaaacatgtatatgtatatgtatatgtatawgtatatgtatatgtatatgtatatgtatatgttgttgtgtatgtgtgtgtgtgtgtatgtgtatgtgtgtgtatgtgtatgtgtgtgtatatgtataagtatatgtatttttagagacagggtcttgctctgtggcccaggcttgagtgcagtgaaacaatcatagctcactgcagccttgggctcctgggctcaatagatcctcctgcctcggcctccctagtagctaggactacaagcatgcatcaccacgcccagttaatatttaaaaatattttgtagaaacagggtcttgctatg

SEQ ID NO: 57873 - DNA, 601 bp, Human
ttgcataaattaaatttattttcaaagacttataataatgcctactatatgtgaggcacaaggcaaacaattttaagtctcttgacaacttagataggttctgtcatcattcccattgtgtagaccaggggactgaggccacacagctagtacatttcagggccaggatttgaacccaggcagtctggctttaaggagttttgcatttaattgctatgctctgagatctttttaaaaaaacatgtatatgtatatgtatatgtataagtatatgtatatgtatatgtatatgtatatgttrttgtgtatgtgtgtgtgtgtgtatgtgtatgtgtgtgtatgtgtatgtgtgtgtatatgtataagtatatgtatttttagagacagggtcttgctctgtggcccaggcttgagtgcagtgaaacaatcatagctcactgcagccttgggctcctgggctcaatagatcctcctgcctcggcctccctagtagctaggactacaagcatgcatcaccacgcccagttaatatttaaaaatattttgtagaaacagggtcttgctatgttacctaggctggtctcaatcttctaggctcaag

SEQ ID NO: 57874 - DNA, 601 bp, Human
gtacatcatgttgagttgccaccaaaatggccttgacaatgatgatacaaacaagaacaaaaagcagcagctaacagtaataggttgggcactctactcagcactctagctgtattatctcattttatcctcctgatacctctattggaaaggtactattactaactttaatttacagacaagaatgctgacattcagagaagttaagtaactggtgcactgtcacacagctgctaagtagtggagctaagatttgctctgcaagactctagaaccccaaacccggaagcctttgctaacytacctgtgccttaacttcacattcctggttttggcttatagaatattttcactttacagccaggcacagtggctcacacctgtaacaccagcactttgggaggtgtaggcaagtggattgcttgaatccaggaggtcaagaccatcctgggcaacatggcaagatcccatctctacaaaaaattagctaggagtgatgcacgcacccgtagtcccacctacccaggaggctgtggtgggagggtcaactgagcctgggaggtcaaggctgcagtgagccatgattgcatcactgcactcc

SEQ ID NO: 57875 - DNA, 601 bp, Human
gatattaaatcctatttaagatattattttaagtgtgttaaaattgaatattcacatggaaaagaatcagaagggggcataaacaaatcaaaatattgatttgatttagggaggggtctgtggataagtgccttctttttgaacttacatcattgcagaagtagttataatatagttgtttaagttttttttaatgtaccacaagatggcaaagttaatatccaaatagatgcaaaagctcccagaagggggttgagttttcagagatttgctcattagatggtttaggcaaattgtcctrgaagcacaaagggataataagcctgtactccacagtcaggtgaatctggatctgtgattgcttgctagatgacctctaggaagtcacttaacagctctgaatatggatttcatcatctttaaagtgggcataatcagggaggattgaaagagatggtgaataaaatataataaacatgaaatggaggttgccggcattattagagctggactggaggtgcaccttgctgcataggtacgaaagaattatgtttcttccattccttttgcagtttttctcagggacaattgtcagcccggc

SEQ ID NO: 57876 - DNA, 601 bp, Human
tggatttcatcatctttaaagtgggcataatcagggaggattgaaagagatggtgaataaaatataataaacatgaaatggaggttgccggcattattagagctggactggaggtgcaccttgctgcataggtacgaaagaattatgtttcttccattccttttgcagtttttctcagggacaattgtcagcccggcacattcatgcaatttcccaactgccagtgggcacaggcagttaagtttctttagcaaaacatctattttaactgttttcttttcaattgaacatatgcacctctttttttttttaaatagaattagattttatgagtcattgaaggacagaagttacttcctccccaaatttgctgccatggcccagcaataactcagttgcaaggcatgctgggaggaacgtcaattcagaatgcaagagaggacagggatggggtgaggatgattcccacatgtagagtggacccctgatggcccaagaatgagccccgagaatgtcccaggggtcctggtaactcgggctcagctctgggctggcagcagtacccaaggatatggttggacttaagggcattgctgcaggt

SEQ ID NO: 57877 - DNA, 601 bp, Human
tgaggtccatttagttagccgaagcccccatagttcactctttatgcctctcatgcactttcttttatcgcattctattttatttatttatttacttttatttgaaacagggtctcactctgtcacccaggctggagtgcaatggtgcaatcactgctcattgcagccttgacctcctgggcacaagccgtcctctcacctgagcctcctgagtagctgagactacaggtgtgcgccaccatgcctggctaatttttttattttttgtagagccagggtcttgccatgttgcccaggctgrcctggaacttctgggctcaaaagcaatccttccacctcagcctctcaaagtgctgggattgcaggcatgagcccctgtgcccagccacattctattttagattagggtttgaattagttgtatacttgttttaaccaagattctgaattccctgagggcaagcctgaaccttattcatcgttttcatccttttaatgcctgcctaatgccatgacttgcaaaaataagcgctcgatgaaagttctaaaactcacttctctgctccagattggctctggattgcctctgacaatattttcc

SEQ ID NO: 57878 - DNA, 601 bp, Human
cgtttgggtggatggtcttaggcagtgcatcataatctggtcttaccctacctttccccttttttcttttatatgactccatgaattttactccccctctccagcaataatagccatcaaatcaggaacgtaagtgcttagttgtattttccacaatatacgttaaaacaaatacaaagccataaaggtgaaaccatcatacatccatggactacctaaaatgatctcctacccattttgggaaacacggccgtttggaaatttatctggcccctgtccctcgcctgggaatccttaacayctggcactgtggattatccacagaaacatctctggcaatagagttgctcctggcatagagtgggcatcattaagtgtttgttcagaaataaaaggacagtgagatgccaaccgtaacatttaatagcttaggcgctggtgtgttgaagccacatgctcagtacagttcaaagatgatagatcttagggtttccctgcatatggttagcggtagaaacataccacaaaacacgaccttacctacagtggagcgatcccctgatgtggggattccgactaatgagtctggggggcaagccga

SEQ ID NO: 57879 - DNA, 601 bp, Human
tgcttagttgtattttccacaatatacgttaaaacaaatacaaagccataaaggtgaaaccatcatacatccatggactacctaaaatgatctcctacccattttgggaaacacggccgtttggaaatttatctggcccctgtccctcgcctgggaatccttaacatctggcactgtggattatccacagaaacatctctggcaatagagttgctcctggcatagagtgggcatcattaagtgtttgttcagaaataaaaggacagtgagatgccaaccgtaacatttaatagcttaggcrctggtgtgttgaagccacatgctcagtacagttcaaagatgatagatcttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaaga

SEQ ID NO: 57880 - DNA, 601 bp, Human
gttcaaagatgatagatcttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccaaagaaccaggggctgggtgtcggcagttctggcttactgtctgcattttgccaccaacttgtatgtgaccttttggcaaatctcctatgccttggaccctgagaatataagtgatcatttcacctccttttctcattagacatgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcc

SEQ ID NO: 57881 - DNA, 601 bp, Human
ttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccraagaaccaggggctgggtgtcggcagttctggcttactgtctgcattttgccaccaacttgtatgtgaccttttggcaaatctcctatgccttggaccctgagaatataagtgatcatttcacctccttttctcattagacatgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcccagctactggagaggctg

SEQ ID NO: 57882 - DNA, 601 bp, Human
agtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccaaagaaccaggggctgggtgtcggcagttctggcttactgtctgcattttgccaccaacttgtatgtgaccttttggcaaatctcctatgccttggaccctgagaatataagtgatcatttcacctccttttctcattagacrtgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcccagctactggagaggctgagacaggaggattacttgagcctgggaggttgaggctgcagtgagcagagatcacgccattgtactccagactgggcgacagagtgagaccctgccacagaaaaaaaaaaacaaaaaaattggttaacttgtgctctcctgt

SEQ ID NO: 57883 - DNA, 601 bp, Human
aattagtcagtgtgggcaacatggcaaaaccctgtctctacaaaaaatacaaaaattagccaagtgtggttgtgtgaacctgtagtcccagctactggagaggctgagacaggaggattacttgagcctgggaggttgaggctgcagtgagcagagatcacgccattgtactccagactgggcgacagagtgagaccctgccacagaaaaaaaaaaacaaaaaaattggttaacttgtgctctcctgtaacctgccagcttctgtcttgatgtaccactaaatctccatgttccttctctyccatcctggactggaagctctttgaggggaggacacatccacacatccatacaatgtctagctcagaacctttcacacaagatgtacccactggaggcagcatcatgaggggttgagagtgtagagtctggaacccaatgcctaaggttcagaccctggctttgcagcagcttatcagctgagagaccactggcaagttacttaccctttctgagcttcaactttctcctctttagaagggagagaatgattatacttgtcacattgagttttgtagagggacaagtgagacaaaatatg

SEQ ID NO: 57884 - DNA, 601 bp, Human
cttgatgtaccactaaatctccatgttccttctcttccatcctggactggaagctctttgaggggaggacacatccacacatccatacaatgtctagctcagaacctttcacacaagatgtacccactggaggcagcatcatgaggggttgagagtgtagagtctggaacccaatgcctaaggttcagaccctggctttgcagcagcttatcagctgagagaccactggcaagttacttaccctttctgagcttcaactttctcctctttagaagggagagaatgattatacttgtcacaytgagttttgtagagggacaagtgagacaaaatatgtaaagcattcagctcatcacgtggtaagtacccaagaaagcttaatttcattattgttgttgttataattattaggcactcccacatttgataaatgcacatatgactgttacatataagataaagttctatgtgctgtatggaagatttttttaaatggtgaattaaatgcttgttatatggccagcatcatgttagacactctacacatgtgtccttgtttaatattctgtgggcaagtgaaaaatgtcccatctacaggtga

SEQ ID NO: 57885 - DNA, 601 bp, Human
tcactctgttgcccaggctggagtgcagtggtgtgatcttggctcactgcaacctccacctcccaggttcaagcaactctgctgcaccagcctctcgagtagctgggactacaggcgcacaccatcatgcccagctaatttttgtatttatattttagtagagacagggtttcactatgttagccaggctggtctcgagctcctgacctcaggagatctgcccgcctcagtctcccaaagtgctgggattacaggcacgagccgctgtgcccggctatcttttaatattctatataatttrtttattatgtttagcatttattgccttttctgtgtctacttgctagaatgaaagacaaaggccaggaatttttgttggttttgttcactgctctatcctcagcacccatctataacctggtacctagtaggactctgtaaatttgtttttacttgaatagatagatgaaataaataaccatcaagttcaaaatataattaacaaattatgatgtggtcagagattaaaaaaagaaaagaaaagaaaaaagcccacaggctttcatgaaagagtataacggcagacctaatttagattggg

SEQ ID NO: 57886 - DNA, 601 bp, Human
gtgattctctcacaggactggagttggtgctggctgctggcaggaggcctcagttctttgccaaatgtaccttcccatagtactgcttgagcatcctcatggcatggcggcaggcttcccaaaaagcaagtgatctgagagagagcagggtggaagttgtaggtcttttacgcgctactcctggaagtcattcattgtcatttttgcagtatccaatgggttacacaggtcagtcctattcattaggggaaggtactacacaagaacataaataccaagagactgaaaaatcactgtgggyggggggagcatcataaaggctggctactacagctatctatcacctgtaacattatttacttaatattttccactttttgttaaaatcagccttatcctaaacaataatatcagttaagtcacaagattaatatgctaattgtattttccagcaaaaacaaatataaacttgtaattattattattattattatttttgaaatggagtctcactctgtcacccaagctggagtgcagtggcatgatcatggctcactgcaacatccccctcccgggttcaagtgagtctcctgcctcagcc

SEQ ID NO: 57887 - DNA, 601 bp, Human
aatctcagtgttttgggaggctgaggttggaggatcacttgagctcaggagttagaggccagcctgggcaccatgacgagatctcgtctctataaaaaataaaaaacttagctgggcatggtggcgcacagctgtagtctctcctaaaaataaaacaaaactcaaagctctaaaaccacagctatttatttatttctaattcatgtccctgactgcttagaaaggccctatatcttccttggggattatcattgtagattttatgtgtccatttgctaatatttattgagaacttactatragccaggccctaagtgcttaacaaacatcgtctcacttaaccttgagaataactctgggagggagatgctaccatccctgctttacaaacaaggaaatggagatgcaaggttttgaaagcttgcccaaaatcatggagctagtaagaagcagttcccaaattctgaccccggtttttctttgcccatgttctttatcttacaccactctccgtcttagatgccttcactccacgggggtgaaggatcaaggtgctcggtggcaatggtctgtggttcctgtgatggggagactgattctg

SEQ ID NO: 57888 - DNA, 601 bp, Human
tctttctgtgctgaccttcaataagaggttacactttagacagatgttgtttcttattccagctgcgccattcattcactatataacttgcccaagttaatctctctaaccctcagtttcctcatttgaggaatggggagatactagtaggacctaccttacaggattgttattaggattaagtcaggtaatgcctaaaatggtgctggggagatggtaaaccttcaacagatgttagctgctattgttaagataatttaacttgctatatagtctgaaagtataattctctcttttttgsgggggtgggggacagggtctcactctgttgctcagactggaatgcattggtcctgaccatagctcactgcagccttgatcacctgggatcaagcgatcctcttgcctcagccttccgagtagctgggatcacaggcatgtgccaccacacccagttattttttttcttttatttttagtagagacaaggtctcactatgttgcccagctagtgaaactataatccttcatccagttcatcatatcccatgtccccttctccactatacaattgctgaacttctgcctacccccagtttgt

SEQ ID NO: 57889 - DNA, 601 bp, Human
aaattagaatccgcggtgggggaggaatcctccagaactaacttgggcatgtgttctgccaggcagcatcgcccactgccctggcaaagtttgggcagctctatatggtggtagaaaatctcggtggactgtgtcaccaatgatggttcagagcctcaaacaggagactgtttgctctaagaggagactcacagagaggacctcagtacttctttctcttgcttgtggaccctacatttgaggagcaggcaaagaattttggctggcagaatgtgatggatcacattattatgaaacattwtttatttatttatttttttctgctatgtaagtacaacttggaaatggatctctgagtggctgccctgaaagacaggattaagttcaggacttggcatttgctggtttttggaggagcaaatggatgatcatagctgcatgagtcataccattttatatttcatgcaaggcagacgattgcacccgaggctgctatttgtcagcaagtccagggcgtacaattctccttgtactacattgatgcaaatggcatagccagggcaggcttgggctggtttgttatgcaagagaggctgcaagg

SEQ ID NO: 57890 - DNA, 601 bp, Human
gatcacattattatgaaacattttttatttatttatttttttctgctatgtaagtacaacttggaaatggatctctgagtggctgccctgaaagacaggattaagttcaggacttggcatttgctggtttttggaggagcaaatggatgatcatagctgcatgagtcataccattttatatttcatgcaaggcagacgattgcacccgaggctgctatttgtcagcaagtccagggcgtacaattctccttgtactacattgatgcaaatggcatagccagggcaggcttgggctggtttkttatgcaagagaggctgcaaggtatgaggcctccaaatagcatttggcatgggtgggggtctatttcaaagattatgaagaaccacaagagtctcttccattcatgtgtttgacacacatttatcaaatcctactatattctaggcactcttctgggtggtgggcatacagaagtgaataaaacagatgaaacccttgcccccgtggagtttatctttctcatggtgggagttagataagtgaatcataaaaacatagtctgccaagtagtgataagtactatggagataaatcaagcag

SEQ ID NO: 57891 - DNA, 601 bp, Human
agacgattgcacccgaggctgctatttgtcagcaagtccagggcgtacaattctccttgtactacattgatgcaaatggcatagccagggcaggcttgggctggtttgttatgcaagagaggctgcaaggtatgaggcctccaaatagcatttggcatgggtgggggtctatttcaaagattatgaagaaccacaagagtctcttccattcatgtgtttgacacacatttatcaaatcctactatattctaggcactcttctgggtggtgggcatacagaagtgaataaaacagatgaaacccttgcccccgtggagtttatctttctcatggtgggagttagataagtgaatcataaaaacatagtctgccaagtagtgataagtactatggagataaatcaagcaggggagggtgctggtgtacactgggtgttggagggttctctctcattctgtagagagcatgatgatgagggcctggagagttaggggtgacttgagagtcctgggccttttgccttaactgcgggatatgggattaaaaggcatgagggggctgggcacagtagctagcacctgtaatcccaacgctttgggag

SEQ ID NO: 57892 - DNA, 601 bp, Human
ttcactatgtgtgcatgaaatggcacatggaaatcctctaattcccttagtttctcttttgactctcatagtgacaacatctttttgtgctgaatattattctggttttgaaaggtgcacatgaggctgggcgcagtggctcatgcctgtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcrggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaacca

SEQ ID NO: 57893 - DNA, 601 bp, Human
tgaaaggtgcacatgaggctgggcgcagtggctcatgcctgtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcaggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccggtcaattgag

SEQ ID NO: 57894 - DNA, 601 bp, Human
gtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcaggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacrtgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccggtcaattgagttgtgattcagggctagtttctaatcaatcaggaagccgc

SEQ ID NO: 57895 - DNA, 601 bp, Human
actccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccrgtcaattgagttgtgattcagggctagtttctaatcaatcaggaagccgcactgggatctgggatccatggatccggctcactggccaggcaggtggtaaaattaaaagattagcatttcaggtgctaagatgatacctattccaaagccccttttcctaaactaactacacactctccctttcatcttccactattaatatggtctttaaaggggtatttatcaatcttttaagccagtctgcatctgaacccttcttttgtgtatgtggaagaacagagtcaatcttctactataaat

SEQ ID NO: 57896 - DNA, 601 bp, Human
tatattagattgcttcttttcatctggtgacccctggagtttctagacttccataataccacctgaacaaccccaatgtaaaatgcacttatccctttcctgattatgccagccaaagtgccagcactaatacttaacagctttgattggcccagattggatcacatgcccattcctgaatcaatcactgtgaccagcaggatggaatatttccattggctgggacaggcccacttgaccactgctggagccatgttacatggaagccatgttacacccatgttacatggaagaattgaargagggtggttcttctaagaaatattagaatgctgtcatcacaaaacactagaatagacagaaccacagatgcccactacccaatcaagatgaccgaagggaaagatctgaattaaggaatagatccccctacctctcaggaaatcggacttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccc

SEQ ID NO: 57897 - DNA, 601 bp, Human
gcccagattggatcacatgcccattcctgaatcaatcactgtgaccagcaggatggaatatttccattggctgggacaggcccacttgaccactgctggagccatgttacatggaagccatgttacacccatgttacatggaagaattgaaagagggtggttcttctaagaaatattagaatgctgtcatcacaaaacactagaatagacagaaccacagatgcccactacccaatcaagatgaccgaagggaaagatctgaattaaggaatagatccccctacctctcaggaaatcggayttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccccaaaatatcaagctcttctcatcaacacagatgaaaataaaagagaatacagcacatatcctttaggttagagctcagatgtcaccgccttagacaggtcttttctgactgacaccctgcttaaagtgacttcctccaatcactatctt

SEQ ID NO: 57898 - DNA, 601 bp, Human
agacaggtcttttctgactgacaccctgcttaaagtgacttcctccaatcactatcttatgtcctctttattttcatcataccacttatcagaatctgtaataatcatgcttacagagtaattgttatctttttcccagcactgaaatttaatctgaagaacaggaggcttgcttatcttgtttactgctacatactatacctggctccaggcatagtgcctgtcacatagtaattgtgcaacattttttttttttcaagacggagtctcgctctgtcacccaggctggagtgcagtggcrtgatctcggctcactgcaacctctgcctcccaggttcaagctattctcctgcctcagcttcccgagtagctgggactacaggcgcccacgaccacgcccagctaatttttgtatttttactagagacggggtttcaccatattggccaggctggtcttgagctcctgaccttgtgatccacctgccttggcctcccgaagtgctggaatcgcaggcgtgagccaatgtgccctgccaaatgtattttgattcaaagaattgatggaaactcctgggtcatgtcctagaaggtggcccaag

SEQ ID NO: 57899 - DNA, 601 bp, Human
caaaggggtaagtgcatctcttaaagctgtgaccaggaccaccacataaaggcatgtgggctgtaccttgcccaagaacaccccaccaggggggaacacagcctgaactccacccttcactccatttgccaatatgagaaccctgatgtggagctgctacctcccggaggagagagagctttttttctgatttgcacagaagtgctgtagagagctgcctgcagctgcgtcttgctgctggctgggctgcagtctctgaaccagcacaggggaatgcttattgaatgaatgaggtagaaakcacagagattttgtcaaagagctggaagtcatgggaaagggcacaagaggtcttttgcacaactcaggctatcttgccctgctctgctgtatgtgtttagttaatactaagagcgtgcaacttttgttctaaaaaataccacgccgtgttgaggttaaggaattctctagataagcagactgaaattcaatgtactcaaaatcccactgtctcctctccccagacacacacacaaatggctaaaagggcatgcacgcttggacatctacggtttatgcacagggcacctgtgaagaaagc

SEQ ID NO: 57900 - DNA, 601 bp, Human
agggcacaagaggtcttttgcacaactcaggctatcttgccctgctctgctgtatgtgtttagttaatactaagagcgtgcaacttttgttctaaaaaataccacgccgtgttgaggttaaggaattctctagataagcagactgaaattcaatgtactcaaaatcccactgtctcctctccccagacacacacacaaatggctaaaagggcatgcacgcttggacatctacggtttatgcacagggcacctgtgaagaaagcaggatgtgtgtttatggggaaggattgtttgttttgcrtcttgtgttggaccagggcatactcacagtgacttctgtgagatcctaaagatcagcgaccctcacctttggagccatcaggataacccgaagtgccttaccagaatgcacatgcttctgccttaccccagagattaagtctgggtatgagtattttggaaaagtctccatttggcttgcagaccactgcctttaaaaatactgtccaaatgaagtgatttttcaactctgatggaagcctgaaagcaatagaattagacgcccagaaaatatgttctacacataatatactaataaagg

SEQ ID NO: 57901 - DNA, 601 bp, Human
cagctggattggaaaccatggccctctgtagttggagcttgccctctgtaattctcagacgttctcatttggccaattctctccaagttcaaatcctggttcaggcattaattgccgcaggaccttggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttawctgccaggttcctcttggcatttgagtttgcatcccctggaattgcaacttttaaagtaggggattttggagatcaagggaccctttgcaaatcttgacccttctactttctaggcacaaggtgtttttgttttgttttgttttgttttgttttgttttgttttgtcaatgtctcgctctgtcgcccaggctagagtgccgtggagtgatcatggctcactgcagccttgatctcccaggctcaagggatcctcctgcctctgcctcccaaagtgctgggattacaggcatgggccactg

SEQ ID NO: 57902 - DNA, 601 bp, Human
tggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttatctgccaggttcctcttggcatttgagtttgcatcccctggaattgcaacttttaaagtaggggattttggagatcaagggaccctttgcaaatcttgacccttctactttctaggcacaaggtgtttttgttttgttttgttttgttttgttttgttttgttttgtcaatgtctcgctctgtcgcccaggctagagtgccgtggagtgatcatggctcactgcagccttgatctcccaggctcaagggatcctcctgcctctgcctcccaaagtgctgggattacaggcatgggccactgcacccagcctaggtgcaagatcttaagccacttcctttgcatctctgggcttctgtttattttaaaaaatggaatagtagtactcattgaaaagagtttttgagagcattaaatgagataacata

SEQ ID NO: 57903 - DNA, 601 bp, Human
ggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttatctgccaggttcctcttggcatttgagtttgcatcccctggaattgcaacttttaaagtaggggattttggagatcaagggaccctttgcaaatcttgacccttctactttctaggcacaaggtgtgtttgttttgttttgttttgttttgttttgttttgttttgtcaatgtctcgctctgtcgcccaggctagagtgccgtggagtgatcatggctcactgcagccttgatctcccaggctcaagggatcctcctgcctctgcctcccaaagtgctgggattacaggcatgggccactgcacccagcctaggtgcaagatcttaagccacttcctttgcatctctgggcttctgtttattttaaaaaatggaatagtagtactcattgaaaagagtttttgagagcattaaatgagataacataa

SEQ ID NO: 57904 - DNA, 601 bp, Human
gttcattgcctttttattcaaatgggaaaaatagtatactcacctcattgggttattatgatgatcagggaagctcatgcatgtaaataaagaagtagcagctcggcgcggtggctcttgcctgtaatcccagcactttgggaggctgaggcaggcagatcatgaggtcaggagatcgagaccatcctggctaacatggtgaaaccccgtctctactaaaaatacaagaaaattattagctgggcatggtggtgggcgcctgtaatcccagctactcgggaggctgaggcaggagaatggsgtgaacccgggaggtggagcttgcagtgacccgagatcgcgcctctgcactccagcctgggtgacagagtgagactccgtctcaaaaaaaaaaaaaaaaaaaaagaagtagctagcttagaatgtaagtgctcagttaatttccccaccctggaggatacactttatatgacaagtacatgcttgtgtgtgagaccacaaattatcttgcgagggggcaacaggctgagtgactgtccaacagtgtaggaatgaatttctgggttcattccttccccatcatcagcaagtcctgggcaga

SEQ ID NO: 57905 - DNA, 601 bp, Human
tgggctaggttttgactatttaatgggctttcagaaagtaattacttgaaacttgggcccctttgactaatactttttcttctgttttgtcatttttgcaagtgctttactgagaaatgcaaatggtatctgaatgaatgtagcctttgcttttgtcaaactccagttttcttgttgtgggaggagggaagtttgaagatattgaaactgtcctaattaaatgcactggtaattgcacaaaacttattcttaaaccaaaatggataaatggatcatgtggcatttatttttttctttctgtttttttttttttggttgtttttttggttttgttttttttttttgagatggagtctctctctgtcgccagactgtagagtgcagtggcgcgatctcagctcactgcaacctccgcttcccgggttcaacaattctcctgcctcagcctcccaagtagctgggactacaggtgtgtgccaccatacccagctaatttttgtatttttagtagagacagggtttcaccatgttggccaggatggtctcaatctcttgaccttgtgattcgcccgcctaggcctcccaaagtgctgggattaca

SEQ ID NO: 57906 - DNA, 601 bp, Human
tgaagttcacggccacattcaggcttcgttttgattaaccataacagatgattggcagtgggtcctattatcaggtcctctcctgcaaattcctggctgggattttttgctgggataaaaagcaaaaaacaaaaatgagttgagattcttcatttgcgctttctttcctaatgcattggagtaataatttctgagtgtcttacatttcctcttctgaaactcagcaaattcaatgtttttctttctctcgaagctgatgaccaaacacccaggcaaacgtctgggttgtggacctgaaggygaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcgtgttttccaaatgctccctgaggggtagacgtcaatgtgtctactggaacatgggtgtatgtattcacacatatgcacaaaatcactggttactaagatggacattttccattggcccagcttagtctctataaagatggaaa

SEQ ID NO: 57907 - DNA, 601 bp, Human
gctttctttcctaatgcattggagtaataatttctgagtgtcttacatttcctcttctgaaactcagcaaattcaatgtttttctttctctcgaagctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcrtgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcatcgattcaattattgtaactgtcttagctgacaactttctgagaatggttcttgggtgagcagagttcagatccatttttggactgtgataaaggatctaattttgccctcattctttctcttggttca

SEQ ID NO: 57908 - DNA, 601 bp, Human
ttccggtatattgattgggagaaacttgaacgcaaagagatccagcccccttataagccaaaagctgtaagtagcccattctctctgactgccgggtattcacacacaaggtattcttgcctgtgcctcgtgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcwtcgattcaattattgtaactgtcttagctgacaactttctgagaatggttcttgggtgagcagagttcagatccatttttggactgtgataaaggatctaattttgccctcattctttctcttggttcaactgtgtcattttttcttcatactgacattgaaaaggtcatgttgtttatctcaacagtatttaaatttaattctgaaacatacactatgtctgagtcagtaaataagatggcagttcagcagccagctcccacccaaggcaaaacagagtgaagcagagactgaagtcct

SEQ ID NO: 57909 - DNA, 601 bp, Human
ctgctgtggagtttggcattaggagctcagccagggaagctaggcagagaccagagggaggtagcatggagaatcatctccttttttttctttttttaaagacagggtcttcttctgttacccaggttggagtgcagtagcgcgatcatagcttactgcaacctcgacctccagggctcatgcgatgctctcacctcagcctcctgagtagctgggactacaggagtgtaccaccatgtctgcctaattttttatttttatttttaaataaatggggtcttggccgggtgcggtgcctcaygcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccgtctcaaataaataaataaataaataaataaataaataaat

SEQ ID NO: 57910 - DNA, 601 bp, Human
ggccgggtgcggtgcctcacgcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccgtctcaaataaataaataaataaataaataaataaataaataaataaataaatgtggtcttgccatgttgcccaggctagtctcaaattcctgggctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagt

SEQ ID NO: 57911 - DNA, 601 bp, Human
ggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccgtctcaaataaataaataaataaataaataaataaataaataaataaataaatgtggtcttgccatgttgcccaggctagtctcaaattcctggrctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatcgatgcaagccagagagcaggtgatctacctaacaggctcagctgatgttcacctcccgatggc

SEQ ID NO: 57912 - DNA, 601 bp, Human
ccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccgtctcaaataaataaataaataaataaataaataaataaataaataaataaatgtggtcttgccatgttgcccaggctagtctcaaattcctgggctcaagtgatcctccaaaaacctcagcctcccaragtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatcgatgcaagccagagagcaggtgatctacctaacaggctcagctgatgttcacctcccgatggcctgccccgcaggatgcagcctcctcagggctgct

SEQ ID NO: 57913 - DNA, 601 bp, Human
ataaataaataaataaataaatgtggtcttgccatgttgcccaggctagtctcaaattcctgggctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatygatgcaagccagagagcaggtgatctacctaacaggctcagctgatgttcacctcccgatggcctgccccgcaggatgcagcctcctcagggctgctccatcttcatggtatttggggctagaactcggtgctgtgggatgcagcagacctgtgagttgattgacagatcctgttacagtcagtgtagtatgtaggccctgtgtagtaagggcttagtgaaagggtgtataaagttaagatgtttatataaaatctcacaattttggctgggtatagtggctcacacccgtaatcccagc

SEQ ID NO: 57914 - DNA, 601 bp, Human
ctgaggtgggaggatcttgatcctgggaggttgaggctgcagtgagccatgatcatgccactgcactctagcctgggcaacagagcaagaccctgtctcagaaaaaaaaaaaaagatacatcacctacccatttgatccagcctgcctgtatgccttttacattgcaaatgcattgcatgagagccctcctccccccaatcccaggattttatatttctccttcctcaccccttcttaactgtctgccacttccaaaaggcccatggtgagcgtgtgcagagttccatgtgccttgtgggrtgtgaaaaggcatgcatgtatctgtcagcgtttctgattcatgcatgctattaaatagagtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcc

SEQ ID NO: 57915 - DNA, 601 bp, Human
ctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcrtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggact

SEQ ID NO: 57916 - DNA, 601 bp, Human
agttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagrgagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgc

SEQ ID NO: 57917 - DNA, 601 bp, Human
atatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaakggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatg

SEQ ID NO: 57918 - DNA, 601 bp, Human
gcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactytgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatgg

SEQ ID NO: 57919 - DNA, 601 bp, Human
ctaactgggagccccagggcctggctttgtcttgtagcttcctgccgtgatgcaccaggctaagtgggaaggtttctgttctatgtctaaagtagcactggcaggtcctcattctgcttgtaattgggatgggaatatgggtaggaatttagggtttggcagagcgtacaggacctctttcaagccagagcacagccctgtcagacttactcactggacatgaatgggtcagtcagccctcagcagtaaccaccagctaccatgttaagtatttgatgtgaattttatcaagtcattctcsccacaccctacaagaaacttgagcttaggggacttagctaacttgcttgaaggttgtatagctgggaattgttggagccaggattggtacccaggttagcttaacttttaagtccgtgccacacaatcagatacatagtatgaggcaatgggatgtaatggaaagcccatgggctttggaattgaacagatgggctctggatcttggctctcctacttgaccctatatgaccctgaacaaactgttaactcttaaaattatctgttaagtagagataatccttttcctgcctatctcaca

SEQ ID NO: 57920 - DNA, 601 bp, Human
cttgttaacctgaaggtgtcctggtgtcttgatggaggctgggcaggtagctcccctgagccactagcctcatgttatcaaagtcggctaggcaacagacagcagggaggagccttatcctctcctccaccatcttaccttgtccatgccctctttttacctccatttcttctccaggctctttcctttcctcctccaaagaagcaatgtctctcttgcaggtcccactcaagtgagatgtcactccctccagacagagttcctggcccttcttgggttcctttcctctgtgctcaatggyagcacctgtcccatggtcccatgcagtggcctgtgtgtgcatctgtgtcctctgctagatcttaagctcaacggggacaagaacaggtaccctcttatgtatcgccagagtccagcatgctgctcggcagaggatctacaacagccaaatattagccttccttattatcccttagcaccaaaatacacgtcaaagcagccacttgttttagagtttttttgcttcattttgttttgagacagggtctcactctgtcacccaggctgaagtgcagaggcacgatcatagcttgctgcagtc

SEQ ID NO: 57921 - DNA, 601 bp, Human
gagtggggagagggagggggaggttgtggagctgccagaagctgtttcactgtctcccatcacagcctctggggaggcccaggcgaagaaacagccttctggtgtggatgggaaattgatggtttttaaagaaaaatggtccctgaagatgctctgtgtctcagcaaatgtgcttcctagactggctggcttgggttccaacacccaggccaaagaaaaacacgcacgggtctgccttatagtcacaccaggatgccataccagcagtccctgccaccatcacctctttgttgtctgctcygcctcccctttctacagtcctaagccaccattcctctcctgtggatgactgcggcagtctctccccgatgccacggccaccaatctagctccccaaacctctgcaatccccacactgcagctgaggggactccttgacgtgtcctctggaattttgaacttatcaaaaaggaaagcaaatactaaatttcccccctcaaataggatctcctcctcgtgttcctctcttactaaatagctcaggccaaaaatgccagggtcaccaacaatgcctctcttcctcacataccccacacccaat

SEQ ID NO: 57922 - DNA, 601 bp, Human
ctgtgatcatgcctctgactcaagcatgggcaacagagcaagaccatgtctctaaaacaatgaaatattataaaaacaaaacatacgtcatcatatcattcagggctcaacattctccagcagtttctcatctagctgagatgaaaatccactgtccttacatggccatcaaggaccctgctctggctcgtggcccgctgtgtggccccttggtcactctgctctggccataccatactgacctcattgctgcttggtgactgtgccaggtgagctctgtcttggggcctttgcacttgcwgctccctctgcctagcatgcctttcctcccgacatccaaagggcaccctctctcacttcactgaggtcttgctcaaaggccatttcctccaagctgaaaatggcatcactctcactccatcccctggactttcttcttcttttttttttttttgagacagagtctcattctgtcgcccaggctggagtgcagtggcttgatctccgctcactgcaacctctgcctcctgggctcaagtgatccccccaccacagtcctcctgagtagctgggaccacaggtgtgcaccaccacacccagc

SEQ ID NO: 57923 - DNA, 601 bp, Human
aacaaaacatacgtcatcatatcattcagggctcaacattctccagcagtttctcatctagctgagatgaaaatccactgtccttacatggccatcaaggaccctgctctggctcgtggcccgctgtgtggccccttggtcactctgctctggccataccatactgacctcattgctgcttggtgactgtgccaggtgagctctgtcttggggcctttgcacttgcagctccctctgcctagcatgcctttcctcccgacatccaaagggcaccctctctcacttcactgaggtcttgctyaaaggccatttcctccaagctgaaaatggcatcactctcactccatcccctggactttcttcttcttttttttttttttgagacagagtctcattctgtcgcccaggctggagtgcagtggcttgatctccgctcactgcaacctctgcctcctgggctcaagtgatccccccaccacagtcctcctgagtagctgggaccacaggtgtgcaccaccacacccagctaatatttgtatttttggtagagacggggtttcaccatgttgcccaggctggtcatgaattcctgagctcaagt

SEQ ID NO: 57924 - DNA, 601 bp, Human
aagacagggttttgccatgttggtcaggctggtctcaaactcatgacctcaggtgatctgcccacctcggcctcccaaagtgctgggattacaggtgtgaaccaccacgcctggcccagaacctgtgcttctgactccctctggtcatcaccaggactctcattggcctctcaaagtcgttatccaaaatggaattaatcatctttctcagttttcacactttctctgtctcagttcatacaaccacagtctctgtcattcaaaccagagacttcatcatccccatccttgtcttcccgcyggccccttccccacttcattagttagtcagccaccaggctgccaccgtacttgtatatttatttatttatttatttatttatttatttatttatttattttgagagagagtctcgctctgtcacccaggctggagtgcagtggcgcgatctcagccgactgcaacctccgcctcccgggttcaagctattctcctgcttcagcctcctgagtagctgggactacaggtgcccatcaccacgcctggctaatttttatatttttagtagagacggggtttcatcatgttggctaggatggt

SEQ ID NO: 57925 - DNA, 601 bp, Human
aaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatc

SEQ ID NO: 57926 - DNA, 601 bp, Human
ctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtrttcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaa

SEQ ID NO: 57927 - DNA, 601 bp, Human
agaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaagsaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatg

SEQ ID NO: 57928 - DNA, 601 bp, Human
aatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtrctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgg

SEQ ID NO: 57929 - DNA, 601 bp, Human
ttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtactcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaata

SEQ ID NO: 57930 - DNA, 601 bp, Human
ctatagcaccccacaggctaacagcaagcaggacaagacaaaaagggcaggtgggacatggtagagatggaccctacccaggaaacagctccatcagcatcttagcctgccccactctagccacacatacccacgtgtactcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaataagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagcc

SEQ ID NO: 57931 - DNA, 601 bp, Human
agctccatcagcatcttagcctgccccactctagccacacatacccacgtgtactcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatscttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggt

SEQ ID NO: 57932 - DNA, 601 bp, Human
caggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgwgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccac

SEQ ID NO: 57933 - DNA, 601 bp, Human
aaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtraaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagactt

SEQ ID NO: 57934 - DNA, 601 bp, Human
agcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttggscaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagttt

SEQ ID NO: 57935 - DNA, 601 bp, Human
ttcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttaygctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaa

SEQ ID NO: 57936 - DNA, 601 bp, Human
ttagggttgcccataacagcatcaggagtggacagatccccaaaggactcaaagaacctctgggtccaagggtagaccaccagcagcctaagggtgggaaaatagaccaataggcagagagagtcagtgcctatcagaaacccaagagtcttctctgtctccacatgcccagtttctattggtctccttaaacctgtcttgtaaccttgataccaacctgcccagggcctcaccaccaacttcatccacgttcaccttgccccacagggcagtaacggcagacttctcctcaggagtcagrtgcaccatggtgtctgtttgaggttgctagtgaacacagttgtgtcagaagcaaatgtaagcaatagatggctctgccctgacttttatgcccagccctggctcctgccctccctgctcctgggagtagattggccaaccctagggtgtggctccacagggtgaggtctaagtgatgacagccgtacctgtccttggctcttctggcactggcttaggagttggacttcaaaccctcagccctccctctaagatatatctcttggccccataccatcagtacaaattgctactaaaaaca

SEQ ID NO: 57937 - DNA, 601 bp, Human
gtgtaaagtttttttttaagttacttaatgtatctcagagatatttccttttgttatacacaatgttaaggcattaagtataatagtaaaaattgcggagaagaaaaaaaaagaaagcaagaattaaacaaaagaaaacaattgttatgaacagcaaataaaagaaactaaaacgatcctgagacttccacactgatgcaatcattcgtctgtttcccattctaaactgtaccctattacttatccccttcctatgacatgaacttaaccatagaaaagaaggggaaagaaaacatcaagsgtcccatagactcaccctgaagttctcaggatccacgtgcagcttgtcacagtgcagctcactcagtgtggcaaaggtgcccttgaggttgtccaggtgagccaggccatcactaaaggcaccgagcactttcttgccatgagccttcaccttagggttgcccataacagcatcaggagtggacagatccccaaaggactcaaagaacctctgggtccaagggtagaccaccagcagcctaagggtgggaaaatagaccaataggcagagagagtcagtgcctatcagaaacccaagagt

SEQ ID NO: 57938 - DNA, 601 bp, Human
tagggagattatgaatatgcaaataagcacacatatattccaaatagtaatgtactaggcagactgtgtaaagtttttttttaagttacttaatgtatctcagagatatttccttttgttatacacaatgttaaggcattaagtataatagtaaaaattgcggagaagaaaaaaaaagaaagcaagaattaaacaaaagaaaacaattgttatgaacagcaaataaaagaaactaaaacgatcctgagacttccacactgatgcaatcattcgtctgtttcccattctaaactgtaccctrttacttatccccttcctatgacatgaacttaaccatagaaaagaaggggaaagaaaacatcaagcgtcccatagactcaccctgaagttctcaggatccacgtgcagcttgtcacagtgcagctcactcagtgtggcaaaggtgcccttgaggttgtccaggtgagccaggccatcactaaaggcaccgagcactttcttgccatgagccttcaccttagggttgcccataacagcatcaggagtggacagatccccaaaggactcaaagaacctctgggtccaagggtagaccaccagc

SEQ ID NO: 57939 - DNA, 601 bp, Human
tgggccagggcattagccacaccagccaccactttctgataggcagcctgcactggtggggtgaattctttgccaaagtgatgggccagcacacagaccagcacgttgcccaggagctgtgggaggaagataagaggtatgaacatgattagcaaaagggcctagcttggactcagaataatccagccttatcccaaccataaaataaaagcagaatggtagctggattgtagctgctattagcaatatgaaacctcttacatcagttacaatttatatgcagaaatatttatatgcagaratattgctattgccttaacccagaaattatcactgttattctttagaatggtgcaaagaggcatgatacattgtatcattattgccctgaaagaaagagattagggaaagtattagaaataagataaacaaaaaagtatattaaaagaagaaagcattttttaaaattacaaatgcaaaattaccctgatttggtcaatatgtgtacacatattaaaacattacactttaacccataaatatgtataatgattatgtatcaattaaaaataaaagaaaataaagtagggagattatgaat

SEQ ID NO: 57940 - DNA, 601 bp, Human
agctggagaagtaactcagaatcaggtcacacagggccatgtcgaatttttgtttttatcctaaaagcaataggaagacaatgaagtgggaagaatagaatgtgaagtgacaagatcagatttgcatttaaaaaaaaacccaatcactttgctgcaagcagaactgattgaattgagtcttgccaatctctggtgagtccagtgagagagtgattgggaaagggagtttctgtaagcctatgttatttcctctaagagctgacttattttatcatgaatgcatttgagatgttcaggcagkaaaatatcttcattaaggcattcttctatctttagcatgtagttagttatttcttaggttttcagtacaaaagattatggcaagccaagaagaataatttcagtgtgttcaatttaagcttagttataaaaaatttattccaccgtttggggttcaagtatttgtctattttgtgttattggtaaaatgatgaaagttatctgtgtatacaagcaataagtacaactgactagtatttaatttggtgtcatttcaaataaagaagtgtaaataaatatccattttgtcaggtttttattg

SEQ ID NO: 57941 - DNA, 601 bp, Human
taactattctctagaaaaatatatggaatatttaatggcttttataaaaaatagcagctttattgagatataattgacataccatggaatacatttttaaagtatacagttcagtagtttttagtgtattcatagttgtgcaattgtcatcactatttaatttcagaacactttcattacaccaaagaagaacactatattcattatcagtcactccccatttccctcttcccgaaggctctgcaaccattaaactgctttctatttctacaaatttgcctattctggaagtttcatatamatggtatcatactgtagtggcctttcatttgacaggcttcttcactggtgtaatattttcaaggcttatccatgttgtcacatatatcatacttcattcctttttttctgactgcagcctcgacctccagagttcaagggatcctcccacctcagcctcccaagtgcataaccatgcctcccaaatgtgtaccaccatgcccagctaatttttctatcttttgtagagatggggttttgctatgtcacccaggttgatcttgaactcctgggttcgagcgatctgcctgccttgggatta

SEQ ID NO: 57942 - DNA, 601 bp, Human
ccaggttgatcttgaactcctgggttcgagcgatctgcctgccttgggattacaggtgtgagccatggtacctggccccttcattcctttttattgctgaatattccattctatgggcaataccacattttgtttatcctttcatcaggtgatggacatttgggttgtttctagtgtttggctattataaataatgctatatgaacactcatgaatgcatttgtgtgtggacatatactttgaattctcgtaggcatatacttaggagtagaattgcttgaatttttgttaactctatgtwtatcatttttaaagaactgccaaattgttttccaaagtggctgcacttgtgagggcgatctggctgcgacatctgtcaccccattgattgccagggttgatttggctgatctggctggctaggcaggtgtccccttcctccctcagtgctccatgtgagtccttcccgaagctgcgtgctcggttgaagaggacaaccatccccaatagaagaggactggtctttggtcaagggtatacgagtagctgcactcccctgctagaacttccaaacaagctctcaaggtccaaagtggctgca

SEQ ID NO: 57943 - DNA, 601 bp, Human
gtttgagcacttgttttccctaaattcaatgatgattttattcgttttaaaaatgctatttcatatctttccttgaaggactcgagagcctattttcatctgcttaatcagattgcccctaaaggtggggaagatggacctgccattgccattgacctttcaggaattaatgtgagtgcaatttttaacttttaaaatatattgtggtaaaacagacgtagaaaatttaccatttttatcattttcagtgttcagttcagtggcattcagtacatttgcattgttgtgcagctatcaccaytatccatctctacaaacttttcatcatcctgtagggaaattctgtactcattaaacaataactccccattttccccttcccccaggccctggtaactactgttctactttttgactatgaatttgaatttcagtagcaggtacagtcaaatttagagtacagttctctacaagcagcattccccagtagagccctcagccctccattaaagtttggtgctttgctctatggaagttttttccatgcccaaggctccaagcctccatgtcaagccaactggctatcatgacggaagaaagg

SEQ ID NO: 57944 - DNA, 601 bp, Human
gggtaagttgacttggaattactacacattttgatcttattttgagttattatttgatatatttgtggaaaagtaattgcttataaacatgtataccaataaaaattatgccaattaaaacttcaattgtaaccatttttgttttattgtttaggagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccrtgcctgcacaagccgaataataatgacatcgatatgaatttactggaaggtgcgttctttctgcctttaattgacttgctatatttatcttcttatggtattgtcttacttcactgtcagagataggggattgtggtgggaaatgcaatttagtgtgtgtaggtatgtgtatctattgaaaaattaaaattatggaaggtggttgctggttttggttaaaagagaatgctggggtaaatcttttatttctccataagaggttagtgaaaactatcatacatttaaaatattctcataaat

SEQ ID NO: 57945 - DNA, 601 bp, Human
ccaacatggacaatgaattatctattagaataaaataattatttgtaggtgtttttctcctttgaaaggtccagtttgactctagtattgttctctttttaaggtttttagtgtacatgaaaaaaattacagtgttcgttatttgtcttttgtgtggtctatcgttatctgtctcataatatataatactttcctgttttgcttcatgaaatgcagatttgacccctcctaatgtaggtactgtatttagtacttttctatactctataaatatattcattctgaatgttctttttattaktaccatttattctttccatctgggttgatattttactttttgcattgttcatgctgtgttatttctctcttaatatgcccatagaatgaaacacaaataaaacttaattagaatagcagaacaaagctttgattttgtaaaatttctacctaatttgccttctataatgatgggatattgtagttgtaaacacattagaactcaattttgagaactggaattcatgatttgatgtaaaatctttatccttctcctgtgacaaaatgtcaagtaatctttgaaaggattcatttaggttct

SEQ ID NO: 57946 - DNA, 601 bp, Human
atatttactgaacctcattgaagcttacagtatatgaatcataataacaaaacattctcaatacccagttcttactcatttgtttcccagcctttctttttttcccactctcatacataccaacacccacattagtatcagaacttaaagtaaaaacagtggcagtggtaatggcagttgttgaagggaaaggcagttgtcagaggaaggcgccaatcttaagatttttcttgctaattgccctggtttggagaaagcagggattcttcttggtggggagagtatgatgtgcggtattcaygatctcagtgttcattctctcacaaaactcacacttatcccttctttcccagtgagacagaatgagaaatcaatttcatgatctttttctgcttgactgccataaccaaagttccagtgtccttgtcacctcataattacagttttgtgattaatgaacgacgtttcagatttaacaaatatattcttcaaagaatatgagtaattcattcttcttgaaggtcccgtaaaataaaataaagattatattttctatgtagatatgtaactgagagggaaaatagacaaaaaatgtagattt

SEQ ID NO: 57947 - DNA, 601 bp, Human
ttcttcttggtggggagagtatgatgtgcggtattcacgatctcagtgttcattctctcacaaaactcacacttatcccttctttcccagtgagacagaatgagaaatcaatttcatgatctttttctgcttgactgccataaccaaagttccagtgtccttgtcacctcataattacagttttgtgattaatgaacgacgtttcagatttaacaaatatattcttcaaagaatatgagtaattcattcttcttgaaggtcccgtaaaataaaataaagattatattttctatgtagataygtaactgagagggaaaatagacaaaaaatgtagatttttcagcgaagagaaatttagggtgagagattagaacttgaaaaaaaataagcaaaagcaacactgttaggttttatcagtctggaaaatttcaaaatccctctgtcagtagaaggcattgtttagagtggcatattaaaaatgatctgctttttatagtcactgaattcttgctaggtatcttttccaacttgctcgctttcttatttttcatgtttgaattctttttgctagtgttcagcatgcttttggaatttttcagtg

SEQ ID NO: 57948 - DNA, 601 bp, Human
aatttgaagagttacagagcaagctaaatgtgatcatgaatggaagaatacagtatgtgtttattaatggtcagggagggaggaggaaagcacttcatatgtcacagcacatttgagtgttaaatatatgttaactcctcttttccctcttagtaacctacttctaagatatttgttatttttattactattttttattatttgtagacgtcaaattgagcctgcaaatgaaaagaatgttttatagttctttcaatcttgtatatcagcaattaagattttacttcttgaaattgtatakcagatctagggggaaaaaaaggttttacttctaagattgctttagctgtctataatccagacaacattttccaatctggaacacatatatctttgtaatgctttaccatggctgttgcacaaatgcatagtgcctctagctttgagcatttatttaccaagacactttgaaatgttattagataaataaatgctcatttataaaatctattttactttccaggtatcaaaaattaaaataattatataatcagttgagaacaataggaagaaatatgaacccccgaagatagtttcagaa

SEQ ID NO: 57949 - DNA, 601 bp, Human
ggtagcagatacaacagactgatcagttaccttttatgcagaccagagggaacaaaatttaagcaagaaattatagggctacataatagagcaataattaaagcagattctgggaaagctgttagataatggcattgaaatcacatgaaactacagtgggtagatgatttcctgaacagttggcacaaataacagaatcctttagatctgacaaggcttgcgttcctatcatgggtgtgcaggtttatactgtctttggcactcaatgtgaagatgactgttgcaatcgctctatacgaaygagcccctggaacgcagatgattatagatttatgtgccaaattgtcctgtgagtctcacatgggccaaaatctagagagtgacttgaacttgcctataacttagaagtgatgacaggtgtaaatgtttcagtttttcaggagtctgctgataagatgtaaactaggccattccactgtctaataactttgccgaagaacaaataatcatgatagttacttagaactatttgcagtcaggagatgactagaaggcagacagtggcagagccagcccacatccctgctcactttgtggtata

SEQ ID NO: 57950 - DNA, 601 bp, Human
gtctactctaggagagagcaaggaagagagaacatttcggaactggatgaattccttgggagtcaacccatacattaatcatttgtacaggtaaatattttattgtgtttcagctttactgtcagggtccaacttttcaagtttcaaactgtaggcatgtttaaatggaacattttctcaagttgcaagaattttagccaatttttagagtttcaggatgctgggaattggcaatacaatggattttaaaagaaagctactattcaaaaaaggaataatagttatgtttttgatgatataygtaaatcagtaaagataatccttttttatagttattgattgtaaaaataatttcaactttaacagattagagtaacagtaataactgataaattgttgttatatcagtatttttattatgtcatttttcatttatttttgccaaaaccttaattattccataatttttgtgtatatttttttctaatttgtaaaagtaacttgttttccttgaataattgttatagcttatctcattctttcttgtttaaaaaatgataacacattattgacattagtagggctaagaaaatattttact

SEQ ID NO: 57951 - DNA, 601 bp, Human
tatctgcttttccttcctgcttcagtgaccttgcagatgctttagtgatctttcagctctatgagatgatccgagtgccagtcaactggagccatgtcaacaaacctccttatcctgcccttggagggaacatgaagaaggtgaatgaaataatggccatggatatattgttattgttctgatatgaaacaaagaatttagagtttcatgaagttatacgtgctctgtccccacaattctgattcagaccaaaatgtgttaagcttaatagcctttttacaagtttgctttaataaatttraagatgaaggcaatccctctagtcagacactttatataactattttcatctttatcaagtcatagtacttaatgttctttgagatgtcctgtaaatgtattctttttttacaattggtataacgttctgaatgtttattggttatccactcatttattcaacagatatttatcaattacctaatacctatacagtgttatgcaggatgtaaaaaaaaaaaaaaagtataaagcatggagttggtcctcaggaaagcctaaataaattagggaaatatgtgtgcaaacaactacaatatgg

SEQ ID NO: 57952 - DNA, 601 bp, Human
gtgtgaaaacagactaatacagtaatcatttcttccattaactctgtgagactgcactccaagtttttcttgctttctttgtgctcattcttaccttgcataggttcttcatcttttagcctgagaactcagtatttccaaggcctggttcttgggccaaaggtcttaacttttatatttacaccctcagggagcagatctgtttttagtgttttaattgcaggttgagtatcccttatccaaaatgcttgggaccagacatatttcagatattggaatatttgcagtatactggttgagsatccttaagctgaaaatctgaaatgctccagttagcttttcttttgagtattgtgttggtgctcaaaaagttttagagtttggagtattttggatttttggattttcagattagggatgctcaacctgtactaccatacacatggattacctctaggaacctaatttctcattctttctctagtttggtacctctctagatctcttagaagtgttctgccaaatttggaaccaaatattgcccataaaagaatatatgctttcccttatgctagcacctatttccagtttctctttcaat

SEQ ID NO: 57953 - DNA, 601 bp, Human
tttcagattagggatgctcaacctgtactaccatacacatggattacctctaggaacctaatttctcattctttctctagtttggtacctctctagatctcttagaagtgttctgccaaatttggaaccaaatattgcccataaaagaatatatgctttcccttatgctagcacctatttccagtttctctttcaatgctggtcctatcaatatattcttaggcctctatactagcaaccctgaactcctttctcaccatcatctcccttaggaactttggtagaactgtaaagcagatgkctcttcattgaaacacattttacacatgtgattactgcagtttgctataaaattctcccactgaactgggtgtccatggtaaatatgctggctttttactctcctgtacacagtgttaaataattcaagtgctaatgttattttccataaattaggaatctattctattttttaaagtctacattcttacagcatatatttcttttaagcgggctaagcctataatatgattccaaaaaatgttttggaatattatctctgcattaaaaaattcttttaaaaactttttagaagtagggt

SEQ ID NO: 57954 - DNA, 601 bp, Human
cattctttctctagtttggtacctctctagatctcttagaagtgttctgccaaatttggaaccaaatattgcccataaaagaatatatgctttcccttatgctagcacctatttccagtttctctttcaatgctggtcctatcaatatattcttaggcctctatactagcaaccctgaactcctttctcaccatcatctcccttaggaactttggtagaactgtaaagcagatggctcttcattgaaacacattttacacatgtgattactgcagtttgctataaaattctcccactgaamtgggtgtccatggtaaatatgctggctttttactctcctgtacacagtgttaaataattcaagtgctaatgttattttccataaattaggaatctattctattttttaaagtctacattcttacagcatatatttcttttaagcgggctaagcctataatatgattccaaaaaatgttttggaatattatctctgcattaaaaaattcttttaaaaactttttagaagtagggtttcactatggtgcccaggctggagtgcatgctattcacaggcgtgattatagcacaatacagcctt

SEQ ID NO: 57955 - DNA, 601 bp, Human
taaaaaaaatttttttttgtaggtataggaaggaattttttttttttttttttttttttttttttggagatggagtctcgctctgtcacccaggctggtgtgcagtggcgcgatcttggctcactgcaagctctgcctcccaggttcacaccattctcctgcctcagcctcctgagtagctgggactacaggtgcccgccaccacacccggctaattttttttttttttttgtatttttagtagacatggggtttcaccatgttagccaggatggtctcgctctcctgacctcgtgatccrcccgcctcagcctcccaaagtgttgggattacaggcatgagctaccacgcctggccaggaacgaatttttattggaaattacattggtttggtttagaaatatattaatgttgtatgtcagaaacatgatttatgagtttaggcatactaattatttggcctgtgtaaacttgaaatattcagttttaattactaaatttttgattggttgtccagttaagtataaatgtaggttaatattatctgactctggtaatctaatcttaaaaaataaacagaatagagctaaaaaaaatccag

SEQ ID NO: 57956 - DNA, 601 bp, Human
ccagcctgggcaacagagcgagactctgcgtcaaaaaaaaaaaaaaaaattaataaatgaagtggctcatagattgtggctcaaagaagctgttactcttcttcacatggcttcagattgttttattagatattgattaagaactgacatttggctagagcctatactagatgttttcacctataccacctcagtattcctaagaatcctatgacattctactttagagattaggaaagggtgctctggcttcaagtaacagaaacccaatttcaagtggtttaaaccaaaaggaaaggtrttgactacaataacagtaatccagaggtagggtagacttctggattggttgaaccaataattgaagaatgtcattcaggactcttttttttttttttttttcccatctctgctttgccatctaatgtgccagcttcaccctaaagctggttttccttttggtcataggatagttgctgcttgtgacagaggtttcattctctcattcacatccaggaggaggggttgctggctttccataacataggcccaaattaaattactgtggtaatagaatagcattcctctatttggcttagac

SEQ ID NO: 57957 - DNA, 601 bp, Human
acatccaggaggaggggttgctggctttccataacataggcccaaattaaattactgtggtaatagaatagcattcctctatttggcttagaccagtgttttgaaatcttaaaagaaaattatcctctaaggaatatttttagacctttttttccgtttttgtctctcccatgaaattttaatgcagagatacactgtatacctgtttatgcactgtatgctttatacataaacaaggttatcaccctacccctattgagaatgcttgacctagattaatttaggttcactcctggaactrtgaatgtcagctttccttgaagctgatgtctgtgtgaaggaggtatggatatagagcaaaaatatgggttctacttgtatgaaagaagtaaagagtgtgtagattctgggtaggcaagcagtggtggccactattcaagctgagagagaaaacaaataatttgttcaagtactgataagtggtaaaaatcagttcagaccaggatgtctgatttcatctgcagtgcgctattcactataatttagttgtccatttttagcttgccttggtggtaacttaaaaatggagagactcttgggc

SEQ ID NO: 57958 - DNA, 601 bp, Human; identical to SEQ ID NO: 23572

SEQ ID NO: 57959 - DNA, 601 bp, Human; identical to SEQ ID NO: 23573

SEQ ID NO: 57960 - DNA, 601 bp, Human; identical to SEQ ID NO: 21235

SEQ ID NO: 57961 - DNA, 601 bp, Human
aaatgttaaaaaaaattagaaagtgatcatttcacttctttaagaaaaacgcttctttttagaaacgggacatgatgatgctcagcagtaaatacatatgaggtgtaatgagaatctgtgagcttcctagcagtttgaaaacaggtaaatgttaattctcttaatagactgagtataccaataggaaataccttagaagtttaaaaatcaacaatgccagcaaaattgaattgtcttacattcctatactatcaaattgtgatggtccttgaaaacccaggtctacaggtgggagagaaaytatggggaagaaaaataaatatcccacagcatctctaaaagtgaatgccaccttacctggcacttttgtctctgctttctagttcattatataattagtgacttgtgcacagatatcccatttgtgtcactgaagtcaaaaggctatgaagtaagatataaccatgtcccatgacattcttttaacataacatgactcactttatttctttcatccctaaaaattcactttaaagaaaaagtggatcccggagcagtggctagaacctgtaatcccagctactcaggaggctgaggcaga

SEQ ID NO: 57962 - DNA, 601 bp, Human
gagaccagcctggccaacatagcgagatcccatctctaaaaaatgttaaaaaaaattagaaagtgatcatttcacttctttaagaaaaacgcttctttttagaaacgggacatgatgatgctcagcagtaaatacatatgaggtgtaatgagaatctgtgagcttcctagcagtttgaaaacaggtaaatgttaattctcttaatagactgagtataccaataggaaataccttagaagtttaaaaatcaacaatgccagcaaaattgaattgtcttacattcctatactatcaaattgtratggtccttgaaaacccaggtctacaggtgggagagaaactatggggaagaaaaataaatatcccacagcatctctaaaagtgaatgccaccttacctggcacttttgtctctgctttctagttcattatataattagtgacttgtgcacagatatcccatttgtgtcactgaagtcaaaaggctatgaagtaagatataaccatgtcccatgacattcttttaacataacatgactcactttatttctttcatccctaaaaattcactttaaagaaaaagtggatcccggagcagtggc

SEQ ID NO: 57963 - DNA, 601 bp, Human
tgccccatttttgtcttccttttgtaataaaactcttcaaaacagttgcccatatcattatctccactttgttcctctcgtctctcttaatcccttgctgatgaaggtttccttcctgcctctccactcacacagctcttgtcaaggtcgccaaagaccctcacatgatcaaagccaatggctaatcctaaatctactaatggagacacagagcatcccctcacttttgaacaatcttcttcactaagcttttaagaacactatggccaggagcgggggctcacgcccataatcctagcaytttgggaggccaaggtgggcgggtcatttgaggtcaggagtttgagaccagcctgaccaacatggtgaaaccctctctctactaaaaatacaaaaagtggccaggtgtagtggcaggcacctctcatcccagctacttgggaggctgaggcaggagaatctcttgaacctgggaggcggaggttgcagtgagctgagattgtgccactgcactccagcctgggtagcagagtgagactgtctccaaaaaagaaataataataataataataataataataataataataatgaaagaaca

SEQ ID NO: 57964 - DNA, 601 bp, Human
atctttacgaacacctctgccccatttttgtcttccttttgtaataaaactcttcaaaacagttgcccatatcattatctccactttgttcctctcgtctctcttaatcccttgctgatgaaggtttccttcctgcctctccactcacacagctcttgtcaaggtcgccaaagaccctcacatgatcaaagccaatggctaatcctaaatctactaatggagacacagagcatcccctcacttttgaacaatcttcttcactaagcttttaagaacactatggccaggagcgggggctcaygcccataatcctagcactttgggaggccaaggtgggcgggtcatttgaggtcaggagtttgagaccagcctgaccaacatggtgaaaccctctctctactaaaaatacaaaaagtggccaggtgtagtggcaggcacctctcatcccagctacttgggaggctgaggcaggagaatctcttgaacctgggaggcggaggttgcagtgagctgagattgtgccactgcactccagcctgggtagcagagtgagactgtctccaaaaaagaaataataataataataataataataataata

SEQ ID NO: 57965 - DNA, 601 bp, Human
gttggcctcaagctcccgacctcaagtgatccgcccgtctcagcctcccaaagtgctgggattacaggcgtgagccaccatgcctggcctaaattgtctttttttatgcaatgatatttatgtttggtatggttcagggcagtaactcaaggtcacgggtccagcaattctctccctcctccaacatcaagttttttctctactggatttatttacaccattagcatacaaatgtacttctcactcgtataataaaaacaaccacaaaaaaaacctgtcttcagcccacatctttacgaayacctctgccccatttttgtcttccttttgtaataaaactcttcaaaacagttgcccatatcattatctccactttgttcctctcgtctctcttaatcccttgctgatgaaggtttccttcctgcctctccactcacacagctcttgtcaaggtcgccaaagaccctcacatgatcaaagccaatggctaatcctaaatctactaatggagacacagagcatcccctcacttttgaacaatcttcttcactaagcttttaagaacactatggccaggagcgggggctcacgcccataatcc

SEQ ID NO: 57966 - DNA, 601 bp, Human
taatctgacttctgttatgaccaccctacctctcatccaataaatccttagtatgtttaaacctgagttatggaaaggagttgaattcaggtagggtccatgtgtcatatgcaaatcagaagacggtgaataccctggtagaagaagttccaccccatagcttagagccagctgtggatcctgttacagaaagattaaggagagtgtatgtaaagaatctagcagtcttgctctgtcgcccaggctggagcacaggggcacgatctcagttcactggagcctctgcctcccgggttcaagygattctcctgtctcagactcccaagtagctgggattacaggtgcctgacaccacgcttgcctagtttttgtatttttaatacagatggggtttcaccatgttggccatgttggcctcaagctcccgacctcaagtgatccgcccgtctcagcctcccaaagtgctgggattacaggcgtgagccaccatgcctggcctaaattgtctttttttatgcaatgatatttatgtttggtatggttcagggcagtaactcaaggtcacgggtccagcaattctctccctcctccaacatcaagt

SEQ ID NO: 57967 - DNA, 601 bp, Human
gtggcaaacctacaaaggtttgtacaaaggtttagaaggctattttagccttctaaaatagtccatagggttatggaatgagatatggaaagaacggctgttcagctagaatctgcactcaggcctccacagaagccacaaatctcacagctaaggccctgcgggagaacgggcagtataaattctgacgaccagtcattgggagacttcagagtatggtgtttggtataaagtgatggatggttctggtatggggaaaccacatggcatgaacttggggacagacagaactgtgtctgcrttccagcttactgaccgggaggccttggcaaatcattaaccatactgaatccatttgtaaaatgggataacaatatctaccttctaaggttgttattagtgtaacgatatctaccttctaaggttgttattagtgtaatttgtgcatcctaagtaacaatgatacttggcagtttgtccaaatttactaggtcccttgcccctacctgccacatagcagtagatgattccttctctttgtctcacttgtttttcttgttttctggagggagacatgtcatagacaatgtcccagctgctg

SEQ ID NO: 57968 - DNA, 601 bp, Human
ccaccttctgcctttctgtctgtgctttcctcttctatgtttactccctttgaccctctactatcctgctcttgcatccttgaggctgcttgaccgctgttagatgtttggcccaagagccctctgccctcctcagcaaaaaatcagcaaagcaatgccaaacagggacataaatcatagcgataaggcacgccaggctccaggaagcaccagagcttgcccaaggtcactccacagcttcaagcatgatcagaaactgaagttccatagctgggtgtggtggctcatgcctgtaatcccwgtacttagggaggccgagggaggcggatcatgagatcaggagtttgagaccagcccggacaacacagtgaaaccctgtctctactgaaaatacaaaaattagctgggtgtggtggcacgcccctgtagtcctatctactgggggaggctaaggcaggataatcgcttgaacccaggaggcagaggttgcagtgagccgagattgcgctattgcactccagcctgggcagcagagtgagactgtcttcaaaaaaaaaaaaaaaaaaagagagagaaaagaaaactgaagtctctaactgta

SEQ ID NO: 57969 - DNA, 601 bp, Human
aaactgatagtaccaattaggggacaaaaatgacatcatacacttactgatgggagctagtgtgaagaacacagcttcacccatgcagtgttcttactgaaaacatttaacctgtatcaaatcatttggaaacagccagttagtctaagtcgaggcacattccacaaaacagcatggcctggacttttcaaaaatgtcagtttcatgaaagatgaaataagagaataaagaaggtggaaaactctttcagattaaaggagactaaagagtcatggcaatgggccaggcgtggtggctcacrcctgtaatcccagcactttgggaggccaaggcgggtggatcacaaggtcaggagttaaagaccagcccggccaagatggtgaaaccccatctctactaaaaatacaaacattagccaggcgcggtggcaggtgcctgtaatcccagctactcgggaggctgaagcacgagaatcgcttgagcccaaggggtggaggttgcagtgagttgagattgcgccactgcactccaacctaggcaacagagcaagactccgtcccaaaaaaaaaaaaaaaaaaaagtcatggcaatgtacagtcac

SEQ ID NO: 57970 - DNA, 601 bp, Human
gctgggcgtggtggctcatgcctataatctcagcactttgggaggccaaggcgggcagatcacttgaggtcaggagttcgagaccagccgggccaatatggtgaaaccctacctccactaaaaatacaaaaattagctggacatggtgacgtgtgcctgtaatcccagctactcaggaggctgagacaggagaatcgcttgaacctgcggggaggaggaggttgcagtgagctgagattgtgccactacactccagcctgagcaacacagtgagactgtctcaaaaaaaaaaaacaaacacacaacaacaacaacaaaatgctgtccacctagaaattttacaggttagaaataaaaataatttaaggggcaaaaaagcaatagcataaattatgtcttttatcaatgtgaattacaaaaatcacttttcctgcctcctcttgctctgtgacatttgttttctagagtctacagtgtgtggcagggtgtgtgtagtggcggcagaacactgacagatggtggtatgtgcttaatctccttgcaaactgggagtctttaagaaggtaacgagccagcttgttggtttctgcttctgttgttc

SEQ ID NO: 57971 - DNA, 601 bp, Human
actgtcggctgggcgtggtggctcatgcctataatctcagcactttgggaggccaaggcgggcagatcacttgaggtcaggagttcgagaccagccgggccaatatggtgaaaccctacctccactaaaaatacaaaaattagctggacatggtgacgtgtgcctgtaatcccagctactcaggaggctgagacaggagaatcgcttgaacctgcggggaggaggaggttgcagtgagctgagattgtgccactacactccagcctgagcaacacagtgagactgtctcaaaaaaaaaaaacaaacaaacaacaacaacaacaaaatgctgtccacctagaaattttacaggttagaaataaaaataatttaaggggcaaaaaagcaatagcataaattatgtcttttatcaatgtgaattacaaaaatcacttttcctgcctcctcttgctctgtgacatttgttttctagagtctacagtgtgtggcagggtgtgtgtagtggcggcagaacactgacagatggtggtatgtgcttaatctccttgcaaactgggagtctttaagaaggtaacgagccagcttgttggtttctgcttct

SEQ ID NO: 57972 - DNA, 601 bp, Human
ctccatctcaaaaaaaaatttttttttttcaaaaatttaaagtgaaagacacaagccttgcccctttaagaatgtttccattcattctgtataaaaattactccttccttccttccttccctccctccctcccttcctccctctctttctctctctctttttttttatttttggccagggtctcactctgtcacccaggtgggagtgcagtgactcaatcacactcactgcagccttgaccttccaggcttaggtgatcctcccatgtcagcctcctgaatagctgggaccactggtgcayaccaccacacctgggtaattttcacattttttgtagagacaaagtttcacttgttgcccaggctggtcttgaactcctgagctcaagcgatttgcctgctttggcctcccaaagcgttaggattacaggcgtaagccaccatgcccagccaataattactaccttttagtgtggtttacagttttttgtttttttttttttttgagacggagtctcgctctgttgcccaggctggagtgcagtggcacgatctctgctcactgcaagctccacctcccaggttcacgccattctcctgcc

SEQ ID NO: 57973 - DNA, 601 bp, Human
gagcttgcagtgagctgagatcgtgccactgcactccagcctgggcgacagagcaagactccatctcaaaaaaaaatttttttttttcaaaaatttaaagtgaaagacacaagccttgcccctttaagaatgtttccattcattctgtataaaaattactccttccttccttccttccctccctccctcccttcctccctctctttctctctctctttttttttatttttggccagggtctcactctgtcacccaggtgggagtgcagtgactcaatcacactcactgcagccttgacctyccaggcttaggtgatcctcccatgtcagcctcctgaatagctgggaccactggtgcacaccaccacacctgggtaattttcacattttttgtagagacaaagtttcacttgttgcccaggctggtcttgaactcctgagctcaagcgatttgcctgctttggcctcccaaagcgttaggattacaggcgtaagccaccatgcccagccaataattactaccttttagtgtggtttacagttttttgtttttttttttttttgagacggagtctcgctctgttgcccaggctggagtgcag

SEQ ID NO: 57974 - DNA, 601 bp, Human
catcaatagtggtaagtcgctgaggcgggcagatcacaaggtcaggtgtttgagaccagcctggccaacatggtgaaaccccgtctctactaaaaatacaaaaattagccgggtgtggtggcaggcacctgtaatcccagctacttgggaggctgaggcaggagaatcgcttgaacccgggaggcggaggttgtagtgagtcgagatggtgccactgcgctccagcctgggcaacagagcgagactccatctcaaaaaaaaaaaatagcggtaagtcatgttgatagtatgtacacttgaygggatgggacgtggtcttctagcccataaccctggtctaatcatgagaaaaaacagacaaattccaatagagggacattctacaaaatatgtgaccagtactcctgaaaactgccagagtcatcaaaaacatgtaaactctgagaaactgtcacagccaagaggaggctgcggacacagcctcctctaaatgattactaaatgattactaaatgtaatgtagtttcctagaagggattctggaacagaaacaggaaattcaacaaaaaattaaagaaatgcgaataaagtatggatggac

SEQ ID NO: 57975 - DNA, 601 bp, Human
agaagaaaagtcactttacagtggagaaacctgacgacactacctcagccaggtgatcaaggtcaacatcaatagtggtaagtcgctgaggcgggcagatcacaaggtcaggtgtttgagaccagcctggccaacatggtgaaaccccgtctctactaaaaatacaaaaattagccgggtgtggtggcaggcacctgtaatcccagctacttgggaggctgaggcaggagaatcgcttgaacccgggaggcggaggttgtagtgagtcgagatggtgccactgcgctccagcctgggcaasagagcgagactccatctcaaaaaaaaaaaatagcggtaagtcatgttgatagtatgtacacttgacgggatgggacgtggtcttctagcccataaccctggtctaatcatgagaaaaaacagacaaattccaatagagggacattctacaaaatatgtgaccagtactcctgaaaactgccagagtcatcaaaaacatgtaaactctgagaaactgtcacagccaagaggaggctgcggacacagcctcctctaaatgattactaaatgattactaaatgtaatgtagtttcctagaagg

SEQ ID NO: 57976 - DNA, 601 bp, Human
gcaagattggcagcatccagtgctgacaagggcatagggaaaggggtgttctcacacatggccaattagagtgcaaactgctataacttttttgggaaagttactggcaatatttattacattaaaaccaaacggaccaaaaaaatgagcaaaagatctgagcagatacctcactgaagaagatataatacagatgggaaattttaaacatatgaaaagatgattaacatcttttgtcattaggaaattccaaattacaaccacaatgagataccattacacacctattagaatggctaamatcccccaaaaagctgataataccaaatgctggtgaggatactgagcaacagaacctctcattcactgctggtcggtgtgctaaatcagacagccactttggaaaacagtttggcagtttcttacaaagctaaacatatctataccatatgagccagtaatcacactcctaggtatttacccaaatggttgaaaactatgtccatatgaaaacctacaagcaaatgtttttaacagctttattcataatcaccaaaaactagaagcaaccaagttgtcttcctataggaaaaaggatgaa

SEQ ID NO: 57977 - DNA, 601 bp, Human
aaactaccttactcctctctctctattgactccactgacctcaggggtagaactcaaagggacacctctgatcctcaaaccagtctgcagcgaatagctggaggtgtccatcatagccccaacattgtgaatgtttgcattcacaagggtttggatgtttctgcttcaatgctgaatggagttcttttgggacgtacaaacgaattagatgagaagaactaagcaacatgatggacaaactgttacaggcttacccaacatgttcacggtacatacaagtaaacttaatagacagaacagrttaaattaccatatataccacaaagatgtttggggctcatttaatgacaattccttcctatatacaagtctgtgaagccaaagcctcaggtctggggcgtctgtgctgggctaatcttgaatctcttggtgctccttaccaggccagtatcaccgtccttcagttaatgctctatctagaagcacgggcctgctcggactcagattgactttctcttgtacaaaagtttccacttttgctgctgctattttattttagtcttccttttattttctctttgtgttttttaaaattttcatt

SEQ ID NO: 57978 - DNA, 601 bp, Human
agggctgagagatgcctggtgggcttccctgggttggggtcgagtgaccttattggaaacggtatcggtgcagtggtgagaccagaagccagattatgtggacttaacatctcaaactaccttactcctctctctctattgactccactgacctcaggggtagaactcaaagggacacctctgatcctcaaaccagtctgcagcgaatagctggaggtgtccatcatagccccaacattgtgaatgtttgcattcacaagggtttggatgtttctgcttcaatgctgaatggagttctttygggacgtacaaacgaattagatgagaagaactaagcaacatgatggacaaactgttacaggcttacccaacatgttcacggtacatacaagtaaacttaatagacagaacagattaaattaccatatataccacaaagatgtttggggctcatttaatgacaattccttcctatatacaagtctgtgaagccaaagcctcaggtctggggcgtctgtgctgggctaatcttgaatctcttggtgctccttaccaggccagtatcaccgtccttcagttaatgctctatctagaagcacgg

SEQ ID NO: 57979 - DNA, 601 bp, Human
gagaaactggccctgaggaagtgaccttgagccgagtctagagggtaaaggtctgaccaaaccaagggcaggggtggtggtaaaggcaaagatggcagctttccaggcagtgactggccctgagtcaggagagaacttgggtcacttcagcaactgaaagacagtgtggctggtgggtgaagctcgtggaatcaaggccagccagtcagaaggcagatcctacagggccttgcaggccacgctaagcaattcactctatcctagtgcaatgggaagccactggaaggatttcagcaagacrtgatatgataccatggggctcttaaaagctcactacagcaacaggatatagaatggcttggaggacgcaaaatggatgaagtggctgttgatagctgacattgtggtgacttggagcagagcagaggcagggtagtcggtgagaagcattgtcttgagatgtattttgttatcagaatagtccggatgtggtgatcggctggaggtgagggacaggggagaaggaagtgtcaaaaatgacacaaaggtttacacactggaactgtcaaaaatgacacaaaggtttacacactggggcaga

SEQ ID NO: 57980 - DNA, 601 bp, Human
agtcaaattgctttccaaaaggattgtgaatatttaccccttggccaggagtatgacagtatttttaccatattatggccagctttaaggagcctatagacaatttaaggcttgtgatatatattgccaaattgcttcctttgagggcttacagtgcctctggcaacacaggaaggtgtaacttgtctctcccatcttcctccatgagatgatcttcaaataattgcaaatagctgataacttatctctcaacctgtttttagaataattttaatatagaaagatgatcattaatactaamtcctaatgaggggttataaatattaaattatcaatattttaaaataaattattaactttcactgggttgccaggattccaggtgacccgaaaatactccagagcagcagatatgtggtctggcatagcacccttatgaagccagtccccgtctagctgtgttcatatattcaacaaatatccctagagccctgtgatagttaatactgagtgccaacttgattggattgaaggatgcaaagtactgtttctggctgtgtctgtgagggtgttgccaaaggagattaacatttgagtcaga

SEQ ID NO: 57981 - DNA, 601 bp, Human
taagttctgtaggcctcagttttccatctgtaagagtaagaagcgcaagggctgtactgccaattacacacaggcacatacaacagggtcaggtaaatattaacctctctgtaaaggttaattattgatattgttacctttgggttaaatctatttttatttagaatgatttttctctattcattttattcaacaattatttatatatcttaaggtgcatatggcactgtgttagccctaaggatatagagacaaataaagcaagtactgcccctaccggcctggagcttagaacctaggmaaggagacagatgttggagaagtaattatagctatgataaatgttataaaaatgaggtaaagtgtacctggtttgagggtgaggtgtggttcagggaaaatctctttgaggaagtggccattaagttaatgattcattaactgagaatgacctgaagttaactgggcaccatctagagccccagaaatgtggctctaactagatagagtcaaattgctttccaaaaggattgtgaatatttaccccttggccaggagtatgacagtatttttaccatattatggccagctttaaggagcc

SEQ ID NO: 57982 - DNA, 601 bp, Human
tagctgggcgtggcggcacgcacctgtaatcccagctactcgggagactgaggcatgagaatcacttgaacccaggaggcagaggttgcagtgagcccagattgtgccactgcactccagccagggcaacagagcaaaactctgtctctaaataaataaataaatttattttaaaaaaggaaacaaaactgaggttctgataactgcatgtattaaatattcaaataacatgtaggttctttccaattttttgctattataaataagattttgataagcaacttattagctggttgcctcwcttggaccaaattaggtaagttctgtaggcctcagttttccatctgtaagagtaagaagcgcaagggctgtactgccaattacacacaggcacatacaacagggtcaggtaaatattaacctctctgtaaaggttaattattgatattgttacctttgggttaaatctatttttatttagaatgatttttctctattcattttattcaacaattatttatatatcttaaggtgcatatggcactgtgttagccctaaggatatagagacaaataaagcaagtactgcccctaccggcctg

SEQ ID NO: 57983 - DNA, 601 bp, Human
tgcttcagttgggtttttgtcacttgaaaccaaagaaatcctgagtaatacagcagagtagacacccggattgctcccagtgaaataccatgtttgttttagtctcaaacttcctagtagccattgcctttggaatcttcctttcaatctccaagcccttctacctccctggtcaggcatagactaactaatatccttccttttcttagagactgagatcacttctatgcagagataaagtaccaaagaaatcaagttcaatctaatgatgcttctgctggtttcttcattaaagtgactwttttttttatccttttgtaacattttttgtaatctttctgctgtccaccttggcagcagagtatgttgtacaaacactggctgtttttaactagtctttttttttttttttttttttgagacagagtctcaccctgttgcccaggctggagtgcaatggtgcaatcttggctcactgcaacctccgcctcccaagttcaagcgattctcctgcctcagcctcccgactggctgagattacaggcacccgccaccacgcccagctaatttttgtatttttagtagagatggggtttcacta

SEQ ID NO: 57984 - DNA, 601 bp, Human
accttgttatgattattcttctttaaaatcattttgtaactatcaatttattggtttgctaattcagtcattctacaagtactgagtatgtaccaagtgccaaatatgcagctagaagacactgagaatccacaggtgaggaaggcccagctcttgcccttgaggattgtgcattttactgggcaaatgggatatgtaaataaacaatcccagaagatgttatagaggccagggtgctggcaggcatcataaaggagtcatatgtgagatgtaggaaggacagcaggagtcttccaggtasaatagagaaagtaaggaaacccacgtttgctgagcaaacagcatgtcctgaacctagaatgcaaggaatttggtaggatgggtcatgtattatgggcaaactggtggggagtggggtggtagagtgagtaagatcttgtatctcatgctggggggatttccccataccagtaagctttggggagctattaaaggattctatgtagagggtggcatgctcaactttgtattttaagaaatctgtacttagaaatataagaagtgatcacaggacattctgagggtaagtatactaacctaa

SEQ ID NO: 57985 - DNA, 601 bp, Human
catgaactttttcctatgtcaatatatgttttatctgttaacataagctttattcttaatgggtccactgtattctatcataaaactttattataatttacgtaactaattatctattgttggatatttcagttgattgcaattttttctttataaacaatacttaaaaatatcccataacaataaatacttttgtaattaagtttttgcacatatattcaaatattttcttatggtaaattgttcaaagtagacttgctgggtttaagataatgcctctaagacttttaattccacacaytgattgccaaattgccttctggacaggttgctccagcagagtacttcataatctcttttgacaatattaggctttagaaattttaaatcaaagtaacctttaaattgaaaatccaaaccttgttatgattattcttctttaaaatcattttgtaactatcaatttattggtttgctaattcagtcattctacaagtactgagtatgtaccaagtgccaaatatgcagctagaagacactgagaatccacaggtgaggaaggcccagctcttgcccttgaggattgtgcattttactgggc

SEQ ID NO: 57986 - DNA, 601 bp, Human
atgttattcagagaaggaactggtggtaattaaatctgtgcaggaaagaatcaatgaagtcttatgtctggctgaacatataggtaggcagaaaaatgaggagaaaacatccaaaccagttatttgtaaaactttgacacagggagaccaatcatctatagaataatagatacaaagttttttaaattctgtataagacaaggaatggttgtgattggggacaattataaaaacataaacctaagcactgggaattataattgacatgtattcatgttactgtaacaggatacatatctcrtggtataaacttgcttgtgttagtagcaacatgaagttggatcttctccaaaagctttccaagggagtaccagaagttacaagcatgttaataagaagatgaattagtgtccatttcaggttcaaatgagaagtctttgagtctgatttggcaagaattatttttaataattaaacattaaaacattactataataataaacatgaaaaatataaaagcacaaataaaatgaaaaatatcaataacaatcataactcatcactagtaatattcagattacttgtcttttttcccatctac

SEQ ID NO: 57987 - DNA, 601 bp, Human
agtattaatatagggttaccagtaccaggcaactttagttcctacaaacatttccccaaataaattatataaaaggagcatataaaagtaaattatagttgcatatcattattgctcctttaatccccagcacagctaatccccagaattacaaaactctcaaatgtaaaaactctgtacaaactacttagtgccatcttgaactggctactcacttcacttctttactcagtttcttttctgtaatgcagaggcctcagactctgagatcccttttagctgaaacactcataataagagrggccagtttttcactgttggagaagggagttacaactataaaaaggggaaaaatagatagaatatattctgtggtgttggatttagagagagagagagagagacagcgtgagagtgctgtgctagaaggggttgatcaccttatataggatggcccagaaaggttctctggttaagggaacatctaaaatagtggttaagtggtgagaagtggccagatttgggctatatttttaaaatagagcttccaggattttctgagggattggatgtgggagaaagagaagaatcaaggaatgac

SEQ ID NO: 57988 - DNA, 601 bp, Human
agctcaagaaaagaaaaaataaacgaagataggctttagtagtgaaaaatcttaggtgacacatagtcatcttactcatcaatcattccatgaatccaaaatgtaaaaatatgcgaccagcacaccgctgaagtctagggagaacaggttaacaaaaatgcaaacatctacttctttggtaaggacatgaaaacctacagggatttcaacaagtatttataaccacctatctcaaacatctgtgacaccactgggaaactgcctggtaacttaagctccattttcacaaggaattttttaytgatgtaaagttaagttactattcagcacaaaagatgctgtttattttctcaagttgccccaaacagacagccttgaagcaggactcatcttccatgtgtgggcatgtggtctctcagagcagcattgctgttgtttgtttggttttttagataatgaagactttactgattatagcaaagagctttacattgcaaaccattctatttgttttttagcatcccagatctgccctaccagggtcttgatgcagtctctcttgctcccccatcgtaaattgttattaaatgttaataataat

SEQ ID NO: 57989 - DNA, 601 bp, Human
ggtgaggtctcctgcccatctcggcctccccaaagtaccaggattatagcgtgaaccattgcacccagcccaaggaagttcattatgatttttcccatggtctggagaccatgggcatagtagagtagggaatttggacaatgctggggaaaaactagttaactttaccttgataggtctaggtctaaaagttggttggctctaagctacctaggttcaactgctaagaaatgataaaggacaggtgtggctccagcaggcaggcagcgctgccttcctatgcaacaggctggctagactmtgttatcagcagcctctaaatgagcagtaaggctaaagtctcgctagccaatttgctccaattttctttttctctgttagactgacctccaatgcagggtgagccatggggctcaggaggtgaataacaaccaaagcctagctagcctggcctacagagctctctccaaaatgggtaactcaccatatcttcagggtctggaattttcactccactgaagtactgattcgtgctaaacacttgctggtgcctaggaatgagatcccctttggacaagaaaagaaaaaggtaagtgaaatt

SEQ ID NO: 57990 - DNA, 601 bp, Human
ataaaagtggcagtgtgtgagctgccgactggagtgactggccaggctcatctaatcaaacagtcctggtgctgtggccagctttcacagtacagtattattttggacaggcaaccagctcccaataaccaattctggattgtacacatactaatcattgataagagtaggagagaagagcctctgtttcagagttccctatgtcaacaggagaaaaaaaaaatcctaaagtaggtttgtattagcccttgacagtagcccctgttgcaccctcatacttccactcatgctccatagcttmaatatttctcttgttctttctgtcggttgaatctgagcatcactggggtttgacgtgccattgctatatcatcgagctctgctgtctcagcaacaatgtctggatgaggccagctggttgcctgtgatacgctggagcccatctgtgagcgtttcacagccccagaagcaagcaggcctccctctgtcagggttactgacaggcagagggactggggcacagatgttcaaccagtgcagcccccgcactgcctcttcctgtgtttctgtcaacaggaaatctgcaggacaatctctggga

SEQ ID NO: 57991 - DNA, 601 bp, Human
ggaaaatacttgcaaatgttttcttaataggttgtgatccatttaaaaaaattgaaaatatacttttccaaggagaattttttttttttttgagacggagtcttactctgtcacccaagctggagtgcagtcgtgcaatctcaactcactgcaacctccgcctcccaggctcaagcaattctcccgcctcaccctcctgagtagtcgggattacaggcgagcgccaccacgcctaattttttttatttttagtagagacggtttcaccatgttgaccaggctggttttgaactgacctcargtgatctgcctgccttggcctcccaaagtgctaggattacaggtgtgagccactgcccagccaggagaagaattctaaaaggaacacttttcattgcatggattgacataagtaattcagattccccagtgatgacaactgctgtgtgcttcctggtctgttggaagccatgatttttacctttaggagccccagggcaggataagagatgtttgggaattttaattcaagtggttcctgttgaaaagaaaagaggtttttaatttacagcatgtattcaaattaaggttacctcaaatt

SEQ ID NO: 57992 - DNA, 601 bp, Human
ggacattgactgtaacttgcaaacattttagttgataccatacctcattttacataagagctatatttctaaatatatatatatataaatatatatatcaagtttttaaatgtacttcaaatgtaccagggagttagctatttaaaaggatcctgcagctaaggattttctgaagaaaaagttccctttgtaaaacaatcaccacccccctgaaatttctgttttgtgtaaatttagacttcaaatataatgttaggtttatttaaagtggaaaatacttgcaaatgttttcttaataggwtgtgatccatttaaaaaaattgaaaatatacttttccaaggagaattttttttttttttgagacggagtcttactctgtcacccaagctggagtgcagtcgtgcaatctcaactcactgcaacctccgcctcccaggctcaagcaattctcccgcctcaccctcctgagtagtcgggattacaggcgagcgccaccacgcctaattttttttatttttagtagagacggtttcaccatgttgaccaggctggttttgaactgacctcaagtgatctgcctgccttggcctcccaaagtgc

SEQ ID NO: 57993 - DNA, 601 bp, Human
ctatagagtagccattcttttattcctttactttgttaataaatttgcttccactttactgtgtggacacgccctgaattctttcttgcatgaggtccaagaaccttcctttggggtccggattgggacccctttcaggtaacagttacattatcatttatattaactcattatttaatacgtcagtaaataaataatttttaaaccatgtgggacattgactgtaacttgcaaacattttagttgataccatacctcattttacataagagctatatttctaaatatatatatatataartatatatatcaagtttttaaatgtacttcaaatgtaccagggagttagctatttaaaaggatcctgcagctaaggattttctgaagaaaaagttccctttgtaaaacaatcaccacccccctgaaatttctgttttgtgtaaatttagacttcaaatataatgttaggtttatttaaagtggaaaatacttgcaaatgttttcttaataggttgtgatccatttaaaaaaattgaaaatatacttttccaaggagaattttttttttttttgagacggagtcttactctgtcacccaagc

SEQ ID NO: 57994 - DNA, 601 bp, Human
tgcctatagagtagccattcttttattcctttactttgttaataaatttgcttccactttactgtgtggacacgccctgaattctttcttgcatgaggtccaagaaccttcctttggggtccggattgggacccctttcaggtaacagttacattatcatttatattaactcattatttaatacgtcagtaaataaataatttttaaaccatgtgggacattgactgtaacttgcaaacattttagttgataccatacctcattttacataagagctatatttctaaatatatatatatawaaatatatatatcaagtttttaaatgtacttcaaatgtaccagggagttagctatttaaaaggatcctgcagctaaggattttctgaagaaaaagttccctttgtaaaacaatcaccacccccctgaaatttctgttttgtgtaaatttagacttcaaatataatgttaggtttatttaaagtggaaaatacttgcaaatgttttcttaataggttgtgatccatttaaaaaaattgaaaatatacttttccaaggagaattttttttttttttgagacggagtcttactctgtcaccca

SEQ ID NO: 57995 - DNA, 601 bp, Human
cagttccagaaaatccctgccctctcctggaaaactcataaataatccaccccttgtttagcatataatcaagaaataactgtaagtatactcagttgagcagcccacagcactgctgcctatagagtagccattcttttattcctttactttgttaataaatttgcttccactttactgtgtggacacgccctgaattctttcttgcatgaggtccaagaaccttcctttggggtccggattgggacccctttcaggtaacagttacattatcatttatattaactcattatttaatacrtcagtaaataaataatttttaaaccatgtgggacattgactgtaacttgcaaacattttagttgataccatacctcattttacataagagctatatttctaaatatatatatatataaatatatatatcaagtttttaaatgtacttcaaatgtaccagggagttagctatttaaaaggatcctgcagctaaggattttctgaagaaaaagttccctttgtaaaacaatcaccacccccctgaaatttctgttttgtgtaaatttagacttcaaatataatgttaggtttatttaaagtg

SEQ ID NO: 57996 - DNA, 601 bp, Human
caggattcttcacagtctcccagtgtgcagtttggatgctgttctctggttaaatgtattcagctgataccaccaaaagcactcatcactgtatttgccctagccaactctgacaaaggatcagggaggaaaacagctccttttttggacaaacctggagtgttagttttaatactaaaagtgtacatgatgacacagaactgcatggggaaaatctgattttattttccaaagcccaaaaagtctccttagctggactcatactcatgtaccttgttgagacctgtgctcatgcaggctrgaaaccctggcccctgtgtggcatcaggaagcagcaggacaagggcacctttaggattcagggagagggggcttcaggagacagatgtccctggggccctggttgatagatcctatgacctgtctcctagtgctggaatgaggatgctggagctgaaagccacaactgccatcctcaagtctagattccaactctctgtaccaggtggcaggtaggagatcatttcaaattataaccttggatgtttctgtaaagcagtggtgctttcggctctttcttagggtcttccttgttggtttg

SEQ ID NO: 57997 - DNA, 601 bp, Human
ccaactacagttcattctaaattattacagcttttggcttatcacaagatgcttaatgtaaggccattttataccaatcaggattcttcacagtctcccagtgtgcagtttggatgctgttctctggttaaatgtattcagctgataccaccaaaagcactcatcactgtatttgccctagccaactctgacaaaggatcagggaggaaaacagctccttttttggacaaacctggagtgttagttttaatactaaaagtgtacatgatgacacagaactgcatggggaaaatctgatttyattttccaaagcccaaaaagtctccttagctggactcatactcatgtaccttgttgagacctgtgctcatgcaggctggaaaccctggcccctgtgtggcatcaggaagcagcaggacaagggcacctttaggattcagggagagggggcttcaggagacagatgtccctggggccctggttgatagatcctatgacctgtctcctagtgctggaatgaggatgctggagctgaaagccacaactgccatcctcaagtctagattccaactctctgtaccaggtggcaggtaggagatca

SEQ ID NO: 57998 - DNA, 601 bp, Human
cagccattgtcctcagaaaagtgctttttagtacttttaaatcagttgattctttcaggatttaaaagcagtacaccaggccaggtgcggtggctcatgcctgtaatcccagcactttgggaggccaaggcggatggatcacctgaggtcaggagtcgagaccagcctgccaacatggcgaaaccctgtctctactaaaaatatagaaattagttaggcatactggcacgtgcctgtaatcccagctactggggaggctgaggcaggagactcacttgaacctgggaggcagaggttgcartgagccaagatcataccactgcactctagcctgagcgacagagtgagactcagtctcaaaaaaaatcaatacaccaaatagtggagtttccctattttttcaaatagaaatatttccatcaaaaccttttgctctcgaatacagactaatactgagataaggaataattctggcgtgggggtggaggagtctgtttctggcctgttgtgctacctgggtcacatatgatggagaataaaacattaattttgtaactgtgatctacattagggccctggagttcatgctgtacttgttcct

SEQ ID NO: 57999 - DNA, 601 bp, Human
gcactgtatgtccttcggtatccctaaaaagggaactgtttagtacttttactttctagaaaaaaatttttcagccattgtcctcagaaaagtgctttttagtacttttaaatcagttgattctttcaggatttaaaagcagtacaccaggccaggtgcggtggctcatgcctgtaatcccagcactttgggaggccaaggcggatggatcacctgaggtcaggagtcgagaccagcctgccaacatggcgaaaccctgtctctactaaaaatatagaaattagttaggcatactggcacrtgcctgtaatcccagctactggggaggctgaggcaggagactcacttgaacctgggaggcagaggttgcaatgagccaagatcataccactgcactctagcctgagcgacagagtgagactcagtctcaaaaaaaatcaatacaccaaatagtggagtttccctattttttcaaatagaaatatttccatcaaaaccttttgctctcgaatacagactaatactgagataaggaataattctggcgtgggggtggaggagtctgtttctggcctgttgtgctacctgggtcacatatgat

SEQ ID NO: 58000 - DNA, 601 bp, Human
atgccttgtcttatagcggagaaaactgataaacagagcacctaggcaatttgcctactcactctcttcccttagttaaaaaggcaaatcaagcatggcacagtgtacacttgtagttccagctacaagggaggctgagtgggagcatcccttgagcccaggagagcagcctgggcaacatagcaagatccccatctctaaagaaaaaagacaaactgcttccttcaagcttcctgaaaatgtttgaatttattgtcaatgtcaaatgaaagaacacacctgtattttttgtattgcactrtatgtccttcggtatccctaaaaagggaactgtttagtacttttactttctagaaaaaaatttttcagccattgtcctcagaaaagtgctttttagtacttttaaatcagttgattctttcaggatttaaaagcagtacaccaggccaggtgcggtggctcatgcctgtaatcccagcactttgggaggccaaggcggatggatcacctgaggtcaggagtcgagaccagcctgccaacatggcgaaaccctgtctctactaaaaatatagaaattagttaggcatactggcacgtgcct

SEQ ID NO: 58001 - DNA, 601 bp, Human
tccagcactttgggaggccgaggcgggcggatcacaaggtcaggagatcgagaccatcctggctaacacggtgaaaccccgtctctactaaaaatacaaaaaattagccgggcgtggttgcgggcgcctgtagtcccagctactcgggaggctgaagcaggagaatggcatgaacctgggaggcggagcttgcagtgagccgagatcaggccactgcactccagcctgggcgacagagcaagactctgtcttaaaataataataataataataataataataataataataataataatatcctcatccatgaatcattttccagctcctctgctgtgtgatcttgggcacattagtaaacctctctgtttcctggtttctcatctgtaaaatgaggatgctaaatccctatttacagcatcattgtgggggataagtgtattattataaagaacctagaaaagtgtttagctgcatatgcagttgtgtgttgcttaataaaaggaatctgttctgagaaatgcgtagttagatgatttcacagttgtgtgaacatcagagtacatttacataaacctagagggtacagcatactgcacac

SEQ ID NO: 58002 - DNA, 601 bp, Human
ctacaggtgcacaccacaatgccaggctaatttttgtatttttagtagagatggggtttcaccaagttggcaaggctggtcttgaactcctgacctcaagcaatcttccccgccttggcctccaaaaatgctgggattgcaggcgtgagtcaccgcacccagccctccatctcttaactctgctttcttgtgggtgttttcctccatcctcaatcattcttttccctcatggaggcagatgagggtgaccaactactccagatttatttatttatttatttatttatttatttatttattaaaagtctaagttttgctctgtcacacaggctggagtgcaatggcatagtcatagctccctgcagcctcaaacttctgggctcaggagattctcctacctcagcttcccaagtagttgggactaataggtgtgcgtcaccatgcccaactgtttttttaatgttttaaaaacattaaaacacagccagacatggtggctcacacctgtaatcccagcactttgggaggccgaggcaggtggatcacgaggtcaggagatcgagaccatcctggctaacacggtgaaaccccgtctctacta

SEQ ID NO: 58003 - DNA, 601 bp, Human
agcaaataatgtagaactcaggagacattcccgggagtggggttaatcagaagtcaacatggcaattagcatccaagatggggccactttgtcttcacacagaacctctctgtgactcagtttccctatctttcaaatggagataaaactagtccctaccttataggattgttgtaagaattaaaaatgaggtaataattgtaaagtcgtaaagtgcttcaagcagtatccattaaatgattgataaataaatcattggtaaatgatttaccagtgatactgataaatgacttctttatcrtttatgaaaaattgataaatgatttatttaccaataaaccaacggtaaatgatttatttaccaataaaccaacggtaaatgatttatttaccaataaaccaacggtaaatgatttatttaccaataaatcaacggtaaatgatttatttaccaagggtaaatgtcactcattgataaatgacttattggtaataaatcaattattagtttattggtttattggtaataaatcatttatcaatgagtgaaatcatttgggacaaagaagagagagggaaaagaggtggtctgagggttggg

SEQ ID NO: 58004 - DNA, 601 bp, Human
cgcacccggctagtccactctgagatcaagcctagatatcctttcttgtgaccgtctctgccatgagctaccaggacatgacgaatctgccttccttcttgctgcctgttagagatataccctggtgatctaatcacctcttaaaggtcccgcttctcaacaccattgcattggggattatacgttcccaacatgtgcacattcaaaccatagcagcgtttaagcactccaaggatatgggtctactgccttcagcctgacttgctattgagtgtgtactcgagagagaggtgggagaaayacttcaaaggcttcaaaatcatttatttgtccttctttatagggaccccgggagatatggcagaatatggggtgcttggggtgacagccacttgctgcattttgattacatggccacggtttgggcatatcggcacctgagaccacccttggttcactcccttcctccctccccctcgcttactctgctccaggcacacagatctcctggctccaacatgccagggcctcagggcctttgcactggctgttccctctgcctgaaatgcttttttctcagagcctttgcactaacctcagg

SEQ ID NO: 58005 - DNA, 601 bp, Human
ttcactatctgtctcatttttttttttttgagatggggtcttgctctgttgcccaggctggagtgcagtggcatgatctcggctcactgcaacctctgcctcctgggttcaagcgattctccttcctctgctttccaagtagctgggactacaggcgtgttccaccacacccagctaattttgtatttttagcagagacaggtttcactatatgttggccaggcgcgtctcaaactcctgacctcaagtgatcaacccacctcagcgtcccaaagtgctgggattacaggcatgagccacyacacccagcttcttttttttgttttgttttgttttttgtttttttgagacatcctcggtctgttgcccaggctgtgcagtggcatgatctcggctcactgccacctccgcctcctgggttcaagcgattctcctgcctcagcctccagagtagctgggattacaggcgactgtcaccacgcctggcaaatttttgtgtgtgtgtgtgtgtgtgcagtcggggtttcaccatgttgcccaggctggtcttgaaccccgacctcaagtgatccgcccgcctcagcctcccaaagtgctggga

SEQ ID NO: 58006 - DNA, 601 bp, Human
gatctaacgctgcagctgatctgacaggaggtggggctcaggtggtaatgcgagcaatggggagtggttgtaaatacagatgaagctatgctagctcacctgcccaccactcacctcctgatgtgtggcccagttcctaacagaccatggaccggtaccaggaggcttgtactgggagctactctggaggctgaggtgggaggatcacttgagcccaggaggtggaggctgcagtgagctgtaatcatgccactgcactcaactgggcaacagagtgagaccctgtcttttaaaaaaaagwtaaaatcactcctgtaatcccagcactttgggaggccaaggtgggcagatcatgaggtcaggagttcgagactagtctgaccaagatggtgaaaccccatctctactaaaaatacaaaaattagctgggcttggtggcacacacctgtaatcccagctactcaggaggctgagcaggagaatcgcttgaacctgggagccagaggttgcagtgagtcgagattctgccactgcactccatcctgggtgacagagtgagactctgtctcaaaaaaaaaaaaaaaaaaagaaaagaaaaagt

SEQ ID NO: 58007 - DNA, 601 bp, Human
gtggggctcaggtggtaatgcgagcaatggggagtggttgtaaatacagatgaagctatgctagctcacctgcccaccactcacctcctgatgtgtggcccagttcctaacagaccatggaccggtaccaggaggcttgtactgggagctactctggaggctgaggtgggaggatcacttgagcccaggaggtggaggctgcagtgagctgtaatcatgccactgcactcaactgggcaacagagtgagaccctgtcttttaaaaaaaagttaaaatcactcctgtaatcccagcactttsggaggccaaggtgggcagatcatgaggtcaggagttcgagactagtctgaccaagatggtgaaaccccatctctactaaaaatacaaaaattagctgggcttggtggcacacacctgtaatcccagctactcaggaggctgagcaggagaatcgcttgaacctgggagccagaggttgcagtgagtcgagattctgccactgcactccatcctgggtgacagagtgagactctgtctcaaaaaaaaaaaaaaaaaaagaaaagaaaaagttaaaaaaaaggccgggcgcggtggctcaag

SEQ ID NO: 58008 - DNA, 601 bp, Human
gcaatggggagtggttgtaaatacagatgaagctatgctagctcacctgcccaccactcacctcctgatgtgtggcccagttcctaacagaccatggaccggtaccaggaggcttgtactgggagctactctggaggctgaggtgggaggatcacttgagcccaggaggtggaggctgcagtgagctgtaatcatgccactgcactcaactgggcaacagagtgagaccctgtcttttaaaaaaaagttaaaatcactcctgtaatcccagcactttgggaggccaaggtgggcagatcaygaggtcaggagttcgagactagtctgaccaagatggtgaaaccccatctctactaaaaatacaaaaattagctgggcttggtggcacacacctgtaatcccagctactcaggaggctgagcaggagaatcgcttgaacctgggagccagaggttgcagtgagtcgagattctgccactgcactccatcctgggtgacagagtgagactctgtctcaaaaaaaaaaaaaaaaaaagaaaagaaaaagttaaaaaaaaggccgggcgcggtggctcaagcctataatcccagcactttggga

SEQ ID NO: 58009 - DNA, 601 bp, Human
aagctatgctagctcacctgcccaccactcacctcctgatgtgtggcccagttcctaacagaccatggaccggtaccaggaggcttgtactgggagctactctggaggctgaggtgggaggatcacttgagcccaggaggtggaggctgcagtgagctgtaatcatgccactgcactcaactgggcaacagagtgagaccctgtcttttaaaaaaaagttaaaatcactcctgtaatcccagcactttgggaggccaaggtgggcagatcatgaggtcaggagttcgagactagtctgacyaagatggtgaaaccccatctctactaaaaatacaaaaattagctgggcttggtggcacacacctgtaatcccagctactcaggaggctgagcaggagaatcgcttgaacctgggagccagaggttgcagtgagtcgagattctgccactgcactccatcctgggtgacagagtgagactctgtctcaaaaaaaaaaaaaaaaaaagaaaagaaaaagttaaaaaaaaggccgggcgcggtggctcaagcctataatcccagcactttgggaggccgaggcaggtggattgcctgaggtca

SEQ ID NO: 58010 - DNA, 601 bp, Human
aaaaaaaaaaaaaaaaaaagaaaagaaaaagttaaaaaaaaggccgggcgcggtggctcaagcctataatcccagcactttgggaggccgaggcaggtggattgcctgaggtcaggagtttgagaccagccttgccagcatggtgaaacccgtctctactaaaaatacaaaaattagccaggtgtggtggcaggtgcctgtaatcccagctactcgagaggctgaaggaggagaatcgcttgaacccaggaggcggagtttgcagtgagccaagatcacaccattgcactccagcctgggwgacaagagtgagacttcatctcaaaaaaaaaagttcaaaaaaaccccaaccaattctctcctccccaataattaccttaggacaacaggcataagcttgggtcatccttggcaaactaggaggtaagtcactctatgtagcagagaaccaaagtaacaaggacttaaataaaactgaagattatttatttcttatgcaataatctgagcttaatcagtccaaggctggcatggtcctttctacaaggtcaaagaccagctcctcctgttctgttcttccgccacctgtgaatttcctttg

SEQ ID NO: 58011 - DNA, 601 bp, Human
caaaacggatcaggaagaccactgaggaggctgttgcagccacaaaggtgatcactgcggtggctgctctaggatttgggaacagggatggtgagaagagcttagatgtgacagatagtttggatgtagaatctgaataatctattgattgactggaaatggaggattcaatgaatcctccatttccagccaggtgcagtggctcatgcctgtaataccagcactttgggaagccaagacaagctaattgtttgaggccaggagttcaaaaccagcctggacaatgtaacaagaccctgtmtctacaaaaaataaaaataaaaataacgttatctgggcatggtggtgcatgcctgtagtcccaacactcaggaggttgaggcaagaggatcaattgaacccaaaaggtggaggctgcagtgagctatgattgtgccacttcactccagtctgggtgacagagcaagacctcatctctacaaataaaaagttagccaggtgtggtggtgcatgcccatagtcccagctgctcaggaggctgaggcaggaagattgcttgagcccaatttcaaggctgcagattgcactactgcacttcagc

SEQ ID NO: 58012 - DNA, 601 bp, Human
caagagaagctggaatggagatccatgaggtctctgaggatcagacagacacatcacagctaactctggcccaaagggtacttcattaggataacaccagctactgtaacaaacaagacatttcagtgacttcacatggtaaaaattgatttcttgtacacaaaacagtacaatgcatgtgcttctagttccaggtcggggggcttttccccgcagataattcagggacccaggctactttcatttgcagttttgccatcccttagagtctcagcctgcagaaaatagggagagaggaggyatggagaagtaatttctccttaaatacagtgccctgaaagtgatgcttatgacaaatgctcctattctattggccagaagcagtcacatgactgcatccacatgcaaggagagatgggaaatgcagtccttagctgggcagccattttccagcagcaattccatattatggaagagaaaacacgaatattggtggatctttagtggcctctgcccgaggtagacagcaggaatagaactaagggcttggaggcagtaacactcagtttgatttgtgctcttgagtaaacccttcttctca

SEQ ID NO: 58013 - DNA, 601 bp, Human
acagtgtttcggtctaggttttctgaagaccttctttatcaggttacagaagttcccttccatttttactttgccaagagatttttttccccctctttcttttgatcaggaatgaatgttgagttgctaccgcatctttcatgtgtcttctgttgcagatttctctttttgacaaaaagagaacaggtcttgggtcagagccttgggcgagcaacagaatctacctagaatttagtaacgttgtttgaaccatatttattctacagttgcttcttcttttatttatttatttatttatttkgagacagggtctcattgtgttgcctgggccggagtgcagtggtgcgatcatagctcactgcagcctctacctcctggcctcaagtgatcctcctgcctcagcctcccaagtagctgggactactggccatcacaccaggctaatttttgtattttttgcagagacagtgtctctccgtgttgctcaggctggtcccaaacccctgacctcaaagtgatcctctcgccttggtttcccaaagtgctgggattacaggtatgagccatcacacccatcatacagttgtttctgtttgtagcc

SEQ ID NO: 58014 - DNA, 601 bp, Human
acaacaagagaagcaaaactaaggggatagaaaacgccggagtaggggtgtgggattttatgaaattttaattaatttatgtatatatttattttctgagatggggtctcgctctgttgcccaggctggagtgcagtggcaccgtcgtggctcaccgcagcctccacctcctgggctccaacaatcctcctctctcagcctcccgagtagctgggactacaggcacccgccaccttgcctggctaattttttgtgtttttagtagagacgggatttcaccgtgttagccaggatggtctcratctcctgacctcgtgatccgcccgcctcggcctcccaaagtgctgggattacaggcatgagccaccacgcccagccttaaatttgtttttgtagaaatgggatctcattatgtggccccaggctgattttgaacacctaggctcaagtgattctctcacttccacctcccaacgtgctgggattacaggtgtgcaccaccacacccagctgactttttattttttgtggagatggggtctccctgtgttgaccaggctggtcttgaactcctgggctcaagtcaacctgggagtgggat

SEQ ID NO: 58015 - DNA, 601 bp, Human
attaatttatgtatatatttattttctgagatggggtctcgctctgttgcccaggctggagtgcagtggcaccgtcgtggctcaccgcagcctccacctcctgggctccaacaatcctcctctctcagcctcccgagtagctgggactacaggcacccgccaccttgcctggctaattttttgtgtttttagtagagacgggatttcaccgtgttagccaggatggtctcgatctcctgacctcgtgatccgcccgcctcggcctcccaaagtgctgggattacaggcatgagccaccacrcccagccttaaatttgtttttgtagaaatgggatctcattatgtggccccaggctgattttgaacacctaggctcaagtgattctctcacttccacctcccaacgtgctgggattacaggtgtgcaccaccacacccagctgactttttattttttgtggagatggggtctccctgtgttgaccaggctggtcttgaactcctgggctcaagtcaacctgggagtgggattttaaatagggtggctagaggaggtctcacagagaaggtgtcctttgaggaaagacaaagacgttggcaa

SEQ ID NO: 58016 - DNA, 601 bp, Human
tgggtgccacaacaaagtaccacgagcttggaggcttaaacagcagaaatttatcttctcacaataaatgtcttgttcacctccctatcctcccctcttcttcctcctcgcccactctaactccagccacatgggcctccttgctgttcctccaacatgttaggcaagatcctgcctcaggaccattgcatgcactgttctctcttcttggaatacactttcttgtgtgctatgggttgaactgtgtccccccaaaatttatacattgaagtcttaacccctagtacctcagaatgtggcwgtatttggatatggagtatttacagaggtagttcagttagaatgaggtcatctgtgtgggccctaatgcactgtgactgatgtccttataagaagagtaaactagggtgcaggcagggcaagaccacgtcacagtgcagggagaaggtggctgtctactgaaatgagcccttagaggaacctacaaatatctagtcctaaaaagtagaaacaaactggccgggcgtggtggctcacacctgtaatcccagcactttgggaggccgaggcgggtggatcacctgaggtcaagagttcaaga

SEQ ID NO: 58017 - DNA, 601 bp, Human
tgttcacctccctatcctcccctcttcttcctcctcgcccactctaactccagccacatgggcctccttgctgttcctccaacatgttaggcaagatcctgcctcaggaccattgcatgcactgttctctcttcttggaatacactttcttgtgtgctatgggttgaactgtgtccccccaaaatttatacattgaagtcttaacccctagtacctcagaatgtggcagtatttggatatggagtatttacagaggtagttcagttagaatgaggtcatctgtgtgggccctaatgcactrtgactgatgtccttataagaagagtaaactagggtgcaggcagggcaagaccacgtcacagtgcagggagaaggtggctgtctactgaaatgagcccttagaggaacctacaaatatctagtcctaaaaagtagaaacaaactggccgggcgtggtggctcacacctgtaatcccagcactttgggaggccgaggcgggtggatcacctgaggtcaagagttcaagaccagcctgaccaacatggtgaaacctcatctctactaaaaatacaaaaataagctgggtgtgatggcgggtgc

SEQ ID NO: 58018 - DNA, 601 bp, Human
acactcttttcataaaatctaagaagttatgtttctgaacctattgagcctttataggaacatatgaatatccagtcctaaaaactagaaatgagcgatctgtgaaaacactttgtgatgtgctgtttcatatcacagaatgggacctgtgttttgaagaaaccaaccctactgacaccttgatcttggacttctagtctcagaactatcttggacatttcctatgaatagaattgtacaatacatggcattttgtgatttgcttctttcactgagcatgtttttaaggttcatccatgtygtagtgtggaacagtattttgctccttttttatggctgagtaatattccattgtgtggatttgcctgtactggacatttcctataaatagatgcatgcaatacgtggctttggaagatggattttaaccaactctactgacgagtctgctttaggactcttggtccagactgacttcatggagagtgttgggggttgtgggagaggccaagcctacaagctgtgggaagctggtggatggaaggctggttagaattcttcaggatctggggaacctcagagagtgctgaacctgttggga

SEQ ID NO: 58019 - DNA, 601 bp, Human
ggggtcagtttctcccctgccctttcgtactgccccaccctcatttctctgtctcctcacagttcctgtgccttaagaacattagaaccttcctgtccacctgctgtgagaagttcggcctcaagcggagcgagctcttcgaagcctttgacctcttcgatgtgcaggattttggcaaggtgagctgcacacttgaagcccaaagactgagtttcagttaatttctattgacgtctacactgggcaagctaaggactgtcaggggacaggcagacaagccagaccaggccatatacaagaygcaaatagcactggcttgggatatgtggaactgggtttgagttcctgctctgacacttgctgtgtgaccttggatacgtggctgtgcctctctgagcccctcgtttctcatctgaaatatgggaatattatcatcctgccctctctgagtggctatgaggattaaatagaaagatagagggccgggcgcagtggctcatgcctgtaatcccagcactttgggaggctgaggtgggcggatcacgaggtcaggagatcgattccaccctggctaacacagtgaaaccccgtctctactaaa

SEQ ID NO: 58020 - DNA, 601 bp, Human
tatatacaaagtatatataaaaatataaacatataatatgtataaaatataaacatgatatatgatatttataagatataaaatatatagtttttcatatagagctatatgtaaataatatatacaatatataaatatataaaatataaaatgtagatatattgatataggtatatatctttttatatagatatatatttttaatatacaagatatatgtccatatgtagatatatatacctttatatatcttatatacataaaagatatatatctttatctatctatcttttttttttttgagacacggtttctctctcattgcccaggctagagggcaatggcaagctctcgctttactacaatctctgcctaccgggctcaagcaatccttctgcttcagcctcccaagtagctgggattacaggcatgcaccaccatgctcgactaatttttgtatttttagtagagacgaggttttgccatgttggccaggctggtctcgaactctgacctcaagtgatctgcccacctcggcctccaaaagtgctgggattgcaggcatgagccactgtgcctggcttatatatctatcttttaa

SEQ ID NO: 58021 - DNA, 601 bp, Human
atatacataaaagatatatatctttatctatctatcttttttttttttgagacacggtttctctctcattgcccaggctagagggcaatggcaagctctcgctttactacaatctctgcctaccgggctcaagcaatccttctgcttcagcctcccaagtagctgggattacaggcatgcaccaccatgctcgactaatttttgtatttttagtagagacgaggttttgccatgttggccaggctggtctcgaactctgacctcaagtgatctgcccacctcggcctccaaaagtgctggrattgcaggcatgagccactgtgcctggcttatatatctatcttttaaagatatatatcattatttaaagatatatatataaagtatgtataagatatgtaatagatacaaatatatattttatatatattttttgttatgttaaccaggctggtcttaaactcctgggctcaagcaatcctcctgtaatccaagccctttgtgaggctgcactgggcctcttcctcttgtctctctgtctctctctttatctctcactctgtctctttttccctctgggtctcctctcgctactttcttc

SEQ ID NO: 58022 - DNA, 601 bp, Human
cctcttgtctctctgtctctctctttatctctcactctgtctctttttccctctgggtctcctctcgctactttcttcctcagtgtgtcattctctcctttgtagctctttatcccaggctcagtctttttctgtatcctcacctctccatttcttttaaaaatagctttattgagatttcattaatatacatgtaatccacccatttagaatatacagttcaatggtttttggcacacacaagattatgcagtcatcatcactgtctaattttggaatattttcatttgttttgttttgkttttttttgtttctttttttttgatttgttttgttttgaaatgtggtctcactctcccatccaggctggagtgcagtggcacgatcatagttcactgcagcctcgaactcctgggctcaagtgatccccctgccttaacctcctgaggagctggggccacgggtgcatgccaccacaccctgcttaattctttaattttttttgtagatatggggtcttgctatgttgcccaggctggtctcctactcctggcctcaagtgatcctcctgccttggcctcccaaagtgttgggattttgg

SEQ ID NO: 58023 - DNA, 601 bp, Human
tcattctctcctttgtagctctttatcccaggctcagtctttttctgtatcctcacctctccatttcttttaaaaatagctttattgagatttcattaatatacatgtaatccacccatttagaatatacagttcaatggtttttggcacacacaagattatgcagtcatcatcactgtctaattttggaatattttcatttgttttgttttggttttttttgtttctttttttttgatttgttttgttttgaaatgtggtctcactctcccatccaggctggagtgcagtggcacgatcrtagttcactgcagcctcgaactcctgggctcaagtgatccccctgccttaacctcctgaggagctggggccacgggtgcatgccaccacaccctgcttaattctttaattttttttgtagatatggggtcttgctatgttgcccaggctggtctcctactcctggcctcaagtgatcctcctgccttggcctcccaaagtgttgggattttgggtgtgagccaccaccccggccttaattttagaacgttttcatcatctcccaaagaaaccccaaactctttagctgttccccttcaat

SEQ ID NO: 58024 - DNA, 601 bp, Human
ggggtttcaccatcttggccaggctggtcttgaactcctgacctcgtgatccacccacctcaggctcccaaagtgctgggattgcaggcgtgagccaccgcacctggccggaccacatttgaaacacccatttacccattgataagcattttggttgtttccgcttttgggttattatgaataatttcactgtgaacattcttgtacaagtttttgtgtggacgcgctgcctctctttatctccctctctctgtctccttcccctgtctctctgagactggtctggaggagggaatcttaycttccgtcatctttctctcccttccccgcagcatttcttgaagcccctgcaacggttcctgaaacctcaagacattgagatcatctttatcaacattgaggtgagccggccgatccccagccctcttgggtctgtctagtgcggataacctgctgcccctacctctccctggagtacgggggttgggagttgagcggcatggggcgggtggatgaccctttccttcctggccccctgagccctgggctctggtcccagccctcacccttccctccgagtaggacctgcttcgtgttcata

SEQ ID NO: 58025 - DNA, 601 bp, Human
caattccaaccaacccctgatcccaggctgaacttgatcttgaactgaacttcaacctggatctgtctggtggaaacacagacagggcaggggtggtgaggacgggggctctccagatctgtccccctccccatctccagcccccctcagcaggcagaatactggacctctatcccaggcagcatttgccacattccagtgggtttgtttgtttgtttgttttgttttgttttgtttttttgagacagggtctcattctgtcccccaagctggagtgtagtggcatgatcatagctcaccrcagcctcgacctcctggactcaagcaatcctcccaactcctaccttggcctcctgagtagctgggactacagatgcatgccaccattcctggctaatttttgtgttttttgtagagatggggtttcaccatgttatccagggtggtctcaaactcctgggctcaagcgactcacccactcagcctctcaaagagctaggattacaggcgtgagcaatcgtgcccagcctcttcccattgcttttttgtttgtttgtttgtctttgttttttgagatggagtctccctctgtcacccaggt

SEQ ID NO: 58026 - DNA, 601 bp, Human
tgggattgcaggagtctgccaccacgccagctatttttttttttttttcatagcagagacggggtttccccgtgttggccaggctggtcttgaactcctgacctcaagtgatcctcccgcctcggcctcccaaagttccttccagtggttctcaagctgcccccacctcatggagtccttttcctgtttccttgggggcagatatgatgctttggcctctagaaaaattcccacagctctggggtggagagctgctcacgtatttattcaaatctatctgcacccaccctgcaactggctstttctgggacctgcctcagtttccccattgttctctgattccccaggaatgttctcagagagccaacaacgggaggttcaccctgcgggacctgctgatggtgcctatgcagcgagttctcaaatatcacctccttctccaggtgccaggcacatctctaggcgtgggctccacgtacctactctcctgtgtctataaaagtggggacggggctggcttctgggggttgggtctctaggacgctcggggatgggtcactggggtcatgtctcagcctccagggtcagcagtacgatggag

SEQ ID NO: 58027 - DNA, 601 bp, Human
attgcactacagctaggaccacagagtgagatcctgtctctattaaaaaataaatgaatgaaacaggagatgtggctgtggtaggtgagggtgggagggggagctatcttacctccattgttcagggacattctctgtggaagtgacatttaagctgagacccctctccctctcggctcttccttacttccttctgctttttctcctgtgaactcttccgttcgcttcagtttttgccctggagttccccctgtgctctggtctgtggcttctctatttctttttttgagacggagcctcrctctgtcaccaggctggagtgcagaggcatgatctcggctcactgcaacctccgcctcctgagttcaagagattctcctacctcagcctcctgagtagctgggattacaggtgcccgccaccacgcccagctaatttttttgtatttttagtagagacggagtttcaccacattggtcaggctggtctcaaactcctgacctcgtgatccgcccacctcagcctcccaaaatgctgggattacaggtgtaagccaccgcgcccggctggcttctctatttctcaacctgtgtctccctca

SEQ ID NO: 58028 - DNA, 601 bp, Human
ccattgttcagggacattctctgtggaagtgacatttaagctgagacccctctccctctcggctcttccttacttccttctgctttttctcctgtgaactcttccgttcgcttcagtttttgccctggagttccccctgtgctctggtctgtggcttctctatttctttttttgagacggagcctcgctctgtcaccaggctggagtgcagaggcatgatctcggctcactgcaacctccgcctcctgagttcaagagattctcctacctcagcctcctgagtagctgggattacaggtgyccgccaccacgcccagctaatttttttgtatttttagtagagacggagtttcaccacattggtcaggctggtctcaaactcctgacctcgtgatccgcccacctcagcctcccaaaatgctgggattacaggtgtaagccaccgcgcccggctggcttctctatttctcaacctgtgtctccctcaaggagccagttgctgtcttgtaactgcctgcttacagcatccgtctctcctaccaggctggagctctggggaccacatcctattcactgctctgtccccagctcctagcagtgt

SEQ ID NO: 58029 - DNA, 601 bp, Human
gctctgtcaccaggctggagtgcagaggcatgatctcggctcactgcaacctccgcctcctgagttcaagagattctcctacctcagcctcctgagtagctgggattacaggtgcccgccaccacgcccagctaatttttttgtatttttagtagagacggagtttcaccacattggtcaggctggtctcaaactcctgacctcgtgatccgcccacctcagcctcccaaaatgctgggattacaggtgtaagccaccgcgcccggctggcttctctatttctcaacctgtgtctccctcraggagccagttgctgtcttgtaactgcctgcttacagcatccgtctctcctaccaggctggagctctggggaccacatcctattcactgctctgtccccagctcctagcagtgtctgtttctcagcaggtgctgcaccaatgctttgttgaacagaaaaatcgatgatgagtgacatgctgtgtctggtgtgtgcttctgcaaaggggagtgtgtgtgtgtgtgtgtgtgtgtgtgcatgtgcacgcctgcgtatgtggttttgggtttatggttgtgtatttggatatcctagaaagcc

SEQ ID NO: 58030 - DNA, 601 bp, Human
ctagcagtgtctgtttctcagcaggtgctgcaccaatgctttgttgaacagaaaaatcgatgatgagtgacatgctgtgtctggtgtgtgcttctgcaaaggggagtgtgtgtgtgtgtgtgtgtgtgtgtgcatgtgcacgcctgcgtatgtggttttgggtttatggttgtgtatttggatatcctagaaagcccttttacaaggatatccatgcatggtgctaggggcatagagactgtcatgggcttgcctgttccctacagagggaggggtgggtgggtgtgtgctcccaccctcwgcgggggcagtgccttcagtctgagctctgcttccctgcagtggagccacatgttcctcctgatcgaggaccaaggtgcccagggctatgagctgttcttcaagacaagagaattgaagaagaagtggatggagcagtttgagatggccatgtgagtccccgtcttcctccctctttctgtccacagaggggcaggggctgggaaggaggaacgtgatctagtccctactctgtcctgacatgccatgggaccactctgaaccacagtctcttcatttgggaaataagagggacaggccc

SEQ ID NO: 58031 - DNA, 601 bp, Human
ttccacttttgtcttctctttctcctttttatgtgaggcaaaattccaacaacaaaaatctaacaatttcgaagtgtatgatcgcatggcattttgtacactaacagcattgtgcaaccatcacctctatccagtttcaaaaccttttcatcagcccaaaggagacctcatacccattaagcattcactcccaattccccgctctcgcagcccctggaaactcctagcctgctttctctttctcccaatgtgcatggcagcacgattcagtgtggccaaagggtgaaaacgacccaaaagycaatcaatgaatgagtggacacgcaaaacgtggtctgttcataccatggaatagtattcagccataaaaaggaataaaatactgaccttcttttttttttttttttaattttcccctgccagctccaacatctatccggagaatgccaccgccaacgggcatgacttccagatgttctcctttgaggagaccacatcctgcaaggcctgtcagatgctgcttaggtgagaatctgggaggagggtcctgcataccggacttggtcatcagttccttgctagagaagatggcctagtaatt

SEQ ID NO: 58032 - DNA, 601 bp, Human
agaatatttggccctgtctgtaaaggtcactcgctcttctttatgtgttccctgcatctcagaggtaccttctatcagggctaccgctgccatcggtgccgggcatctgcacacaaggagtgtctggggagggtccctccatgtggccgacatgggcaaggtacgagtgggagggaggctgggaggtgagcttggttctctttggaggatttcccgttctcaccatttcctttaccctcccgtagatttcccaggaactatgaagaaggtaagactttcccgtggtccttcctgtgtaccrcaaataatgggcaacagcgcggggaggacccaggacatcctggaactgggcaggatcctttgtggggtgaggagagtaagggggcctacaagcccccaggctgggcataggtagacaggctttctttgtttctccttccaggacaaactacatcgcagggctcaggacaaaaagaggaatgagctgggtgagttggcaggggttgctgtgttggggcaggaggaaaattcatctctattgatgttgacccagggacagatctccataatcatattaacagccacattgggccgggtgcaa

SEQ ID NO: 58033 - DNA, 601 bp, Human
ttagcggggttcttgcttgagcccaggagttcaaggttgcagtgagccatgatcacgccactgcacgccaacctgggcaacagagcaagatcctgtttcaaaaaaataaaaaaataaatatatgaaatctatgaatgggtatgttttcttcttattattacttactatgtaattagcaatagtcagtcagctttcttagcaagagtcaaaattagaaacaacccgtgtcctttgtacaatagaatatatatatgtgtatatatatatacatacacacacacacacacacacacacacacaaacgtattttattgagagaggaaatacatactttaaggtatgtaaaaatcaataaatcttaagtatatgacttaatacatttttatccatgcaaccaacaatcaaataaaaatgtagaacatttccatccctccagaactgcactgtgtaatataaattaattaaaatgaaatcaccttaaaaatttttttgctcacgttagccttgaagttctcaataatggcctgtggctagttgctaccatattggacatatccatcaccacagaaagctttgtcagaaagcactgctactcacctat

SEQ ID NO: 58034 - DNA, 601 bp, Human
ctcctgggagttcaagtgattctcctgcctcagcctcccaagtagctgggattacaggtgcccaccaccacacccagctaatttctgtagttttagtagagatggggtttcaccatgttggccagtctggtctcaaactcctgacctcaggtgatcttcctgcctcggcctcccaaagtgctgggattacagacatgagccaccgtgcccagccaggacacatgttttcatttctcttgggttgctgggttacagagtagatacaatgtttagcttcagtagatattgccaaatagttttmcaaagagtatccccaccagcaatgagtgaaaattccagtttctccacgtccttgtcaacacttagtattgccagtctaaaaagaaaaattttagccattctcgtgggtggcaagattcagggttgaaagttgactgccaaccaccctgtactcctgtaccctgtcctccaggtctgcccaagatggaggtgtttcaggaatactacgggcttcctccaccccctggagccattggaccctttctacggctcaaccctggagacattgtggagctcacgaaggctgaggctgaacagaact

SEQ ID NO: 58035 - DNA, 601 bp, Human
gtgtttcaggaatactacgggcttcctccaccccctggagccattggaccctttctacggctcaaccctggagacattgtggagctcacgaaggctgaggctgaacagaactggtgggaggtacaggctggggccacaagagtgatggggtgggacccaagtgtagggttatggattcatgtggtctcagggagttgggtcatagttccaccatgctctggaggtgatgcctggggagtggggtaggtagactgagacttctgggcatggcttttctgagcgggccatcttcccaggaagytaatactcattatcacctctctgggctctccaggccatcctgagatagatggacaagcagagtgaccattgagcagagagatggacacacacacacacacacacacacacacacacacacacacacgagtgatggggcaggatccacgtgtagggttatgggtttagatggcaggtggggttatggatcctataacctctctgttcctgtttttgtctcctgggtgtttagggcagaaatacatctactaatgaaattggctggtttccttgtaacagggtgaagccctatgtccatgtg

SEQ ID NO: 58036 - DNA, 601 bp, Human
ttgtggagctcacgaaggctgaggctgaacagaactggtgggaggtacaggctggggccacaagagtgatggggtgggacccaagtgtagggttatggattcatgtggtctcagggagttgggtcatagttccaccatgctctggaggtgatgcctggggagtggggtaggtagactgagacttctgggcatggcttttctgagcgggccatcttcccaggaagttaatactcattatcacctctctgggctctccaggccatcctgagatagatggacaagcagagtgaccattgagcaragagatggacacacacacacacacacacacacacacacacacacacacacgagtgatggggcaggatccacgtgtagggttatgggtttagatggcaggtggggttatggatcctataacctctctgttcctgtttttgtctcctgggtgtttagggcagaaatacatctactaatgaaattggctggtttccttgtaacagggtgaagccctatgtccatgtgagtgcctcaagtctgaatggaataagggcaaggggtccagggcgggtcctgggaggatggacagacttggaaagac

SEQ ID NO: 58037 - DNA, 601 bp, Human
acgttcccctttacccctaaatacttcttaagagcaagagccttctcatgcataaccagagcaagatattaaaagacacaaaattcaacattgacattatactattatttaattcatagtctgtatttaaatgttgtcaatttccccaaaaattttatcaaaaatttttttgttcctatggtttctccactgtcaagttacaataggaatttccaaccccatcattctttccaaatttattagctggtgttctgctgcaagaaagagctgtcctttctgccctcatctgtctgtctgtctrtctatctatctatctatctatctatctatctatctatctatctatccatgcatccatcttttatctatatatcatctatctatttacctatcatctatttgcctatcacctatctacccatctattatctatctatctatatcatcatcatcatcatcaatcttttatctatttacctatcatctatccatctattcgtcatctacatattatctatctatctatctatctatctatctatctatctatatgtctatctatccatgtacctacccatcaatccatccattcatcaatcag

SEQ ID NO: 58038 - DNA, 601 bp, Human
aaccatctatcatctgtctattacctatttattatcatttctctctcatctattcatttatcatttatccatcacctgtctgtttatcatctatcatctttccatctatctattacctgtttatccatcatccatctattctatctatctatctcttaattttttgttttagagagagggtctcattctgtcacctaggctggagtgcaatggtgtgatttaactcactgcagccttgacctcctgggctcaagcaatcctcccacctcaccctcctgagtagctgggaccacagatgcamgccattatgctcagctttatttatttatttatttatttatttaagatggagtttcactcttgtttcccaggctggagtgcagtgggatgatctcggctcattgcaacctccgccttccggtttcaagcgattctcctgccttagcctcctgagtagctaggattacaggcgcctgccaccacatctggctaatttttgtatttttagtagagatggagtttcatcatgttggtcaggctggtctcgaactcctgaccttgtgatccgccagcttcagcctcccaaagtgttgggattaca

SEQ ID NO: 58039 - DNA, 601 bp, Human
aagcgattctcctgccttagcctcctgagtagctaggattacaggcgcctgccaccacatctggctaatttttgtatttttagtagagatggagtttcatcatgttggtcaggctggtctcgaactcctgaccttgtgatccgccagcttcagcctcccaaagtgttgggattacaggtgtgagccactgcacccagccgcagctgtttttttgtgtgtgattttttttttttttagagatagggtctcactatgttgtccaggctggtcttgaactcctgggctcaagcaatcctctcayagaacatccttctcttttttcttttaaaaaattgaggtgaaatttgcacagcataaaactgaccgttacaatgaaaaattcagaatactgagtagctgagattacaggcgtgcaccaccacacctggctaattttttgtatttttagtagagatgggattttaccatgttggtcaggctgatctcaaactcctgacctcaaatgatctgcctgcctcggcctcccaaagtgctgggattacaggcgtgagccaccacgcccggctgggtatggcattttcttttggagtgataaaaatgt

SEQ ID NO: 58040 - DNA, 601 bp, Human
agtggcattaagtacattcacagtgttttgccaccatcaccaccatcatctccagaacacttttcatcttgcagcactctgaacccattaaacagcaaccacctattcccctctcccagcccctgacattcacattctactcttgagctctatggatttttctgtcctaagtacctcacctaagtgaaatcatacagtatttgtcctttgtgtctagcttgtttcacttggcataatgtattcaaggctcatccatgttgtggaatgtgtcagaattttctttctttttttttttttttttggtgaaatggagtctcgctctgtcacccaagctggagagcagtggcgcaatcttggctcactgcaagctccacttcccgggttcacaccattctcctgcctcagcctcccgagtagctgggactacaggcacttgccaccacgcctggctaattttttgtatttttagtagagtttcaccgtgttagccaggatggtctcgatctcctgaccttgtgttcctcccgcttcggcttcccaaagtgctgggattacaggcgtgagccactgcgcccggcctttttttatttttatttttttg

SEQ ID NO: 58041 - DNA, 601 bp, Human
tcacttggcataatgtattcaaggctcatccatgttgtggaatgtgtcagaattttctttctttttttttttttttttggtgaaatggagtctcgctctgtcacccaagctggagagcagtggcgcaatcttggctcactgcaagctccacttcccgggttcacaccattctcctgcctcagcctcccgagtagctgggactacaggcacttgccaccacgcctggctaattttttgtatttttagtagagtttcaccgtgttagccaggatggtctcgatctcctgaccttgtgttcctsccgcttcggcttcccaaagtgctgggattacaggcgtgagccactgcgcccggcctttttttatttttatttttttgggatggagtgtggtcctgttacccaggctggagtgcagtggtcgtgtaattataactcactgcagactcgaccccctaagcttaagtgatcctcccacttcagcctcctgagtagctgggactacaggcatgtgccaccatgcctggctaatttttctacttttaaaaaaatttttgagatggagtttcgctcttgttgcccaggctggagtggaatggtgca

SEQ ID NO: 58042 - DNA, 601 bp, Human
cccggcctttttttatttttatttttttgggatggagtgtggtcctgttacccaggctggagtgcagtggtcgtgtaattataactcactgcagactcgaccccctaagcttaagtgatcctcccacttcagcctcctgagtagctgggactacaggcatgtgccaccatgcctggctaatttttctacttttaaaaaaatttttgagatggagtttcgctcttgttgcccaggctggagtggaatggtgcaatctcggcccactgcaacctcagcctcccgggttcaagtgattctcccrcttcagcctcgagtagctgggattacaggcatgcaccaccacaccaagctaatttttgtatttttagtagagacagggtttcaccatgttggccaggctggtctcgaactcctgacctgaggtgatctgcccgcgttggcctcccaaagtgctgggagtacaggtgtgagccaccatgccgggcctaatttttgtattcttttgtagggacagggtttcatcatgttgcccaggctggtctcgaactcctgggctcaagagacccaccctccttggcttcccaaagtgctaggattacag

SEQ ID NO: 58043 - DNA, 601 bp, Human
ctgtagtgcaaaagtagccacagataatctgtaaatgatgtatagacacggctgtgttcctacaaagcataattcatgggcactgacaggtgaatttcatatgatcttcacaatcccaaaaacattcttttggctaggcgtggtggctcatgcttgtaatcccagacctttgggaggacaaggcaggaggattgcttgaggtcaggagtttgagaccagcctgggaaacaaagggagaccatcccccgcccgatcttgacaaaatttaaaaaaattaaaaattagcgggtgtggtggtgcrtacctgtagtcccagcacttgggaggctgaggtgagaggatcgcttgaacctgggagatcgaggctgcagtgagctataatcatactgctgcactccaacctgggcagcatagtgagactctgtccctaaaaaaaagaaaaaattcttttgatttttgccaaccatctaaaaatgtaaaaaccattcttgacttgagggtaatgataaactgctgggaagacaacccctgctttatatgatactggggcagtctctcccccgaggttctgggactttatccccagtgagtaccacagtgc

SEQ ID NO: 58044 - DNA, 601 bp, Human
gcactgacaggtgaatttcatatgatcttcacaatcccaaaaacattcttttggctaggcgtggtggctcatgcttgtaatcccagacctttgggaggacaaggcaggaggattgcttgaggtcaggagtttgagaccagcctgggaaacaaagggagaccatcccccgcccgatcttgacaaaatttaaaaaaattaaaaattagcgggtgtggtggtgcgtacctgtagtcccagcacttgggaggctgaggtgagaggatcgcttgaacctgggagatcgaggctgcagtgagctatratcatactgctgcactccaacctgggcagcatagtgagactctgtccctaaaaaaaagaaaaaattcttttgatttttgccaaccatctaaaaatgtaaaaaccattcttgacttgagggtaatgataaactgctgggaagacaacccctgctttatatgatactggggcagtctctcccccgaggttctgggactttatccccagtgagtaccacagtgcctggcacataataggcactcactaaatgcaagtggaatgagtgaatgaatgaatgaatgaagtgccctgccctctgctg

SEQ ID NO: 58045 - DNA, 601 bp, Human
tcacttgaggtcaggagttcaagaccagcctgggcaacatggtgaaaccctgtctctactaaaaatacaaaaaaaaattagctgggcatggtggcgcacgcctgtagtcccagctactcaggaggctgaggcaggggaatcgcttgaacctggcaggcggaggttgcagtgagccgagattgcgccattgcactccagcctgggcaacagagcgagactcggtctcaaaaaataaacaaacaaacaaataaataaataaataaaaatgaggtgaaattcatacaacataaaattaaccttktaattgttactggcatttctatttctattcatatttacatttatattacatattaacatttacatgatgttagatattatatgcaattacatatgatttataattaatacttatcatttatattgtgtatttatgtttacaacctattatatattataccacatatcataaaatatatttatattatgctatgtattttcacaaattaatgttttttatttatgttgcacatttatgtttatattatattataccatacacaatatattataataagatttataggttacctatttactt

SEQ ID NO: 58046 - DNA, 601 bp, Human
cacagagatgggcacacagtgagccttcaggaaatgcctggtgaagccatcgccaaattccagacacccagccagacccaaagggctgagccatccccccgaatccatgtgtcaaaccttagtggtgacctgtagaagtggaagcccgctccccatgtctgggctccggcccctgcctccacggggcctaccttggtgctgaagggctgttagagccaggctgtcaccaacttaaaaaatcaaaggggttcagggggaaaggcaacctccatatggcaatatggggacccaggcacggggrccgtgccacctctgtccttggtgtctctttgcaggtacgcaggccccatggagcgggcaggggcagagagcatcctggccaaccgctcggacgggactttcttggtgcggcagagggtgaaggatgcagcagaatttgccatcagcattaagtaactcctttctccctgactcatacccttttggggcctgggccctgcgggcctgggaaaaagggtatccaggttttactttatagaagtgtacggtaatagcatccaccttttactgagcccctgctggttcccacgtgcctttcacc

SEQ ID NO: 58047 - DNA, 601 bp, Human
ggttcagggggaaaggcaacctccatatggcaatatggggacccaggcacggggaccgtgccacctctgtccttggtgtctctttgcaggtacgcaggccccatggagcgggcaggggcagagagcatcctggccaaccgctcggacgggactttcttggtgcggcagagggtgaaggatgcagcagaatttgccatcagcattaagtaactcctttctccctgactcatacccttttggggcctgggccctgcgggcctgggaaaaagggtatccaggttttactttatagaagtgtacrgtaatagcatccaccttttactgagcccctgctggttcccacgtgcctttcaccttctttatttcttttaattgacgaccacaagaaagagatatgattcctatagaggctcaaaaaggctcttaaaattaattaattaatttgagtcagagtctccctctgtcgccctgacctttcttttttcccctttttttcttttcttttcttttctttttttttctgacagagtccctttgtcgcccaggctggagtgcagtggtgagatctcagctcactgcaacctcccaggttcaagcgatt

SEQ ID NO: 58048 - DNA, 601 bp, Human
gagccactgtgcctggccaatattattcccatctttatgtccatgtgtacccaatgtttaacccctgcttataagtgagaacatgtggtgtttggcttactgtttctgtattaattcatttaggataataacacccagtgcatccacgctgctgcaatgcacatgatctcattcttctttatggctgtatagtagtccatagtgtgtgtatatgtaccacattttcttatccagtccactgttgatgggcacctgggtcgatccatgtctttgctattgtgaatgctgctgtgatgaacawacaagggtgtgtgtctttctggtagcacaattactttttcctttgggtagatacccagtcatagggtagctgcatcaaatggtggttctatttttagttcttcgagaaacctccaaactgctttccgcagtggctgaaccaatttacagtccagcccacagtgtagaggaattcccttctctcacatgctgctgagtttgtaatttcattgttatttttggctcctgtgaatttcccttactttttttttttttgagagctcagcaatttttttctcaacatttctagtgtttttttaaa

SEQ ID NO: 58049 - DNA, 601 bp, Human
cgcccgccagcaaggctgggaccgcgaaaaatcggggaaactgcctttggctgtgagggtgcggggcagatgtagaaaaggggcgcagggggagaaggtgaggcacctggccaggccctgggggcttctcgctcgcagccctgtcaccgccgggggccccggggtgggggaggggaggggcatttggcgcctattcaagcagggtggggtaggtgggtcttccgaggaggaaaaagggcgccctgggatgccacgacccgcacctcccggggctggagtccacggtcggcgtgggtggcgrgaccccgcggcccgccatcccgcccctgcacatctggctcttctggcttccccccgacacccagccgccctcctcccggacccaggaaccgctgccgccgcccgaggccgggcgtgtggcatggccgcgcgtccaggctccgagggacgtcgggtcagggtctcaggctgcgaccctccccgtgcacccctcctggcgtgcgcgcccccctcgcgaccgctcccctcactcactatccgagggtcgagggcgcccggcggctgtcactgcgctggggctggcgctgcaggagcagcgggg

SEQ ID NO: 58050 - DNA, 601 bp, Human
aacattatatggcttcataacctcttgaatgaaacagatgagggctaagagttcagttgaaccatttcacttatttatccaacatccattcagtgacagggtagggagagagaaagatattaattagggatgatctttcagcaaagctgacattctgagatctgaacaccttatggaaatctggtggaggagttccagatggtgggaaacacaggaagcaaggaaaaatgtgagtgttcaaggaagagaaatatctgtagggctgagttgggggaggttattgaaaattatagttgaagargtagaatgatctgcagatttgtggggtaggctgggtcaaaagtggagaaatttggtttacatttttaaaagatcattggcaattgtggagaatgaattgcaggaaggtaagtagaagcagagagaatagttagaagtgtttatgacagaagtagagtgtgggaaacccagactagaaggattgtagtggaaatgaaaataactgcataaattcaaggtctgttatttagaagggtaaagtcaacttgctgctaatctactagatctggatatgaagaaaaggagagtaaaaaaacaccct

SEQ ID NO: 58051 - DNA, 601 bp, Human
gttttccaatgaccaggccaaatttgggaaatatgtgaagtattcatataattattatccagaaagacagaaaacattatatggcttcataacctcttgaatgaaacagatgagggctaagagttcagttgaaccatttcacttatttatccaacatccattcagtgacagggtagggagagagaaagatattaattagggatgatctttcagcaaagctgacattctgagatctgaacaccttatggaaatctggtggaggagttccagatggtgggaaacacaggaagcaaggaaaaaygtgagtgttcaaggaagagaaatatctgtagggctgagttgggggaggttattgaaaattatagttgaagaagtagaatgatctgcagatttgtggggtaggctgggtcaaaagtggagaaatttggtttacatttttaaaagatcattggcaattgtggagaatgaattgcaggaaggtaagtagaagcagagagaatagttagaagtgtttatgacagaagtagagtgtgggaaacccagactagaaggattgtagtggaaatgaaaataactgcataaattcaaggtctgttattta

SEQ ID NO: 58052 - DNA, 601 bp, Human
tttgctattgtgagctcttgcagttgacattggtgtccatttcacatacttaaatcattttgtgttttgaacatcccttactttctgggactacaagatgctctaagtgcatcttataatttccgtttcagccctagaatcagtcatttctccaagcactgtggtttccttttttttggaaaaaggtattaaatgagagtgaaatctggatgttggttgtagatttaattttaaaatatgaaattaatgtatttttcatttccataacaatactgcagaagaaatagaatagcatcatatgttataaaaatggaagctgaagcaactgtttgcaaaaggttaaatccattccttttaactagctaagtgttttccaatgaccaggccaaatttgggaaatatgtgaagtattcatataattattatccagaaagacagaaaacattatatggcttcataacctcttgaatgaaacagatgagggctaagagttcagttgaaccatttcacttatttatccaacatccattcagtgacagggtagggagagagaaagatattaattagggatgatctttcagcaaagctgacattctgagat

SEQ ID NO: 58053 - DNA, 601 bp, Human
gagtggggagtaaatttataaatcatttggaattcttctttacagcagatttgtccattaatctcctatttattcatactaccaatcatttatatcagtataaactcatagactttgggttataatccaatactatttactgtattgctcaaattgttccagcttttgctattgtgagctcttgcagttgacattggtgtccatttcacatacttaaatcattttgtgttttgaacatcccttactttctgggactacaagatgctctaagtgcatcttataatttccgtttcagccctasaatcagtcatttctccaagcactgtggtttccttttttttggaaaaaggtattaaatgagagtgaaatctggatgttggttgtagatttaattttaaaatatgaaattaatgtatttttcatttccataacaatactgcagaagaaatagaatagcatcatattttataaaaatggaagctgaagcaactgtttgcaaaaggttaaatccattccttttaactagctaagtgttttccaatgaccaggccaaatttgggaaatatgtgaagtattcatataattattatccagaaagaca

SEQ ID NO: 58054 - DNA, 601 bp, Human
tttctcagccttagtctggggctgtgggtttttagaccagaggtaaggtgctatgatttgaactgttgttagccttgattacttggctgaggtagtatttctgagcttgctccaaatgtaaagttactcctttttgttctttttccatttgaaactttttggaaggaagtcactatgtacacctcacacttaaaggagtggggagtaaatttataaatcatttggaattcttctttacagcagatttgtccattaatctcctatttattcatactaccaatcatttatatcagtataaacycatagactttgggttataatccaatactatttactgtattgctcaaattgttccagcttttgctattgtgagctcttgcagttgacattggtgtccatttcacatacttaaatcattttgtgttttgaacatcccttactttctgggactacaagatgctctaagtgcatcttataatttccgtttcagccctagaatcagtcatttctccaagcactgtggtttccttttttttggaaaaaggtattaaatgagagtgaaatctggatgttggttgtagatttaattttaaaatatgaa

SEQ ID NO: 58055 - DNA, 601 bp, Human
ttccacaattaggatttgtcaagtttttctcagccttagtctggggctgtgggtttttagaccagaggtaaggtgctatgatttgaactgttgttagccttgattacttggctgaggtagtatttctgagcttgctccaaatgtaaagttactcctttttgttctttttccatttgaaactttttggaaggaagtcactatgtacacctcacacttaaaggagtggggagtaaatttataaatcatttggaattcttctttacagcagatttgtccattaatctcctatttattcatactrccaatcatttatatcagtataaactcatagactttgggttataatccaatactatttactgtattgctcaaattgttccagcttttgctattgtgagctcttgcagttgacattggtgtccatttcacatacttaaatcattttgtgttttgaacatcccttactttctgggactacaagatgctctaagtgcatcttataatttccgtttcagccctagaatcagtcatttctccaagcactgtggtttccttttttttggaaaaaggtattaaatgagagtgaaatctggatgttggt

SEQ ID NO: 58056 - DNA, 601 bp, Human
ttttttgttagctaataccaacattagaatctgtactcttcctcacgaaattagcacttaaggagttaaaatgactaccacgttcctcttgcaacaacagtattttcacatggataattagatttagtatttaggtaaggtgcagtggctcatgcctataatcccaacactttgggaggctgaggttgggggactgcttgagctcaggagttcagaccagtctgggcaacataaagagactccatctctacaacaattaaaaaaagaaactagctgggcatggtggcatgtgcctttggtmccaactactagggaggctgaggcgggagaattgcttgagcccgggaggttgaggctgcagggagttgtgatcataccactgcattccagcctggaagacagagggaaaccctgtcttaaaaaaaaagaaaaaagaaaaaaaaaggtttagtattttaaaagaattttaataaacttatttgaattcacagaaaagctgcaaggatagtgcagaattcctgtacacccattgcttaacttatattactaacagtaatgcatgtcacaacaaattaaccaatattgttgcattattaactaa

SEQ ID NO: 58057 - DNA, 601 bp, Human
atttctcttcctcattataatgaggtgctctggaaaaacagatcttacaaataacattcatactgtttataaaaatgatagaaaagtcagaatttatgttgcaagcgcacttaaggtactaaagaagaaaatgtgtacgtttcttttctcatgtgagctggcccttttccagtccttagtaacaatgacctttccatcccaggggctttgtacatcatgcctttccctgcttagaatcttttccacttcctttgcttatttagcttctaatccattactcatggagagcttcatttttttkggggggggggggggcgggggacttctcagacctcatcaaactctactctaaagcactaccaaattgaaattttaaaaagtactttaatttccttaaaggccagacataactgttactgcttatgacaaaatccaagcaaatggcagtgcctgacacaatgaagacatatgatataaaaatgtgtttcccatttttttttgttagctaataccaacattagaatctgtactcttcctcacgaaattagcacttaaggagttaaaatgactaccacgttcctcttgcaacaacagtattttc

SEQ ID NO: 58058 - DNA, 601 bp, Human
gatttctcttcctcattataatgaggtgctctggaaaaacagatcttacaaataacattcatactgtttataaaaatgatagaaaagtcagaatttatgttgcaagcgcacttaaggtactaaagaagaaaatgtgtacgtttcttttctcatgtgagctggcccttttccagtccttagtaacaatgacctttccatcccaggggctttgtacatcatgcctttccctgcttagaatcttttccacttcctttgcttatttagcttctaatccattactcatggagagcttcattttttkgggggggggggggggcgggggacttctcagacctcatcaaactctactctaaagcactaccaaattgaaattttaaaaagtactttaatttccttaaaggccagacataactgttactgcttatgacaaaatccaagcaaatggcagtgcctgacacaatgaagacatatgatataaaaatgtgtttcccatttttttttgttagctaataccaacattagaatctgtactcttcctcacgaaattagcacttaaggagttaaaatgactaccacgttcctcttgcaacaacagtatttt

SEQ ID NO: 58059 - DNA, 601 bp, Human
aggcagttaattaaatgagccagatttctcttcctcattataatgaggtgctctggaaaaacagatcttacaaataacattcatactgtttataaaaatgatagaaaagtcagaatttatgttgcaagcgcacttaaggtactaaagaagaaaatgtgtacgtttcttttctcatgtgagctggcccttttccagtccttagtaacaatgacctttccatcccaggggctttgtacatcatgcctttccctgcttagaatcttttccacttcctttgcttatttagcttctaatccattamtcatggagagcttcatttttttgggggggggggggggcgggggacttctcagacctcatcaaactctactctaaagcactaccaaattgaaattttaaaaagtactttaatttccttaaaggccagacataactgttactgcttatgacaaaatccaagcaaatggcagtgcctgacacaatgaagacatatgatataaaaatgtgtttcccatttttttttgttagctaataccaacattagaatctgtactcttcctcacgaaattagcacttaaggagttaaaatgactaccacgtt

SEQ ID NO: 58060 - DNA, 601 bp, Human
tagagctaataatgatgcaaatcctttatatttgtttagaagtttgcaatttccaatgcttacaaaccttttgaggtaggatggggaattgttatttttacaattgagcacactgaagtgtagcttagtttgcccaatacaggcagttaattaaatgagccagatttctcttcctcattataatgaggtgctctggaaaaacagatcttacaaataacattcatactgtttataaaaatgatagaaaagtcagaatttatgttgcaagcgcacttaaggtactaaagaagaaaatgtgtaygtttcttttctcatgtgagctggcccttttccagtccttagtaacaatgacctttccatcccaggggctttgtacatcatgcctttccctgcttagaatcttttccacttcctttgcttatttagcttctaatccattactcatggagagcttcatttttttgggggggggggggggcgggggacttctcagacctcatcaaactctactctaaagcactaccaaattgaaattttaaaaagtactttaatttccttaaaggccagacataactgttactgcttatgacaaaatccaagc

SEQ ID NO: 58061 - DNA, 601 bp, Human
taaattactgttcaattgctttaaataacttaagataaacttgctattaatgataaatagaaaaaagggaaagacttgttcagggttttattaccaccctgctccaacccccaggatctaagaaatcagttaagacacaatggagcaggcagcatcttaagatagctttaaagcaagatttcaccatccctgtgctacagacattttgcagtgaatacctctttgttctcagggactgtcctgtgcattgtaggatgttaagcagcctttacccattagacaccagtggcagcccccactyccaagatgcaatgtctccagttaccagttattgccaaatactgggcagggaaaaaggccagatgcaaaatttcctctattcttcagttgagaaccacaactctaaaaaatgattaggattttgtcagacaacagtggcctgggaagggcattcacaatttgagcaacggcacaatgctgggaaggaatatggtagatgggttcagaaaactgtttagcattgttgaaggcagagagtaagagtaggcaaacaatggggacatgagctaagaaagcctgaatcttaaatgccaggttaaaa

SEQ ID NO: 58062 - DNA, 601 bp, Human
tgtaccttgtctaatatgtgctggaaactgctctttaatcactgaacaaagacattccacgactaatttaccaaagaaccgtaagtatgaatagttctgctatcaatcaaaagtaagtgttggtaaataagaatgacactctaatcaattaaccagatttaagaatatgagtgatagggcagcaggtgtaaattactgttcaattgctttaaataacttaagataaacttgctattaatgataaatagaaaaaagggaaagacttgttcagggttttattaccaccctgctccaacccccrggatctaagaaatcagttaagacacaatggagcaggcagcatcttaagatagctttaaagcaagatttcaccatccctgtgctacagacattttgcagtgaatacctctttgttctcagggactgtcctgtgcattgtaggatgttaagcagcctttacccattagacaccagtggcagcccccactcccaagatgcaatgtctccagttaccagttattgccaaatactgggcagggaaaaaggccagatgcaaaatttcctctattcttcagttgagaaccacaactctaaaaaatga

SEQ ID NO: 58063 - DNA, 601 bp, Human
aaaaaatagtggaaaaaggggctatataataaacatctgtgtttatggaacaaatgaagaaatgtgatgtatcaaaagagtaggcgctatggtcaaagttatccttaaagtaaccacaaatacttttagattcagtgtttattccttggacttgaaatgacattatggttctctttgacgtaagcacaacccaagccactgacagcaaaagtggttaagattagtacaggaggacaaggtataagggtgggaataatcttgataaaaataataaaaattttgtgtattatttcactattarcaatgattgcaagccttaaaataactattcaagaaatctataggtagcttggagaaaagaactaataacacatttaaacatctataaattaaagtctacctgaattcccacagctcttatctccaagttttattctgatgggtgctcctggtgaccttctaatatattcaaagcgtttgtctaccttactggatagtaaactcgagtaccgggacatctccctgtaccttgtctaatatgtgctggaaactgctctttaatcactgaacaaagacattccacgactaatttaccaaagaa

SEQ ID NO: 58064 - DNA, 601 bp, Human
ggctgtaacacctgactgttgtctataactgattgagtaaaaaatagtggaaaaaggggctatataataaacatctgtgtttatggaacaaatgaagaaatgtgatgtatcaaaagagtaggcgctatggtcaaagttatccttaaagtaaccacaaatacttttagattcagtgtttattccttggacttgaaatgacattatggttctctttgacgtaagcacaacccaagccactgacagcaaaagtggttaagattagtacaggaggacaaggtataagggtgggaataatcttgayaaaaataataaaaattttgtgtattatttcactattagcaatgattgcaagccttaaaataactattcaagaaatctataggtagcttggagaaaagaactaataacacatttaaacatctataaattaaagtctacctgaattcccacagctcttatctccaagttttattctgatgggtgctcctggtgaccttctaatatattcaaagcgtttgtctaccttactggatagtaaactcgagtaccgggacatctccctgtaccttgtctaatatgtgctggaaactgctctttaatc

SEQ ID NO: 58065 - DNA, 601 bp, Human
tctcagcattaggtattgtctacatgtacttgcttacatagctgtgatgttattcaagtttaattattgatatgacaataatatgtgaaaatattacttaaatcttataagtacatacatattatattattcttgagaaggcacttcagaacagactgcttttggatctgcctggctgtaacacctgactgttgtctataactgattgagtaaaaaatagtggaaaaaggggctatataataaacatctgtgtttatggaacaaatgaagaaatgtgatgtatcaaaagagtaggcgctayggtcaaagttatccttaaagtaaccacaaatacttttagattcagtgtttattccttggacttgaaatgacattatggttctctttgacgtaagcacaacccaagccactgacagcaaaagtggttaagattagtacaggaggacaaggtataagggtgggaataatcttgataaaaataataaaaattttgtgtattatttcactattagcaatgattgcaagccttaaaataactattcaagaaatctataggtagcttggagaaaagaactaataacacatttaaacatctataaat

SEQ ID NO: 58066 - DNA, 601 bp, Human
ttatattttcatcactgtcaaatctaggagagccctagcaccaaaaatggcttagaaagaacaaaaattacttcatactttctggtgtgacaagtcataatgcctattagacatgtagactggaactaggctgttttacagttaagccccaaagatgtaacttacatattagaaatttcaaaactaaaaggaacaaggatcctaatccaacagaaatagttttgtaatagcatgaatataaaatttgaaatgactaggttaaatgcataattcaagttttctttcatcttagtggcacatrggtagcaaaacaccagcaagtcattaccgcaattaaacaacattgtaaggttatctacaacaggttgagcatctctaatccaaaaatctgaaaacttttgaatgctgacatgatgctcaaaggaaatgcacattggagcacttgcggattttggattagggatgttcaactgtttaacctgtagggtataatacaaatattccaaaatttgaaaaacatctgaaatccttctggtactaagcatttcagatgagggacactcaacctgtacaacagcctttgcatgagctggtggtactg

SEQ ID NO: 58067 - DNA, 601 bp, Human
tccctcaagaagctgtttaggctcatgcctgtaatcccagcactttggaaggctgaagcaggcagatcacgaggtcaagatatcgagataccctcctggccaacatggtgaaaccctgtgtctactaaaaatacaaaaattagctgggcgtggtggcacacgcctgtagtcccagctactcaggaggcagaagaatcacttgagcccgggaggcagaggttgcagtgagctgagatcgtgccactgcactccaacctggtgacagggcgagactccgtccccaaaaaaaattaaaaaaaaagaagctgtttatatctgttttgctttagctctgtttcataaagaccagtgtaaactcacacttgcaaagagtacctctagataatttttcaaaaagccaaaaaaaaaaaaacaactccagttaagtcctatctaattctagcctgcataatcaccttaattctcaaagttatctgactaagtgattttccttggtagattgagaaagaaatggtggttagcaccaggtttctaagaaattgtcataaacagagcctgggaggtggaggttgcagtaagccaagattgcaccattgcgctc

SEQ ID NO: 58068 - DNA, 601 bp, Human
agaatctgtggtactgatttgactgtccctcaagaagctgtttaggctcatgcctgtaatcccagcactttggaaggctgaagcaggcagatcacgaggtcaagatatcgagataccctcctggccaacatggtgaaaccctgtgtctactaaaaatacaaaaattagctgggcgtggtggcacacgcctgtagtcccagctactcaggaggcagaagaatcacttgagcccgggaggcagaggttgcagtgagctgagatcgtgccactgcactccaacctggtgacagggcgagactcygtccccaaaaaaaattaaaaaaaaagaagctgtttatatctgttttgctttagctctgtttcataaagaccagtgtaaactcacacttgcaaagagtacctctagataatttttcaaaaagccaaaaaaaaaaaaacaactccagttaagtcctatctaattctagcctgcataatcaccttaattctcaaagttatctgactaagtgattttccttggtagattgagaaagaaatggtggttagcaccaggtttctaagaaattgtcataaacagagcctgggaggtggaggttgcagt

SEQ ID NO: 58069 - DNA, 601 bp, Human
ttatattattagtgcttctcaaacctgaccacattacaattgcctggcggttttaactggtctaaaatgaagctcagggctctgtatttttaaaaagctccctcctcattaagtaattctgagtgcattgaggcttaagaaccactgctttgtacagtattttttcacaatatctgcaaacatcaaatagtagcccccactgtatatatgataccatgttagctatctggtaaaagtaatagacaaatttcaaagtactctaggcacactgctattagaaatcaactttagaaactcactwtgttaacagaaaaagtagaatctgtggtactgatttgactgtccctcaagaagctgtttaggctcatgcctgtaatcccagcactttggaaggctgaagcaggcagatcacgaggtcaagatatcgagataccctcctggccaacatggtgaaaccctgtgtctactaaaaatacaaaaattagctgggcgtggtggcacacgcctgtagtcccagctactcaggaggcagaagaatcacttgagcccgggaggcagaggttgcagtgagctgagatcgtgccactgcactccaacctgg

SEQ ID NO: 58070 - DNA, 601 bp, Human
aagtctgggctgctgatttctgaacagaagccagtggggttctgaacataacatattctctggttgaagcatgaggtgaaaatttattgttgttttcctaatttaaaaaaaagttttaatagaatttagaaattatttcctgtatcctcaatgagacatttttatgtttgtacatataagaaatgacaaacaagattaggtaagagacttatccctacatgcaatttacctgcacgtacttaaacaaagcaaaacctaaatactcacacatatcaagcctaacttatagacagaaactgtsaaccaaatactatgggaaatcactttagatgcagtctatatggtacttaatacctaaaaagtaaaacagcttttccaaattttccagatgttataaaatacacatacacacaactggcaactaagattgactaaatggtcgactctatctgagaaatgagtaattttccctttgttactttagacattctatttctaggaagaatccaagaaataaatgttgagttgagatttctttatttttgaatgtggtttctaagttccagtataaggctgaaatactttatgactgtaaagaagg

SEQ ID NO: 58071 - DNA, 601 bp, Human
cattatggcataaaatttaagaatagttttattatgtaggatttatatttactgatcaacatgaatcagaaaatattctataattttggtaagttatctaaattaagcttgcaaagttatctacatttgagtagaaattttagcacacatcattcactgatctgaaggtataatagaaggccttcaagttcagaaagcttgcctttttccacttaactctcttcctcggttcttaaaagcggaaaatgcaaaatgtagtactgagtaattttataagaaatctaggtttttcattatttcytcagtgtttctaaattagaactcaaaatcactgaactttcaaacaatgccaagcagtacctaatattcatagaaatacatttctacgtactttcctaatttcatgtttcttttgttttccacattgagagcgaaatgaagaggacactaatgaaatccctaatagttctaattatactataattaaatttaaatgatcattaatatcaggtttcttaatgtcagagaataaattagttattatctagagcaaagttacattttgaccttgaaagttcttttacatttcttactctaaatc

SEQ ID NO: 58072 - DNA, 601 bp, Human
gagacacttcgtacaataatcaaatccacagccttctcgtttgcaggttgcccgttgtaaatagcaatcatattttgcaggtgaattacagcgaatacaggctttgaggctttcgttctttttcaatgtcttggcaacctaaaaagaaaaaaaaaacccattaacaaatttcagcaagaattacatgtactttagttaataaaaccaaggacacccttgcaccttccccaattcatgtatgaaatatcactgtcacacatacgataactactgccctaactattgccctttatctatgcaktatctgatagatgctcaataaatgctttttgaataaatctgtatgttgcattagtcattatggcataaaatttaagaatagttttattatgtaggatttatatttactgatcaacatgaatcagaaaatattctataattttggtaagttatctaaattaagcttgcaaagttatctacatttgagtagaaattttagcacacatcattcactgatctgaaggtataatagaaggccttcaagttcagaaagcttgcctttttccacttaactctcttcctcggttcttaaaagcggaaa

SEQ ID NO: 58073 - DNA, 601 bp, Human
catgatcagtaacaattgatttaataagagatcacaatcttcgtaaattctttttgcttttctttgtaccaggcaggggacctattttacaactggctttgaggagcttgccatctgaacagtctttagtagtatgataattacagagacacttcgtacaataatcaaatccacagccttctcgtttgcaggttgcccgttgtaaatagcaatcatattttgcaggtgaattacagcgaatacaggctttgaggctttcgttctttttcaatgtcttggcaacctaaaaagaaaaaaaaaacccattaacaaatttcagcaagaattacatgtactttagttaataaaaccaaggacacccttgcaccttccccaattcatgtatgaaatatcactgtcacacatacgataactactgccctaactattgccctttatctatgcagtatctgatagatgctcaataaatgctttttgaataaatctgtatgttgcattagtcattatggcataaaatttaagaatagttttattatgtaggatttatatttactgatcaacatgaatcagaaaatattctataattttggtaagttatcta

SEQ ID NO: 58074 - DNA, 601 bp, Human; identical to SEQ ID NO: 27326

SEQ ID NO: 58075 - DNA, 601 bp, Human; identical to SEQ ID NO: 27327

SEQ ID NO: 58076 - DNA, 601 bp, Human; identical to SEQ ID NO: 27328

SEQ ID NO: 58077 - DNA, 601 bp, Human
ttggaagtatggccattttagctatattgattctccaacccatgagcatgaaatatttttccatgtatttgttttgtctctgatttttttcagccatgttttgtagattctctttttccacacaaagtctggcagaatcactcatttattactccatatcatggaggaaaaatgaaataacattaattctctactgagtaatacaacaaaattctaaactcagtaggtttttgggaaatataactctttatttaaatatcagtacacagcaataaattactaaaggaaacaatcattaatrtaaatttttttcttattaaataattaaacaattctctttcaggacatggaaagaatccctggaggtctgaagtctaacatgattgttttactgacaatcatgtcagtaatgaaagaaagaaatcatcattcaaagaagtacttgattttccaaacaaaaagagaagaaagaaaatgttgacatatcttgtttagtcagccagaactttaagtgcaggaattccatcaggtagcaccaagagaaaattgcataatatgttaggaataatcactggttaaattgttggcaaaaggaatcaag

SEQ ID NO: 58078 - DNA, 601 bp, Human
atcatgatatctttgtcaggctgtatgtccaaagtggcatttcctaggttatcttccaggatttttatagttttaggacttacatttaaatctttaattcatgtcgagttattttacatatatggtgaaaggtagaggttcagtttcattctcctacacatggctagccagttatcccagcaccatttattgaattaggactctttcctcattgctttttttgttgattttgttgaaagttaaaaggtgtgaaggtttctttctgagctgtctattctgttccactgatctaagtgtctaytttggtaccagtaccattctgttttgatcaccgtagccttatattatagtttgaagtcaggctatgtggtgtctctggctttgttctttttgcttatgattgttttggctatttgggctcttttttaactccaaagaacttttagattagatttgtctaattttgtggaaaatgacattggtattgatagagatagtgttgcatctataaattgcttttggaagtatggccattttagctatattgattctccaacccatgagcatgaaatatttttccatgtatttgttttgtctctga

SEQ ID NO: 58079 - DNA, 601 bp, Human
tgtcatgtcgagcccatcctgcccacacacctttcaccttgggggctgtctcccagctcatgaaggagttctgaagccatcaagcaggcagtcactgtgtgatctgaaacactcagacagctcctcactctgatctatcttcctggtccccttgggatgaagcagcgtcctgttggttttcactgcagcagaagagaatcctcccccagggcagaactgctgggccaccagagtacccctctgctctttgccctcagggcatcttgatctgcagggtgggaggaactgccccagtcctcaraaatgaactctttatggattcctcttccaccatgatgtcaatgtctcttttgtcttctctagcccttggctgtggatcccaggttgtgtgccaaggagctcagggcacaaactcgctgttggcaaaccctctgggcttattgaaatatttgaaagatgaacagtgccatctgctggaaaagactggaaagtaccagtccaaggtatttcatagttccaacatcagactatgcaccattacaggttacaggtatgcaccaccacatctggctaatttttgtatttttagtagagacggagt

SEQ ID NO: 58080 - DNA, 601 bp, Human
gcaggggcgcgcggggctgcctcagtgacgaggcactggttctagatatttaccaaacggtgttgacacaccggggatgttataggcgattgctgatttcaaccacagatgactttgggggaaagttcgctcctgggggtttcagtttcgacccctccgcgtccattctggcttctgcgggctccgccagggcgtccgcttcgcccgagctccggacccaggtcctgccctgtggagaccccggagtgggtgcgccgctgccggccgatacccccgggcctccgggtccacagcgtccggraaaaaacggcctttcgaagacctgggatgactcgctggtcgcggcaagggacccttggttcccgtgtcagaaggatcaaggaaatgcggggcctgttggggtgaggagcacgaggtccctcctccatcctcgcggggactttgtcaccggctcagtgtgtagacctcaccgtcccactcgaatctgtggggctccgacagtgtgggccccgcgaggacccccatcctccttgccctggggccgctacaggagggcgccgggacgcactaggtcctgagtgtccagggtccggcaggggcg

SEQ ID NO: 58081 - DNA, 601 bp, Human
gtaagaaagagtggggccggagccccagggagggtcaccggatgggctcgcctgatctgttgtgggccccgagggtcctgggacgcggaacccaagcaggggcgcgcggggctgcctcagtgacgaggcactggttctagatatttaccaaacggtgttgacacaccggggatgttataggcgattgctgatttcaaccacagatgactttgggggaaagttcgctcctgggggtttcagtttcgacccctccgcgtccattctggcttctgcgggctccgccagggcgtccgcttcgccsgagctccggacccaggtcctgccctgtggagaccccggagtgggtgcgccgctgccggccgatacccccgggcctccgggtccacagcgtccggaaaaaaacggcctttcgaagacctgggatgactcgctggtcgcggcaagggacccttggttcccgtgtcagaaggatcaaggaaatgcggggcctgttggggtgaggagcacgaggtccctcctccatcctcgcggggactttgtcaccggctcagtgtgtagacctcaccgtcccactcgaatctgtggggctccgacagtgtgg

SEQ ID NO: 58082 - DNA, 601 bp, Human
gccctctgtttcctccgggtgtgtcacgccctgggctccaggtccccagtggcacaggtgctggcacagagttgggtgtctgcatccagcttctgttcctggtgccaggatggtccagggtgggtcgggtcggtgagttccaggctggaccctaaacaggggtcatgggggttcttggactgcagggaggccaggaggaggggaggcttctgtaagctcctgaatgtctccctggaatgtaatgcagcattgcaggctggagccagcctggcatggggagagagatgtgagactgatgaaragcgtgcagcctgatttaaagccaaaccctgagtcctttccaagaactataaagcatattgtagtcgctaaaagaaacaaatacaaaaaaacaaagtagcctttcttggcagatacagcaccttttatttttaatctttacatttaacattgcctttttaaaatactgtatattattcgatattttaaaatccaacctgggagtttcgctgatttatgtgatgagtttagtaattcacgtttattgttaattattactgtttaggatttagctatgccatttttttattttttatttttt

SEQ ID NO: 58083 - DNA, 601 bp, Human
agggagccaggatccaagtatttccagccccagggcctggagttgcaagtgggcggggcggggccactggagctgtgacagcatcgagagcctcggtgactcacgtgggggccctctgtttcctccgggtgtgtcacgccctgggctccaggtccccagtggcacaggtgctggcacagagttgggtgtctgcatccagcttctgttcctggtgccaggatggtccagggtgggtcgggtcggtgagttccaggctggaccctaaacaggggtcatgggggttcttggactgcagggaggycaggaggaggggaggcttctgtaagctcctgaatgtctccctggaatgtaatgcagcattgcaggctggagccagcctggcatggggagagagatgtgagactgatgaagagcgtgcagcctgatttaaagccaaaccctgagtcctttccaagaactataaagcatattgtagtcgctaaaagaaacaaatacaaaaaaacaaagtagcctttcttggcagatacagcaccttttatttttaatctttacatttaacattgcctttttaaaatactgtatattattcgatattttaaaa

SEQ ID NO: 58084 - DNA, 601 bp, Human
gaaaagaaagccctagaggcctactgtgatcaaccatcatgtgatcaattgtgtttccatggagagcagaacccgatagtaggggtctacgcatgggtggggctcactttgctgcactcccatctatgtccaaccacacccaaatccatggctgtatccgcacctcggctcagtccctggatggtccctgtaaccatcctcaaaggggacactcgagtgcgtcctcctctgagtcaccatggaaccatctagatctatggacagaagccagagggaggtggggagcccagtggcctctggyggcaagggagggcttagcctggggtgaggagtgggcagagctgagcccactctacccccggccactcagcccgttctccattgaatgagtcttcatgtggggagaacttcacctggtgaccagcaatccctagggtcctgaggctgtgggaaagaggaggaggcctggaccaagcccagggcctgtctctgcttcaggacagggtcatgggagggcagccacctctgtgactgagcagggacacaggagcctagaaggttctcgcctgatgcactaaagccactgtccaggaagggccac

SEQ ID NO: 58085 - DNA, 601 bp, Human
cacaccccctccctccgcctgcgtcgcggagtccccgaccctctctgtccagcgcgcagccgcctccccagtccaaagcggaccttctttgcctctccactaaaagcatgaggaggtctttgagtatattctatatccctttatgacttttggaaaaaaaagaaaagaaagccctagaggcctactgtgatcaaccatcatgtgatcaattgtgtttccatggagagcagaacccgatagtaggggtctacgcatgggtggggctcactttgctgcactcccatctatgtccaaccacacycaaatccatggctgtatccgcacctcggctcagtccctggatggtccctgtaaccatcctcaaaggggacactcgagtgcgtcctcctctgagtcaccatggaaccatctagatctatggacagaagccagagggaggtggggagcccagtggcctctggtggcaagggagggcttagcctggggtgaggagtgggcagagctgagcccactctacccccggccactcagcccgttctccattgaatgagtcttcatgtggggagaacttcacctggtgaccagcaatccctagggtcct

SEQ ID NO: 58086 - DNA, 601 bp, Human
gtgaagaaacttaacaggaatatacagtggcggcggtgaccccgtcaccgcctgcgccagcgacacaccccctccctccgcctgcgtcgcggagtccccgaccctctctgtccagcgcgcagccgcctccccagtccaaagcggaccttctttgcctctccactaaaagcatgaggaggtctttgagtatattctatatccctttatgacttttggaaaaaaaagaaaagaaagccctagaggcctactgtgatcaaccatcatgtgatcaattgtgtttccatggagagcagaacccgakagtaggggtctacgcatgggtggggctcactttgctgcactcccatctatgtccaaccacacccaaatccatggctgtatccgcacctcggctcagtccctggatggtccctgtaaccatcctcaaaggggacactcgagtgcgtcctcctctgagtcaccatggaaccatctagatctatggacagaagccagagggaggtggggagcccagtggcctctggtggcaagggagggcttagcctggggtgaggagtgggcagagctgagcccactctacccccggccactcagcccgttc

SEQ ID NO: 58087 - DNA, 601 bp, Human
ccgcgctctttaaaaaccctcctggtctgcagggcaagctgcagccgcaggaagcggacccagcgtaaaggagccgcagcggggaactccgggggcgggggggccgatgctcggggagatcgcgccggtccttctagaagctttccttcctctgaaacacgctgcagtccacagcccgccaagtttggccccagcccccgattaggctccagcccccgattaggctccatccccgaactcaccggcccgccctgacccggaccagccggacagcagtagcagaagcgggaagcacagaagraacgcggggcaagcggccgctgccattggggacctggggcacaggggacgggagtcggggtcgaggcggatatgggcggaggaatcgcctggtgcctcacattcaggctagtgaattggaccgctccgccccgtccagccccgttccgccccgccgcaggctgggatccaaggggcgtgatccgacggctgccttgtttgggcatgctccaccccgccctgctccggggctcgtcacgtgacagcggccccggcgggcgaaccctccccctccacctcggccccgcggcttggtggcggc

SEQ ID NO: 58088 - DNA, 601 bp, Human
ttgcaggggaagttccagggcggagccctacaggtgctggagggtggagagcgggtgagagcagagcatttctgtggttggtgggggagtttgtgatcgcatccctgtggaaccccgcttcacccctgtcctgaccccagctagggtttcgggggctctggtttcttcttcccgagggcgagtagggctgcggagctgcatcagggatccccgctccaccctgccctctgcagcccgttggcccctccaccctcctgtggtgccttttccgcgctctttaaaaaccctcctggtctgcagkgcaagctgcagccgcaggaagcggacccagcgtaaaggagccgcagcggggaactccgggggcgggggggccgatgctcggggagatcgcgccggtccttctagaagctttccttcctctgaaacacgctgcagtccacagcccgccaagtttggccccagcccccgattaggctccagcccccgattaggctccatccccgaactcaccggcccgccctgacccggaccagccggacagcagtagcagaagcgggaagcacagaagaaacgcggggcaagcggccgctgccattgggga

SEQ ID NO: 58089 - DNA, 601 bp, Human
ctggtgagcccctgggtgcaggtgagtgtctgcagcaaattgcaggggaagttccagggcggagccctacaggtgctggagggtggagagcgggtgagagcagagcatttctgtggttggtgggggagtttgtgatcgcatccctgtggaaccccgcttcacccctgtcctgaccccagctagggtttcgggggctctggtttcttcttcccgagggcgagtagggctgcggagctgcatcagggatccccgctccaccctgccctctgcagcccgttggcccctccaccctcctgtggtkccttttccgcgctctttaaaaaccctcctggtctgcagggcaagctgcagccgcaggaagcggacccagcgtaaaggagccgcagcggggaactccgggggcgggggggccgatgctcggggagatcgcgccggtccttctagaagctttccttcctctgaaacacgctgcagtccacagcccgccaagtttggccccagcccccgattaggctccagcccccgattaggctccatccccgaactcaccggcccgccctgacccggaccagccggacagcagtagcagaagcgggaagca

SEQ ID NO: 58090 - DNA, 601 bp, Human
caaggatggatgacctggaggctgaaaggagtcaccccaggaaataaccgagctcctttgcccagctttgagaactgagtcacatctcagacccagagtccattactagaaggagagcccagaggccctggtgggccccttcaacaccacagcaactgcaatgactccttcagcctcccccagagagccagatgggcattcactctggtaactgtacaccatgaaacagcaaatacccagacacttctggtggacacagtgtgtgatccaacctcctttcagagatctgaagcattaactgcctgttactcatgaggtgcatttggggcaaagtaacggatggacacctgtgtcaggtccagcttagggggatgtgctgggttcatagacccattcgatggtaatttcacatttcctggatttctaccgggaatggatagtgtttgtagttaatgtagtaactattataggttgtgctggtcatatgacctcccctgtcactactcaactctgctcttgtagctgggatgcagccatacacactctgtgatgaggggtgacgctggacctaccaatatggctatttgaccctggactccct

SEQ ID NO: 58091 - DNA, 601 bp, Human
cagaacaatgtccatcctctgtgctcatgggaagcctggaggactcctgattacccagcatacaaagaaggccccaggagaaggcagcagtctatcaggaagcccagggatgcctgttgctgaaggctggggttgagggtaggaaatgctgttcctgaaacgggctcccagtagtaatggggatggaaaatcctgaaataagagatctcaagtggaggccatcaactgtcaggaggaaggagggggcaaagatggaaataattagagaagtcacaatgccaggtggggacctcagtcatayaaaggtgtgcccatggctcatagaacaaaggggtcaagaatccaaaagagatggaaactcaacccggatgctgctagatttaaataactacaacaaacaaagacaaaacacaaggatggatgacctggaggctgaaaggagtcaccccaggaaataaccgagctcctttgcccagctttgagaactgagtcacatctcagacccagagtccattactagaaggagagcccagaggccctggtgggccccttcaacaccacagcaactgcaatgactccttcagcctcccccagagagcca

SEQ ID NO: 58092 - DNA, 601 bp, Human
cagtttgtcttagtgtgcttgtgtgggagagaagggagaaatctcttagtgtttcagtttgttcttcccaggtttttgtgacatttactttcttccgcagagaagcaaaggctttggccttgtggttaacacagtcatagtgaagaaaaggcctttcatccaccaggccttgaacttcacaccatcgtggttcaggtctgaacttaggagtgatgatgaagtcatagcaaagacagtgtgtgtctgtggaagaaaaacacaggagagggttggtgtggaggaaagtggaatctgagacccytcctcccccttatggtgactgcaaatgaaggcctctgaggggctgggctggcagagcaagatgtgccccagccaagcctgtcatgtcaactaattaaagactagagcatctcccttgcttgagtacatggaggggaaggttcctgcagccatgaaaccacatgtcccctccagacatgtctcacctgccctgtgccaacatcagtcagcacatgaccttgtggtggaggtgccaggcctgttgtggcaggaaaaggcctggatgaggaggaccctcagcagcagcccatgtggactgcag

SEQ ID NO: 58093 - DNA, 601 bp, Human
gtcatcttcttggctccaggatgaagtgctgtctactttctgttgtttgagtcaaagaggaggaaagtctgtccattgaagaggaactgccaagatcctctgccgtgtccgtgggcttcatgctcacaagacatcctggcctgcagaatgaggggctctgccctattgcaaagagatcagctctgatcttgacaaatcctgagccccaccctgcttcctttcctggctcctggacttgctctctctgctgcatccggcccatgctcctcaaccacttgggtgacacaaacttctgatttawtttttacaggaaaccaataaatgcctctaagacactactgtgtctgctctctgctgtcctggactattttaaacttaccgatgggtattacattctccatttcaatgtcaggcagttgccctttgaggaaatcccccacatctcttagtgtttcagtttgtcttagtgtgcttgtgtgggagagaagggagaaatctcttagtgtttcagtttgttcttcccaggtttttgtgacatttactttcttccgcagagaagcaaaggctttggccttgtggttaacacagtcatagtgaagaa

SEQ ID NO: 58094 - DNA, 601 bp, Human
acacacacacacacactcacacaacgggctgataagatctgaactcaagagagctgccttttttcacctctcacttacttgttggatccagcatttgttcccagtatatcaaaaagtcttcaagccatgtcttacaatcccccattgaaatgttatggaagaacacggtcacctccttgttcttctcccacttctctgtcatcttcttggctccaggatgaagtgctgtctactttctgttgtttgagtcaaagaggaggaaagtctgtccattgaagaggaactgccaagatcctctgcygtgtccgtgggcttcatgctcacaagacatcctggcctgcagaatgaggggctctgccctattgcaaagagatcagctctgatcttgacaaatcctgagccccaccctgcttcctttcctggctcctggacttgctctctctgctgcatccggcccatgctcctcaaccacttgggtgacacaaacttctgatttattttttacaggaaaccaataaatgcctctaagacactactgtgtctgctctctgctgtcctggactattttaaacttaccgatgggtattacattctccatttc

SEQ ID NO: 58095 - DNA, 601 bp, Human
aggtggtttcgatggatatacagacacagacagggggagaggaaaggaaaagtgattctaggaggaaggaacactaatgaaaaaggtctagaaacactatgacacccacagatttgaggctggtgagaaatgcacagtgggttgagcagaagcaggtgcagtgaggaagaggagtcgggggaagaagggagaggaggatggagagcataggtatgccagcacccccaggaggagccccccatgagggggtcatgttcacactcacttaaacacgcacacgcacacacacacacacacacaatcacacaacgggctgataagatctgaactcaagagagctgccttttttcacctctcacttacttgttggatccagcatttgttcccagtatatcaaaaagtcttcaagccatgtcttacaatcccccattgaaatgttatggaagaacacggtcacctccttgttcttctcccacttctctgtcatcttcttggctccaggatgaagtgctgtctactttctgttgtttgagtcaaagaggaggaaagtctgtccattgaagaggaactgccaagatcctctgccgtgtccgtgggcttc

SEQ ID NO: 58096 - DNA, 601 bp, Human
tgacagcacagcccaccctcctgctgtggcggaagaggagatgatgccccagggccagggaggggagggtctcggggctggcattctaggtggtttcgatggatatacagacacagacagggggagaggaaaggaaaagtgattctaggaggaaggaacactaatgaaaaaggtctagaaacactatgacacccacagatttgaggctggtgagaaatgcacagtgggttgagcagaagcaggtgcagtgaggaagaggagtcgggggaagaagggagaggaggatggagagcataggtaygccagcacccccaggaggagccccccatgagggggtcatgttcacactcacttaaacacgcacacgcacacacacacacacacacactcacacaacgggctgataagatctgaactcaagagagctgccttttttcacctctcacttacttgttggatccagcatttgttcccagtatatcaaaaagtcttcaagccatgtcttacaatcccccattgaaatgttatggaagaacacggtcacctccttgttcttctcccacttctctgtcatcttcttggctccaggatgaagtgctgt

SEQ ID NO: 58097 - DNA, 601 bp, Human
tgcctgcaggccacacaccactacccttcccgaataggaacctgctctgaaacaggcctgaaatggctaaactctctcaagctcaacaggccttgagccttggtatgggcccctccctttccctctggttctgacagtgagaatccatcagaactcagggctgagctacccaggtcattgccagtaggtgacactaggtctcattcatctgtctcatgtcaggatgagaaggtcccagccatggggatgggtgggactctgggaattctccttctgcatcctcccacctcacccatctgcytcttgctcccctcccaatattgcccacattacctgtcactctaaagaactctcctcagatgccagggaggataaagcagaggatgatgaggaggctccagggactgagggtgctggccatggctttgggttgggttgtgcctggggtcagagagggtggttctgaaatggaaacacaggagtgacaaccctcgtccaggccccaaatcttaggggatgcctcctcagctcctgcccccctcaactcatcctggaagagcttttgtcccacaatgctgtgaggaagctgctgtgaccgttc

SEQ ID NO: 58098 - DNA, 601 bp, Human
cctggccaagctcagtggtgagcatggaactccaacagcagcttagctcccctgcctgagtccactctgctccaggcagggccatcagctggctcaggatctggagtgtgcaagaggcggaatggcaggggcatcgccccagggcccagcaaggactcccatgggtccaaggggcctggccttttcctaaatctcaccctggacacgctctactcttcaccttccaccttaactgctgggacccgagctgctttctctgggaatgcagccttaggaactgggtgggccaaggccctcacakctccctcatcctgggattctcccagatcactctcttcttagcctcctccagggacgccctttcccttgacatccttggtgaagcagccatgctgctcctctcctactgtgcagactgcccatgcctgagttcctgctgcctgcaggccacacaccactacccttcccgaataggaacctgctctgaaacaggcctgaaatggctaaactctctcaagctcaacaggccttgagccttggtatgggcccctccctttccctctggttctgacagtgagaatccatcagaactcagggctga

SEQ ID NO: 58099 - DNA, 601 bp, Human
tggcactttcatgtataatttttatacaatcagcatcacagaacttatgattattttaaatgactagagtttatttttttaagctgggtttgggttcatagtgcagagaaaaatggggttaactctggtcagttaaccccatttttttggccttatgtcattttattttatttattcattttaatttcaacctatataattgattaaagggtacacatacaggtttgttgcatgggtagattttgggaggctgaggcttggtgtcccaatgatcccatcgctcaaacagtaaacatggcayctaacaagtgtttttttcagcccaggtgcctctcctctccctcccatctagtgatctccagtgtccatggttcatgtgaattcaatgtttagctgctagtttccaatgggaacatgcagtatgtggttttctgttcttgcattaggttgcttaggataatagcctctagttccatccatgttgctgaaaaggacatgattttcttgtgtttcatggctgcatagatttccatggtgtctatgtaccacattttttttcattcaattcactgttgctgggcacttagattgattctgtgtc

SEQ ID NO: 58100 - DNA, 601 bp, Human
cacttgaaaatggagaaaaagtagtaagggtataaagaagaagatggaaatcatctgtaattccattatacagtgtttaattttagggttttggcactttcatgtataatttttatacaatcagcatcacagaacttatgattattttaaatgactagagtttatttttttaagctgggtttgggttcatagtgcagagaaaaatggggttaactctggtcagttaaccccatttttttggccttatgtcattttattttatttattcattttaatttcaacctatataattgattaaagrgtacacatacaggtttgttgcatgggtagattttgggaggctgaggcttggtgtcccaatgatcccatcgctcaaacagtaaacatggcacctaacaagtgtttttttcagcccaggtgcctctcctctccctcccatctagtgatctccagtgtccatggttcatgtgaattcaatgtttagctgctagtttccaatgggaacatgcagtatgtggttttctgttcttgcattaggttgcttaggataatagcctctagttccatccatgttgctgaaaaggacatgattttcttgtgt

SEQ ID NO: 58101 - DNA, 601 bp, Human
tagaggaccagagctgttaggttcctctgcaatgccgagaccacctccacaacctgccctgcgtcattctctctcccgaggctgaatgcagctcttgtgctttcagtgccaaggaagccacagtcctaggccagaggaagggctgaggtggacagtggaaaaggaggaggtgggtgcagaaggagaaggctgacagcaaggatttcctgaggataaacaaaaaatgtcacttgaaaatggagaaaaagtagtaagggtataaagaagaagatggaaatcatctgtaattccattatacagygtttaattttagggttttggcactttcatgtataatttttatacaatcagcatcacagaacttatgattattttaaatgactagagtttatttttttaagctgggtttgggttcatagtgcagagaaaaatggggttaactctggtcagttaaccccatttttttggccttatgtcattttattttatttattcattttaatttcaacctatataattgattaaagggtacacatacaggtttgttgcatgggtagattttgggaggctgaggcttggtgtcccaatgatcccatcgctc

SEQ ID NO: 58102 - DNA, 601 bp, Human
tagaaagagacctcagcaggtcaaaggaggacaaacccaatgaatggagcttttccactgagtcccagatagaccaaatagagttctctggggctggggcttttgaatggctccaagaccagcgtgccccttcagcaagtggagactgtggctttgcagctgtcatggacatggtgagtccagtgttttctgggcgtaataaatcagcatatattgtgcagacaagaagtagaaagaaatgttaggaggaagaatataaagtttaagtacgaagggaagaattagaaaaaaaaaaaaaaaacaatgaggaaaggggcaaggttgacttggttgtagctaacctggtggagaaacgcagccgtctgcaatagaggaccagagctgttaggttcctctgcaatgccgagaccacctccacaacctgccctgcgtcattctctctcccgaggctgaatgcagctcttgtgctttcagtgccaaggaagccacagtcctaggccagaggaagggctgaggtggacagtggaaaaggaggaggtgggtgcagaaggagaaggctgacagcaaggatttcctgaggataaacaaaaaatgtcacttg

SEQ ID NO: 58103 - DNA, 601 bp, Human
acggtgggactctatgttgaggcttgagtctctgctcagttaggtgaggttggacagaggtttgcatcaatgccttgagccggcgagtctctccccagtgctgagggctttgtgtgtgtggtgcactcctgcccctgccgcactcaggcgggcagctgatgtcaccactgcagctccacttcctgcccgcacagaacctccaggtcagccaaagatcagagatgtggccttctcaggtgcttcctgggcacgtgccagcccctatgcacatctcattccccaaatctttctctcaatttcycccactagcctcttgtttgccctacatgcaaacggtgaggttgtatagttggaatgattgcttttagccaatgctctgaagatctggcttttcccctagaaagagacctcagcaggtcaaaggaggacaaacccaatgaatggagcttttccactgagtcccagatagaccaaatagagttctctggggctggggcttttgaatggctccaagaccagcgtgccccttcagcaagtggagactgtggctttgcagctgtcatggacatggtgagtccagtgttttctgggcgtaataaat

SEQ ID NO: 58104 - DNA, 601 bp, Human
ggattggagggggccagaggacacggtgggactctatgttgaggcttgagtctctgctcagttaggtgaggttggacagaggtttgcatcaatgccttgagccggcgagtctctccccagtgctgagggctttgtgtgtgtggtgcactcctgcccctgccgcactcaggcgggcagctgatgtcaccactgcagctccacttcctgcccgcacagaacctccaggtcagccaaagatcagagatgtggccttctcaggtgcttcctgggcacgtgccagcccctatgcacatctcattcsccaaatctttctctcaatttctcccactagcctcttgtttgccctacatgcaaacggtgaggttgtatagttggaatgattgcttttagccaatgctctgaagatctggcttttcccctagaaagagacctcagcaggtcaaaggaggacaaacccaatgaatggagcttttccactgagtcccagatagaccaaatagagttctctggggctggggcttttgaatggctccaagaccagcgtgccccttcagcaagtggagactgtggctttgcagctgtcatggacatggtgagtcca

SEQ ID NO: 58105 - DNA, 601 bp, Human
aaaattttttgccgtggactatttttaccctatctacctaaatgatttctttcttatctcctataacagcaggaggatgggagggacgagaggattggagggggccagaggacacggtgggactctatgttgaggcttgagtctctgctcagttaggtgaggttggacagaggtttgcatcaatgccttgagccggcgagtctctccccagtgctgagggctttgtgtgtgtggtgcactcctgcccctgccgcactcaggcgggcagctgatgtcaccactgcagctccacttcctgccygcacagaacctccaggtcagccaaagatcagagatgtggccttctcaggtgcttcctgggcacgtgccagcccctatgcacatctcattccccaaatctttctctcaatttctcccactagcctcttgtttgccctacatgcaaacggtgaggttgtatagttggaatgattgcttttagccaatgctctgaagatctggcttttcccctagaaagagacctcagcaggtcaaaggaggacaaacccaatgaatggagcttttccactgagtcccagatagaccaaatagagttctctgg

SEQ ID NO: 58106 - DNA, 601 bp, Human
cccgcgggcggaactgcctttggaagacgcgtgagaactccaccccatcgcggcaggggacagttattatctccgagcttgaggtgaggggaaatcagaggcggctgatggtttcctcctacagcctggtgctgggcgcggggaggactttacacccagctcctgccgagacgtgaccttacagctggggtccttggggctccaaaagtgcggcttccgcgcggatcccattcctgcttgctttgaggctgctggtgagcggcgcctgcgcaggggaagttgtgtgcccgagttgcttacytgtgttttattgatcttctagactgctcttgttagaagagaagtgatttctttgaactgcttggggttagaaagagagcaatttctgagctgttttttgttagaaggaaaattttttgccgtggactatttttaccctatctacctaaatgatttctttcttatctcctataacagcaggaggatgggagggacgagaggattggagggggccagaggacacggtgggactctatgttgaggcttgagtctctgctcagttaggtgaggttggacagaggtttgcatcaatgccttgagc

SEQ ID NO: 58107 - DNA, 601 bp, Human
cattgcgaggggtttcagttccgcccggcagcatccctcagggttctgcgcgctcccgtggcaccgtctgcgcccgagctccggtcccgtcccgattgcctgatgccccgcagggagcgcccagcggccgccgatgtcccaccagcaggcaccgggcgcctagcgggacccgcgggcggaactgcctttggaagacgcgtgagaactccaccccatcgcggcaggggacagttattatctccgagcttgaggtgaggggaaatcagaggcggctgatggtttcctcctacagcctggtgckgggcgcggggaggactttacacccagctcctgccgagacgtgaccttacagctggggtccttggggctccaaaagtgcggcttccgcgcggatcccattcctgcttgctttgaggctgctggtgagcggcgcctgcgcaggggaagttgtgtgcccgagttgcttacctgtgttttattgatcttctagactgctcttgttagaagagaagtgatttctttgaactgcttggggttagaaagagagcaatttctgagctgttttttgttagaaggaaaattttttgccgtggactatttt

SEQ ID NO: 58108 - DNA, 601 bp, Human
cgacggaatgccgaggacaccggtgttcgccgcgcaggggaaactgcggagcttcccgctgagccgtgtggggctttggtcacccgggtggagccgaagcgcggagaaaagtcctgacgtttcactcctcctgtctcctgcttcccatcctttccaggagatcatttcacttcattgttagcaaatcttttctcccatctgagcgctgcttctttattgtcttaaatgagtgtttcacaaagagcacggattgggttttgtactttttctgtgtggttggtttttgtgtgtctgtgggtgrtgaaatcgggtcggagtcgctctaaagtcatttttgtctcttgcgcgcctcagggaggatattaaaggcttttgtggatttcaaccgctaaagcctttcctcaaagttcattgcgaggggtttcagttccgcccggcagcatccctcagggttctgcgcgctcccgtggcaccgtctgcgcccgagctccggtcccgtcccgattgcctgatgccccgcagggagcgcccagcggccgccgatgtcccaccagcaggcaccgggcgcctagcgggacccgcgggcggaactgcctttgga

SEQ ID NO: 58109 - DNA, 601 bp, Human
gacccattcctggaactcaccggctcgcgccgtccagggacagtcctgcagcagaagcagagccagaatgcaatgaatcaacgtggggccctcggccagcgcctttgggaccgggacctggcgacggaatgccgaggacaccggtgttcgccgcgcaggggaaactgcggagcttcccgctgagccgtgtggggctttggtcacccgggtggagccgaagcgcggagaaaagtcctgacgtttcactcctcctgtctcctgcttcccatcctttccaggagatcatttcacttcattgttwgcaaatcttttctcccatctgagcgctgcttctttattgtcttaaatgagtgtttcacaaagagcacggattgggttttgtactttttctgtgtggttggtttttgtgtgtctgtgggtggtgaaatcgggtcggagtcgctctaaagtcatttttgtctcttgcgcgcctcagggaggatattaaaggcttttgtggatttcaaccgctaaagcctttcctcaaagttcattgcgaggggtttcagttccgcccggcagcatccctcagggttctgcgcgctcccgtggcaccgtctgc

SEQ ID NO: 58110 - DNA, 601 bp, Human
ggccgcgagaccaagcatttattccaggcgaccagctgtttcactgcccttagtttctggtctcgtttccgccactgtgttttctcgggccgggagaagcagccccagggacgcgacaggggcagaaggagccctgcatggggaattgagaagggtgcggcgcggtcagaaagatccgtcctccgcgacgccctctcctctttctccgacccattcctggaactcaccggctcgcgccgtccagggacagtcctgcagcagaagcagagccagaatgcaatgaatcaacgtggggccctcrgccagcgcctttgggaccgggacctggcgacggaatgccgaggacaccggtgttcgccgcgcaggggaaactgcggagcttcccgctgagccgtgtggggctttggtcacccgggtggagccgaagcgcggagaaaagtcctgacgtttcactcctcctgtctcctgcttcccatcctttccaggagatcatttcacttcattgttagcaaatcttttctcccatctgagcgctgcttctttattgtcttaaatgagtgtttcacaaagagcacggattgggttttgtactttttctgtg

SEQ ID NO: 58111 - DNA, 601 bp, Human
tcccataaaactcctgctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagccccagggacgcgacaggggcagaaggagccctgcatggggaattgagaagggtgcggcgcggtcagaaagatccgtcctccgcgacgccctctcctctttctccgacccattcctggaactcaccggctcgcgccrtccagggacagtcctgcagcagaagcagagccagaatgcaatgaatcaacgtggggccctcggccagcgcctttgggaccgggacctggcgacggaatgccgaggacaccggtgttcgccgcgcaggggaaactgcggagcttcccgctgagccgtgtggggctttggtcacccgggtggagccgaagcgcggagaaaagtcctgacgtttcactcctcctgtctcctgcttcccatcctttccaggagatcatttcacttcattgttagcaaatcttttctcccatctgagcgctgctt

SEQ ID NO: 58112 - DNA, 601 bp, Human
ccctcctcactggcccatttataaaaactctgacatttttactacaacctggcaacccgttcgggacacctctctgtgacagagagctgttctttcctttctcccataaaactcctgctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagccccagggacgcgacaggggcagaaggagccctgcrtggggaattgagaagggtgcggcgcggtcagaaagatccgtcctccgcgacgccctctcctctttctccgacccattcctggaactcaccggctcgcgccgtccagggacagtcctgcagcagaagcagagccagaatgcaatgaatcaacgtggggccctcggccagcgcctttgggaccgggacctggcgacggaatgccgaggacaccggtgttcgccgcgcaggggaaactgcggagcttcccgctgagccgtgtggggctttggtcacccgggtggagccgaagcgcggagaaaa

SEQ ID NO: 58113 - DNA, 601 bp, Human
aaccgcttcttcgggccctatggagataagacaccccctcctcactggcccatttataaaaactctgacatttttactacaacctggcaacccgttcgggacacctctctgtgacagagagctgttctttcctttctcccataaaactcctgctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagycccagggacgcgacaggggcagaaggagccctgcatggggaattgagaagggtgcggcgcggtcagaaagatccgtcctccgcgacgccctctcctctttctccgacccattcctggaactcaccggctcgcgccgtccagggacagtcctgcagcagaagcagagccagaatgcaatgaatcaacgtggggccctcggccagcgcctttgggaccgggacctggcgacggaatgccgaggacaccggtgttcgccgcgcaggggaaactgcggagcttcccgctgagccgtgtggggct

SEQ ID NO: 58114 - DNA, 601 bp, Human
gattaaaaagaaaatcacaaaaaatcagaaaataagataaattaaaacaaaaacacagcatattataacttatgagaagtagctaaagcagttcttagagggaaatgcattgctgtcagtgtgaatatattgagaaagagaaaagaaacaaaggagtaatctcaaattgagaacctaatatttcacttgaagaaactcaaaaaagaagccatctactcaaaataaacgaacaatgaataggaattagaatgtaaataaatgaagtagagaagagaaaaacattggagaactcaacaaaacygatagctgagtgttcgaaaagcttggtcattggcattggaggtggctttgatggatttctagaaacagaccagggagaggaaaggaaaagtaattctcaagagagggaacactaaggagaaaggtctgaaaacacaatgacacccacagtttcgaggctcgtgagaaatccacagtgagtggagcagaagcaagcgcagtgaggaagaagagtcaggagggagaagggagaggaggatgggagagcacaggcacaccagcatgactaggaggagccctgtggggtgacattgctgggctg

SEQ ID NO: 58115 - DNA, 601 bp, Human
gtcagggaggtgggggtgggggtgggatgattctgcccaggacccataccatatactttttatatttatcatttttccaccttaaaatgcaggagggagcagagcaatactggagaagagatttttcatcctattaaaattaagcatgaggcacacatctttgctctcagtactttgggaggccaagtaagaaatattgcttgagcccaggaggtcaaggctacagtgagctatgatcataccactgcatgccagcctgggtcagcccaggaggtcaaggctacagtgaattatgatcatkccactgcatgccagcctgggtcacagagtgagaccctgtttcaaaaataaaataacataaaataagataaaaagttgctttttatccaatctaggttgtgataaattaagatattaattgctattccacaggaaaaccactaagaaagtaacattttaaaaataattaaggggccgggtgtagtggctcatgcctgtaaacccagcactttgggaggctgaggcgggcaaatcccctgaagttgggagtttaagaccaacctgaccaacatggagaaaccctgtctctactaaaaaatac

SEQ ID NO: 58116 - DNA, 601 bp, Human
cctttccatgtaacccagtgcagaggttccagggactcggacctgcatcttgtcagggaggtgggggtgggggtgggatgattctgcccaggacccataccatatactttttatatttatcatttttccaccttaaaatgcaggagggagcagagcaatactggagaagagatttttcatcctattaaaattaagcatgaggcacacatctttgctctcagtactttgggaggccaagtaagaaatattgcttgagcccaggaggtcaaggctacagtgagctatgatcataccactgcaygccagcctgggtcagcccaggaggtcaaggctacagtgaattatgatcattccactgcatgccagcctgggtcacagagtgagaccctgtttcaaaaataaaataacataaaataagataaaaagttgctttttatccaatctaggttgtgataaattaagatattaattgctattccacaggaaaaccactaagaaagtaacattttaaaaataattaaggggccgggtgtagtggctcatgcctgtaaacccagcactttgggaggctgaggcgggcaaatcccctgaagttgggagt

SEQ ID NO: 58117 - DNA, 601 bp, Human
accaggctggatcctcagggtgccctctgtcttgttctccctcttctgtccccatcttcctgtataaagatcctgtggttacaatggacccctgggaaatccagagaattaccccatctccaggacagatgataagcaacctcagctccacctgcagccttcattcccctttccatgtaacccagtgcagaggttccagggactcggacctgcatcttgtcagggaggtgggggtgggggtgggatgattctgcccaggacccataccatatactttttatatttatcatttttccacctyaaaatgcaggagggagcagagcaatactggagaagagatttttcatcctattaaaattaagcatgaggcacacatctttgctctcagtactttgggaggccaagtaagaaatattgcttgagcccaggaggtcaaggctacagtgagctatgatcataccactgcatgccagcctgggtcagcccaggaggtcaaggctacagtgaattatgatcattccactgcatgccagcctgggtcacagagtgagaccctgtttcaaaaataaaataacataaaataagataaaaagttgctttt

SEQ ID NO: 58118 - DNA, 601 bp, Human
caccaggctggatcctcagggtgccctctgtcttgttctccctcttctgtccccatcttcctgtataaagatcctgtggttacaatggacccctgggaaatccagagaattaccccatctccaggacagatgataagcaacctcagctccacctgcagccttcattcccctttccatgtaacccagtgcagaggttccagggactcggacctgcatcttgtcagggaggtgggggtgggggtgggatgattctgcccaggacccataccatatactttttatatttatcatttttccaccwtaaaatgcaggagggagcagagcaatactggagaagagatttttcatcctattaaaattaagcatgaggcacacatctttgctctcagtactttgggaggccaagtaagaaatattgcttgagcccaggaggtcaaggctacagtgagctatgatcataccactgcatgccagcctgggtcagcccaggaggtcaaggctacagtgaattatgatcattccactgcatgccagcctgggtcacagagtgagaccctgtttcaaaaataaaataacataaaataagataaaaagttgcttt

SEQ ID NO: 58119 - DNA, 601 bp, Human
tccaccaggctggatcctcagggtgccctctgtcttgttctccctcttctgtccccatcttcctgtataaagatcctgtggttacaatggacccctgggaaatccagagaattaccccatctccaggacagatgataagcaacctcagctccacctgcagccttcattcccctttccatgtaacccagtgcagaggttccagggactcggacctgcatcttgtcagggaggtgggggtgggggtgggatgattctgcccaggacccataccatatactttttatatttatcatttttccascttaaaatgcaggagggagcagagcaatactggagaagagatttttcatcctattaaaattaagcatgaggcacacatctttgctctcagtactttgggaggccaagtaagaaatattgcttgagcccaggaggtcaaggctacagtgagctatgatcataccactgcatgccagcctgggtcagcccaggaggtcaaggctacagtgaattatgatcattccactgcatgccagcctgggtcacagagtgagaccctgtttcaaaaataaaataacataaaataagataaaaagttgct

SEQ ID NO: 58120 - DNA, 601 bp, Human
agctccaccaggctggatcctcagggtgccctctgtcttgttctccctcttctgtccccatcttcctgtataaagatcctgtggttacaatggacccctgggaaatccagagaattaccccatctccaggacagatgataagcaacctcagctccacctgcagccttcattcccctttccatgtaacccagtgcagaggttccagggactcggacctgcatcttgtcagggaggtgggggtgggggtgggatgattctgcccaggacccataccatatactttttatatttatcatttttmcaccttaaaatgcaggagggagcagagcaatactggagaagagatttttcatcctattaaaattaagcatgaggcacacatctttgctctcagtactttgggaggccaagtaagaaatattgcttgagcccaggaggtcaaggctacagtgagctatgatcataccactgcatgccagcctgggtcagcccaggaggtcaaggctacagtgaattatgatcattccactgcatgccagcctgggtcacagagtgagaccctgtttcaaaaataaaataacataaaataagataaaaagtt

SEQ ID NO: 58121 - DNA, 601 bp, Human
ccaaacctggcaggatgactcaccccggttgcactcacagccaagacccactcggcctctggaccaatctaccgcaggggatggtaaagtcaggagtgtgaatactactgagccttctgccagggcataagaaacagcaagtgtaggatgaccagcaggaggctcagactaccctgccctgcactctcccactttgagtggggaggaagccttgagcccagggggttgagatttcagtgaactatgatcgtgccactgcactccagactggtgacagagcaagactctgtcacacacatgytcacacacacaaattaaattgtgatataatacatgtaacatgaaagtttccatcttaaccatttttaaatgtaaaagtatctttttcaaaatgcagtatttccacctgcctgagcaatcctggaccttcttcacctgaattttttcttcctaaagcaaggaccactttaaatcagactgtattagttttcaatagctgttgttacaaattactacaaatttagtgttttaaaacaacatacattcatccaggcacggtggctcacgcctgtaatcccaccactttgggaggctgagttgg

SEQ ID NO: 58122 - DNA, 601 bp, Human
gattggggtggatgatgagaaaagtttcctgaatatcatagtttccaaacctggcaggatgactcaccccggttgcactcacagccaagacccactcggcctctggaccaatctaccgcaggggatggtaaagtcaggagtgtgaatactactgagccttctgccagggcataagaaacagcaagtgtaggatgaccagcaggaggctcagactaccctgccctgcactctcccactttgagtggggaggaagccttgagcccagggggttgagatttcagtgaactatgatcgtgccacygcactccagactggtgacagagcaagactctgtcacacacatgctcacacacacaaattaaattgtgatataatacatgtaacatgaaagtttccatcttaaccatttttaaatgtaaaagtatctttttcaaaatgcagtatttccacctgcctgagcaatcctggaccttcttcacctgaattttttcttcctaaagcaaggaccactttaaatcagactgtattagttttcaatagctgttgttacaaattactacaaatttagtgttttaaaacaacatacattcatccaggcacg

SEQ ID NO: 58123 - DNA, 601 bp, Human
gggatgatgctgggagggccgtgaaatggggagccaatggtgagagcatggtgaacacagagagcccagaccccacaccatctggggaggaactcatgtgatgctgggagcactgggaaggcagggagcctggctgcagcactcactgttcctctcatctgggaccggattggggtggatgatgagaaaagtttcctgaatatcatagtttccaaacctggcaggatgactcaccccggttgcactcacagccaagacccactcggcctctggaccaatctaccgcaggggatggtaaagwcaggagtgtgaatactactgagccttctgccagggcataagaaacagcaagtgtaggatgaccagcaggaggctcagactaccctgccctgcactctcccactttgagtggggaggaagccttgagcccagggggttgagatttcagtgaactatgatcgtgccactgcactccagactggtgacagagcaagactctgtcacacacatgctcacacacacaaattaaattgtgatataatacatgtaacatgaaagtttccatcttaaccatttttaaatgtaaaagtatctttttcaa

SEQ ID NO: 58124 - DNA, 601 bp, Human
tggaccaggggtcttgccccgacctctgcctcttcacccaacccccacctggtcaggcagtgaccctggaggggctgggatgatgctgggagggccgtgaaatggggagccaatggtgagagcatggtgaacacagagagcccagaccccacaccatctggggaggaactcatgtgatgctgggagcactgggaaggcagggagcctggctgcagcactcactgttcctctcatctgggaccggattggggtggatgatgagaaaagtttcctgaatatcatagtttccaaacctggcagratgactcaccccggttgcactcacagccaagacccactcggcctctggaccaatctaccgcaggggatggtaaagtcaggagtgtgaatactactgagccttctgccagggcataagaaacagcaagtgtaggatgaccagcaggaggctcagactaccctgccctgcactctcccactttgagtggggaggaagccttgagcccagggggttgagatttcagtgaactatgatcgtgccactgcactccagactggtgacagagcaagactctgtcacacacatgctcacacacacaaa

SEQ ID NO: 58125 - DNA, 601 bp, Human
aagtcaaactggaccaggggtcttgccccgacctctgcctcttcacccaacccccacctggtcaggcagtgaccctggaggggctgggatgatgctgggagggccgtgaaatggggagccaatggtgagagcatggtgaacacagagagcccagaccccacaccatctggggaggaactcatgtgatgctgggagcactgggaaggcagggagcctggctgcagcactcactgttcctctcatctgggaccggattggggtggatgatgagaaaagtttcctgaatatcatagtttccaarcctggcaggatgactcaccccggttgcactcacagccaagacccactcggcctctggaccaatctaccgcaggggatggtaaagtcaggagtgtgaatactactgagccttctgccagggcataagaaacagcaagtgtaggatgaccagcaggaggctcagactaccctgccctgcactctcccactttgagtggggaggaagccttgagcccagggggttgagatttcagtgaactatgatcgtgccactgcactccagactggtgacagagcaagactctgtcacacacatgctcac

SEQ ID NO: 58126 - DNA, 601 bp, Human
ggatgtggaatacagtcacgtttcagagaggaacctaaagtcaaactggaccaggggtcttgccccgacctctgcctcttcacccaacccccacctggtcaggcagtgaccctggaggggctgggatgatgctgggagggccgtgaaatggggagccaatggtgagagcatggtgaacacagagagcccagaccccacaccatctggggaggaactcatgtgatgctgggagcactgggaaggcagggagcctggctgcagcactcactgttcctctcatctgggaccggattggggtggrtgatgagaaaagtttcctgaatatcatagtttccaaacctggcaggatgactcaccccggttgcactcacagccaagacccactcggcctctggaccaatctaccgcaggggatggtaaagtcaggagtgtgaatactactgagccttctgccagggcataagaaacagcaagtgtaggatgaccagcaggaggctcagactaccctgccctgcactctcccactttgagtggggaggaagccttgagcccagggggttgagatttcagtgaactatgatcgtgccactgcactccagac

SEQ ID NO: 58127 - DNA, 601 bp, Human
cctcttctctgcccttccctggcacctctcttcagcggcatctgtgcaggaactgctgggaagatggacacatagacactggttacatttgttgtgatgcagtcattctgtgcaatattgtgcagagataaaaaggaaaagaatctgtatgtgtgggtcttggaagatcttcaaactgttattttgggatagaatctgcgtgcagcagagtgcctatgggcttatctttgttataaaaaccagcattgatacgtacacatgtctgcactattagtaaagaaaacagtgtttccataacttmttgccagtctgtttatccgttttaggaaaaatcaatatagttaaaaagccatggtggcaggaattggtcatcaccagccctgattctacactgccctacacatcatctcaactgaggttgctggaggaacaggatgtggaatacagtcacgtttcagagaggaacctaaagtcaaactggaccaggggtcttgccccgacctctgcctcttcacccaacccccacctggtcaggcagtgaccctggaggggctgggatgatgctgggagggccgtgaaatggggagccaatggtgagagc

SEQ ID NO: 58128 - DNA, 601 bp, Human
gtccccttctgtacctaccaccttttccactgtccacctgagcccttcctctggcctgggactatggcttccttggcactgaaggcacaagagctacattcagcctcaggagaggatgatgcagggtaggttgtggaggtggtctcagcattgcagatgagtctaacagcgcccagtctccattgcagacggctgcatttctccaccatgttagctacaaccaagccaaccttgcccctttcttgtttggtttttgtctcactcttcccaactgcttcttgaaaattcatattcttccacytaacatttctttctacttcttgacttcacaatgtacactgatttgttgtgcccagaaaacactggtcccaccatgtcgtaagttaccatctaaagtgtagtgaatgaatggacaggaaagaggcccctgccccaatcactgcctctcatttattcactcacagggtaagtacagcctcagcaccaacaatgggctgtgctgcggatgcttccctgaggaaaacagacaaaatccctgctccagtggggacagcaggtgaacctaatgagcaggggcattgcatcgggtgtaggaaggtga

SEQ ID NO: 58129 - DNA, 601 bp, Human
acatatgattataccaaaaccctaacattaaacactgtgtaatggaattatggataattgccatcttgttattatacctttcttttttgtcccattttcaagtgacattttttgtttatcctcaggaactcattgcttacaggggtccccttctgtacctaccaccttttccactgtccacctgagcccttcctctggcctgggactatggcttccttggcactgaaggcacaagagctacattcagcctcaggagaggatgatgcagggtaggttgtggaggtggtctcagcattgcagrtgagtctaacagcgcccagtctccattgcagacggctgcatttctccaccatgttagctacaaccaagccaaccttgcccctttcttgtttggtttttgtctcactcttcccaactgcttcttgaaaattcatattcttccacctaacatttctttctacttcttgacttcacaatgtacactgatttgttgtgcccagaaaacactggtcccaccatgtcgtaagttaccatctaaagtgtagtgaatgaatggacaggaaagaggcccctgccccaatcactgcctctcatttattca

SEQ ID NO: 58130 - DNA, 601 bp, Human
aaaataaactctagtcatttaaaataagtgtaaggtatatgaccataatgttataaaaattacatatgattataccaaaaccctaacattaaacactgtgtaatggaattatggataattgccatcttgttattatacctttcttttttgtcccattttcaagtgacattttttgtttatcctcaggaactcattgcttacaggggtccccttctgtacctaccaccttttccactgtccacctgagcccttcctctggcctgggactatggcttccttggcactgaaggcacaagagctrcattcagcctcaggagaggatgatgcagggtaggttgtggaggtggtctcagcattgcagatgagtctaacagcgcccagtctccattgcagacggctgcatttctccaccatgttagctacaaccaagccaaccttgcccctttcttgtttggtttttgtctcactcttcccaactgcttcttgaaaattcatattcttccacctaacatttctttctacttcttgacttcacaatgtacactgatttgttgtgcccagaaaacactggtcccaccatgtcgtaagttaccatctaaag

SEQ ID NO: 58131 - DNA, 601 bp, Human
gggatagttgggaccccaagccgcagcctcccacaattgacccatgtaacgaacctgcacgtgtactctttaatctataaaaagagttgaaattaaaaatgaataaagaaaataaaatgacatgaggcaaaaacaaaaaatgggtttaactgacaggggtgagagagaactctgcattatcaactctaaccctgctctaaaaaaataaactctagtcatttaaaataagtgtaaggtatatgaccataatgttataaaaattacatatgattataccaaaaccctaacattaaacactgtrtaatggaattatggataattgccatcttgttattatacctttcttttttgtcccattttcaagtgacattttttgtttatcctcaggaactcattgcttacaggggtccccttctgtacctaccaccttttccactgtccacctgagcccttcctctggcctgggactatggcttccttggcactgaaggcacaagagctacattcagcctcaggagaggatgatgcagggtaggttgtggaggtggtctcagcattgcagatgagtctaacagcgcccagtctccattgcagacggctg

SEQ ID NO: 58132 - DNA, 601 bp, Human
cattgcagtgctattctcatgagcaaggacgcagaaccaatctaagtgcccagcagcaggggactgaatgaaggaagcgtggtacgtatgcaccatggaaatctatgcagccacgaaagacaacaaaatcatgtcattttcagcaacatggatggagctggaggccattatcctaggtgacttaacagaacagacaactgcattctgcaggttctcgtttataagaggagggctaaacattaaatatatatgaatataaagatgggaaccacagacactggagatcactagacaggggagrgaggaggggcatgtgggctgaagaaccacccactgggtaccgcttttactgtctgggtgatgggatagttgggaccccaagccgcagcctcccacaattgacccatgtaacgaacctgcacgtgtactctttaatctataaaaagagttgaaattaaaaatgaataaagaaaataaaatgacatgaggcaaaaacaaaaaatgggtttaactgacaggggtgagagagaactctgcattatcaactctaaccctgctctaaaaaaataaactctagtcatttaaaataagtgtaaggtat

SEQ ID NO: 58133 - DNA, 601 bp, Human
aaatgtctaatatgcagaatctacaaggagtttaaacaactcaacaagcaagaagaaaaaaccctattaaaaagtaagcaaagaacatgaacagacgcttttcaaagaagacctgcaagtggcggacaaacatgaacaaatgctcaatatgaatcatcatcagagaaatgcagatcaaaaccacagtgagctaccatctcataccagtcaaaacggcaattctttatttattttttatttttatttttttttgagacggagtctcgctgtctcccaggctggagtgcattggcgcaatctyggctcactgcaagctccgcctcccgggttcacgccattctcctgcctcagcctcccgtgtagctgagactgcaggcgcccgccaccaggcccggctaattttttgtatgtttagtagagacggagtttcacggtgctagccaggatggtctcaatctcctgacctcgtgatccgcccgcctcggcctcccaaagtactgggattacaggcgtgagccaccgcgcccggcccaaaacggcaattcttaaaaagtcaaaaaaaccacagatgttggtgaagccgaggagaaaaaggaacact

SEQ ID NO: 58134 - DNA, 601 bp, Human
cacaaatgtctaatatgcagaatctacaaggagtttaaacaactcaacaagcaagaagaaaaaaccctattaaaaagtaagcaaagaacatgaacagacgcttttcaaagaagacctgcaagtggcggacaaacatgaacaaatgctcaatatgaatcatcatcagagaaatgcagatcaaaaccacagtgagctaccatctcataccagtcaaaacggcaattctttatttattttttatttttatttttttttgagacggagtctcgctgtctcccaggctggagtgcattggcgcaaacttggctcactgcaagctccgcctcccgggttcacgccattctcctgcctcagcctcccgtgtagctgagactgcaggcgcccgccaccaggcccggctaattttttgtatgtttagtagagacggagtttcacggtgctagccaggatggtctcaatctcctgacctcgtgatccgcccgcctcggcctcccaaagtactgggattacaggcgtgagccaccgcgcccggcccaaaacggcaattcttaaaaagtcaaaaaaaccacagatgttggtgaagccgaggagaaaaaggaac

SEQ ID NO: 58135 - DNA, 601 bp, Human
gtaaacagcctatagagtaggagaaatatctgcaaactatgcatctcacaaatgtctaatatgcagaatctacaaggagtttaaacaactcaacaagcaagaagaaaaaaccctattaaaaagtaagcaaagaacatgaacagacgcttttcaaagaagacctgcaagtggcggacaaacatgaacaaatgctcaatatgaatcatcatcagagaaatgcagatcaaaaccacagtgagctaccatctcataccagtcaaaacggcaattctttatttattttttatttttatttttttttgagacggagtctcgctgtctcccaggctggagtgcattggcgcaatcttggctcactgcaagctccgcctcccgggttcacgccattctcctgcctcagcctcccgtgtagctgagactgcaggcgcccgccaccaggcccggctaattttttgtatgtttagtagagacggagtttcacggtgctagccaggatggtctcaatctcctgacctcgtgatccgcccgcctcggcctcccaaagtactgggattacaggcgtgagccaccgcgcccggcccaaaacggcaattcttaaaaa

SEQ ID NO: 58136 - DNA, 601 bp, Human
ggcagagatttcatgatgaagacaccaaaagcaactggaaccaaaaccaaaaattggcaaatgggatctcattaaactaaagaacttctgcacagcaaaagaaactagcaacacagtaaacagcctatagagtaggagaaatatctgcaaactatgcatctcacaaatgtctaatatgcagaatctacaaggagtttaaacaactcaacaagcaagaagaaaaaaccctattaaaaagtaagcaaagaacatgaacagacgcttttcaaagaagacctgcaagtggcggacaaacatgaamaaatgctcaatatgaatcatcatcagagaaatgcagatcaaaaccacagtgagctaccatctcataccagtcaaaacggcaattctttatttattttttatttttatttttttttgagacggagtctcgctgtctcccaggctggagtgcattggcgcaatcttggctcactgcaagctccgcctcccgggttcacgccattctcctgcctcagcctcccgtgtagctgagactgcaggcgcccgccaccaggcccggctaattttttgtatgtttagtagagacggagtttcacggtgc

SEQ ID NO: 58137 - DNA, 601 bp, Human
ggacataggacctggcagagatttcatgatgaagacaccaaaagcaactggaaccaaaaccaaaaattggcaaatgggatctcattaaactaaagaacttctgcacagcaaaagaaactagcaacacagtaaacagcctatagagtaggagaaatatctgcaaactatgcatctcacaaatgtctaatatgcagaatctacaaggagtttaaacaactcaacaagcaagaagaaaaaaccctattaaaaagtaagcaaagaacatgaacagacgcttttcaaagaagacctgcaagtggcsgacaaacatgaacaaatgctcaatatgaatcatcatcagagaaatgcagatcaaaaccacagtgagctaccatctcataccagtcaaaacggcaattctttatttattttttatttttatttttttttgagacggagtctcgctgtctcccaggctggagtgcattggcgcaatcttggctcactgcaagctccgcctcccgggttcacgccattctcctgcctcagcctcccgtgtagctgagactgcaggcgcccgccaccaggcccggctaattttttgtatgtttagtagagacgg

SEQ ID NO: 58138 - DNA, 601 bp, Human
tttaaatgtacgtcttaaaactataaaaatcctggaagataacctagaaataccactctggacataggacctggcagagatttcatgatgaagacaccaaaagcaactggaaccaaaaccaaaaattggcaaatgggatctcattaaactaaagaacttctgcacagcaaaagaaactagcaacacagtaaacagcctatagagtaggagaaatatctgcaaactatgcatctcacaaatgtctaatatgcagaatctacaaggagtttaaacaactcaacaagcaagaagaaaaaacccwattaaaaagtaagcaaagaacatgaacagacgcttttcaaagaagacctgcaagtggcggacaaacatgaacaaatgctcaatatgaatcatcatcagagaaatgcagatcaaaaccacagtgagctaccatctcataccagtcaaaacggcaattctttatttattttttatttttatttttttttgagacggagtctcgctgtctcccaggctggagtgcattggcgcaatcttggctcactgcaagctccgcctcccgggttcacgccattctcctgcctcagcctcccgtgtagct

SEQ ID NO: 58139 - DNA, 601 bp, Human
gatgacaccatggacccaatagctcattcactgccttgatcccttttgtcaacaattttaccaccggttattcctaacatcttatgctattttctcttggtgttacctgatggaatttttgcacttaaagttctggctgactaaataagatatgtcaacattttctttcttttgcttttgtttagaaaatcagttacttctttgaatgatgaccctgttcttccaaatgatattgtcagtaaaacaatcatgttagacttcagacctccagggattctttccatgtcctgaaagataattygttaaatatctaataaaaaattatattaatgagtttcctttagtaatttgttgccctctactgatatttaaataaagagttctatgtaccaaaaacctactgagtttggaattttgttgtattacccagtagagaattaatgttatatcatttttcctccatgatatggagtaataaatgagtgattctgctagattttgtgtggaaacagaatctacaaaacatggctgaaaaaatcagagacaacaaaaatacatggaaaaatatttcatgctcatgggttggagaatcaatatagct

SEQ ID NO: 58140 - DNA, 601 bp, Human
cttcaatggacagaggttcctcctctttgacccaaacaacagaaagtagacagtgcttcatcctggagtcaagaagatgaaagagaagtgggagaagaacagggatgtggccatgttcttccagaagatttcactgggagacggaaacttggcttgaggaattcttgatacactgggaaaaaatgctgaagagaacaagtaagtgggaagaaaacaaaggtagctgtcctgagttcagatctaatcagtccagtgtctgtgtgtgtgtgtgtgtgtgtgtttgagtgagtgtgaacaagaycccctcatggagggctcctcctgggggtgcctgtgctctcccatcctcctctcccttctccctcctgactcctcttcctcactgcacttgcttctgctcccctccttgtggatttctcaccagccttgaaactgcgggtgtcactgagtttccagacctggaaaagtgatccgggttctccttcaccatttaaaccaacatttgtatcctttctgaaggctgaagatgaaaccaaaaagcccctgtgagcacggtctcgatcaaactttcccttctggctggccacctgcccaccacgta

SEQ ID NO: 58141 - DNA, 601 bp, Human
gggaggaggggtctcaggttccactcccagccacaccatccccctcctgtgtttttcttccatacacacacactgcctttgctatgacttcatcgtcactcctaagttcagacctgaaccacgatggtgtgaagttcaagatcaggtggataaaaggccttttcttcactatgactgtgttagccataaggccaaagcctttgcttctctggggaagaaagtcaatgtcacaaaagcctgggaagaacagactgaaacactaagagacatggtggatttcctcaaagagcaactgcctgaygttcgagtggagaattgaatatccagtggtaagtttaaaatggcccaggacaggagggagcagacactataatagcttagaaacctttaatgtgttcatgcaacaaataaatcaggtgggcatcccagcttgtgtgtgcctaatctcagttggtccacctgagacaacctgaacaccaaccctagtctcccatgcggccccttatccactccgacaagatgaaagaaacaatcacgaaccaggaaaaacttgccaaactgcaggcacaagtgtgcattggtgggaaaggacctgcttgca

SEQ ID NO: 58142 - DNA, 601 bp, Human
ctgacacccctctggcatgggcacttctctgagcctgtgatcccttcctctacgccctaccttagaagttctagattttctacttctagccttgtgaaccatccctcttccaaggtttcaggaatgcatctcatagcagatgggcagcatcaccaggggctttgccaatgtgttaaatcctgtgactatgacaataatctctttatgatacaaattggattctgtcctcaccccacccactgtgctggagcatcctagggcagcccccacaccctctcccacctcctgcagtccccagggkctgctgaggaagatcctcctcatccaggccttttcctgccacagcaggcctggctgctgacatgacaaggtcatgtgctgaccgatgtgggcagagcccaggtgggatatgttttgggaggacatgtggtttcatggctgcagggaccttcctcgccttgtactctagcaaaggagacactctagtctttaactagttgacatgacagtcctagctggggcacgtcttgctctgccagcccagcccctcaaaggccttcacttgcagtcaccataagggggaggaggggtctcaggttcc

SEQ ID NO: 58143 - DNA, 601 bp, Human
ttctcccagagccttctttatatgctgggtaaacaagagtcctccaggcttcccatgagcatagaggacggacattgttctggattttcacactgacacccctctggcatgggcacttctctgagcctgtgatcccttcctctacgccctaccttagaagttctagattttctacttctagccttgtgaaccatccctcttccaaggtttcaggaatgcatctcatagcagatgggcagcatcaccaggggctttgccaatgtgttaaatcctgtgactatgacaataatctctttatgayacaaattggattctgtcctcaccccacccactgtgctggagcatcctagggcagcccccacaccctctcccacctcctgcagtccccagggtctgctgaggaagatcctcctcatccaggccttttcctgccacagcaggcctggctgctgacatgacaaggtcatgtgctgaccgatgtgggcagagcccaggtgggatatgttttgggaggacatgtggtttcatggctgcagggaccttcctcgccttgtactctagcaaaggagacactctagtctttaactagttgacatgacag

SEQ ID NO: 58144 - DNA, 601 bp, Human
aaagacacctgcaccaatatgttcattacagtgctattctcaccagcaaggacagagaatcaatctaagtgcccaacaacagtaaattcaatgaaaaaaaatgtggtacatagatacgatggaaaactatgcagccatgaaacacaagaaaatcatgtccttttcagcaacatggatgcaactagaggctattatcctaagcaacctaatgcaagaacagaaaaccacatactgcatcttcccattggaaagtggcagctaaacattaaattcgcatgaaccacagatgctggagatcacyagaccggggagagaagaggggcacctgggctgaaaaacacacctgttgggtatcatgcttactgtctgggcgatgggatcattgggacaccaagcctcagcttctcaaattctacccatgtaacaaacctgtatatgtaccttgtattatataggttgaaattaaagatgaataaataaaataaaatgacacaaggccaaaaacaaatgggtttaactgaccagagcgagagaactctgcactatgaacccaaacccagctcaaaaagataaaatctagtcatttaagataatcataagt

SEQ ID NO: 58145 - DNA, 601 bp, Human
ctcgggatatacccacaggaaaagaattcattttatcaaaaagacacctgcaccaatatgttcattacagtgctattctcaccagcaaggacagagaatcaatctaagtgcccaacaacagtaaattcaatgaaaaaaaatgtggtacatagatacgatggaaaactatgcagccatgaaacacaagaaaatcatgtccttttcagcaacatggatgcaactagaggctattatcctaagcaacctaatgcaagaacagaaaaccacatactgcatcttcccattggaaagtggcagctamacattaaattcgcatgaaccacagatgctggagatcaccagaccggggagagaagaggggcacctgggctgaaaaacacacctgttgggtatcatgcttactgtctgggcgatgggatcattgggacaccaagcctcagcttctcaaattctacccatgtaacaaacctgtatatgtaccttgtattatataggttgaaattaaagatgaataaataaaataaaatgacacaaggccaaaaacaaatgggtttaactgaccagagcgagagaactctgcactatgaacccaaacccagct

SEQ ID NO: 58146 - DNA, 601 bp, Human
tcagagatggtggtgaggctgcagagcaaaagaaacagacactgttggtgggaaagcaaacttgttcagccactatggaaagcagtttggagatttctccaagaacttaaaatagaactaccattcaatcccgcaatcccactactcgggatatacccacaggaaaagaattcattttatcaaaaagacacctgcaccaatatgttcattacagtgctattctcaccagcaaggacagagaatcaatctaagtgcccaacaacagtaaattcaatgaaaaaaaatgtggtacatagatackatggaaaactatgcagccatgaaacacaagaaaatcatgtccttttcagcaacatggatgcaactagaggctattatcctaagcaacctaatgcaagaacagaaaaccacatactgcatcttcccattggaaagtggcagctaaacattaaattcgcatgaaccacagatgctggagatcaccagaccggggagagaagaggggcacctgggctgaaaaacacacctgttgggtatcatgcttactgtctgggcgatgggatcattgggacaccaagcctcagcttctcaaattctaccc

SEQ ID NO: 58147 - DNA, 601 bp, Human
aaagaagacctacaattggccaacaaacatgaaaaaatgctcagtatcactaatcatcagataagtgcaaatcaaaactgcaatgagttaccatctcttaccagtcacaaagtcagagatggtggtgaggctgcagagcaaaagaaacagacactgttggtgggaaagcaaacttgttcagccactatggaaagcagtttggagatttctccaagaacttaaaatagaactaccattcaatcccgcaatcccactactcgggatatacccacaggaaaagaattcattttatcaaaaagayacctgcaccaatatgttcattacagtgctattctcaccagcaaggacagagaatcaatctaagtgcccaacaacagtaaattcaatgaaaaaaaatgtggtacatagatacgatggaaaactatgcagccatgaaacacaagaaaatcatgtccttttcagcaacatggatgcaactagaggctattatcctaagcaacctaatgcaagaacagaaaaccacatactgcatcttcccattggaaagtggcagctaaacattaaattcgcatgaaccacagatgctggagatcaccagacc

SEQ ID NO: 58148 - DNA, 601 bp, Human
ctggcaaagatttcatgaagaagacactaaaaacaattgcaacaaaaacagaaattgacaaatggggcctcattaaactaaagagcttctgcacagaaaaagaaactagcaacacagtaaacagacagcctgtagaatggggaaaactatttgcaaactctgcatctgatgaaggtccaatatccagaatctacaaggaacttaaacaattcaacaagcaagaagaaaaaacccaattaaaattgggcaaaggcatgaacagacacttttcaaaagaagacctacaattggccaacaaacrtgaaaaaatgctcagtatcactaatcatcagataagtgcaaatcaaaactgcaatgagttaccatctcttaccagtcacaaagtcagagatggtggtgaggctgcagagcaaaagaaacagacactgttggtgggaaagcaaacttgttcagccactatggaaagcagtttggagatttctccaagaacttaaaatagaactaccattcaatcccgcaatcccactactcgggatatacccacaggaaaagaattcattttatcaaaaagacacctgcaccaatatgttcattacagtgc

SEQ ID NO: 58149 - DNA, 601 bp, Human
aaagactccctattcgaaaattagtgctggaatatctggccaaccatatgcagaagaatgaaactgaacccctacttctccccatatatgtaaaataattcaatatggatgaaagatttaaatataagtactaaaactgtaaaaatcctggaatataacctaagaaataccaatgtggacatagggcctggcaaagatttcatgaagaagacactaaaaacaattgcaacaaaaacagaaattgacaaatggggcctcattaaactaaagagcttctgcacagaaaaagaaactagcaacrcagtaaacagacagcctgtagaatggggaaaactatttgcaaactctgcatctgatgaaggtccaatatccagaatctacaaggaacttaaacaattcaacaagcaagaagaaaaaacccaattaaaattgggcaaaggcatgaacagacacttttcaaaagaagacctacaattggccaacaaacatgaaaaaatgctcagtatcactaatcatcagataagtgcaaatcaaaactgcaatgagttaccatctcttaccagtcacaaagtcagagatggtggtgaggctgcagagcaaa

SEQ ID NO: 58150 - DNA, 601 bp, Human
aggcggttgcactgaactgagatcatcccacttcactccagcctgggcaacagagtaagactcagtctcaagaaaaaaaaaaaaaaagacaaaaaaagtattaccaacttgtgccagccatgaggtctacaacctcgatgctgccaccctcaggaccctgggggttacaacctccactccagctcccctctgaacctgtgcttttcctctgagccccattcactcccacaactgtctcattcattcactggttcactcagcctccaaccacccttaaatcatgtcaggctcaccagctgayggagagaaaaatcatcctttgtaggtctgaaaaacgtgtctgaatcctgatggtgggtcttgttttcatttccaccccctcacagcacactcagggccatgaagaggccatggcctgggctcagagctccagctctcctcagggtgggcctggcatttgctgacttcagggagggtggcagggctcacaactgaaataggagacctgccctgggtccttagcatgtgcaaggatagggttctttgtagaatctgctcatttcatctgtgttcatagcatctgtcattttccacatgcgga

SEQ ID NO: 58151 - DNA, 601 bp, Human
tggccagtttcagtggctcacacctgtaatcccagcactatgggaggctgaggcaggtggatcacctgaggccaggagtttataagaccagcctagccaacatggtgagacctgtctctactaaaattgcaaaaattagttgggcacagtggcaggccctgtaatcctagctacttgggaggctgagttaaaagaatcgcttcaaccctggaggaggcggttgcactgaactgagatcatcccacttcactccagcctgggcaacagagtaagactcagtctcaagaaaaaaaaaaaaaaagacaaaaaaagtattaccaacttgtgccagccatgaggtctacaacctcgatgctgccaccctcaggaccctgggggttacaacctccactccagctcccctctgaacctgtgcttttcctctgagccccattcactcccacaactgtctcattcattcactggttcactcagcctccaaccacccttaaatcatgtcaggctcaccagctgacggagagaaaaatcatcctttgtaggtctgaaaaacgtgtctgaatcctgatggtgggtcttgttttcatttccaccccctcacagc

SEQ ID NO: 58152 - DNA, 601 bp, Human
ttgggcaggtgcatcctacactacagtgaatggtgctgggacaactggatgccacatgcagaagaatgagatgggccccttccttacagcacacacaaaaactagctctagatgaatggcagatgtccagctaagacatgaaactatgattgtctcagaagaaaatagagcagtaaatttttgtgaccctggatttggcaaatgcttaactactgtaggccagtagcaaaaatggcaaaataaaaggtagtttgatttcattttatgcaaatgtaaaacttttgtgcttcaaaaaggactycatttagaaggtaaaaagaaaacttgcagaatgagagaaaataattgaaaatcatgtatctggtaagggactgttattctgaacataaaagaactcttgcaactcaatattataaaatgaagtaacccaatttaaatatatgcaaggaatttgaatagacatttctccaaagtgagacaggtatactacacggtggtctcaaaagaataggaaattttaggcagcagtttcaggtgactagcaaaaggaatctgttgaaatatctgcagcagctctgggctggtaagttgctgagaaaca

SEQ ID NO: 58153 - DNA, 601 bp, Human
tggagctctggagaagtggcaaattcaggaccctcttttgtggggcatgagatatataggcaggatcatttctaccaaagaggctgtcactttggcttatcaatactttcatctccctaccccttccagatcacagtgggtgctttacttgtttttatggattattgtgtcaaccaagatgagaggtcagaatcaccctaaagatttgaaacttcttcaagatttgacaaatgcgcattttaatgcccctcctattttcaggaagctgtggctaaagaaaacattttattatatagcattscccaaattacttatacagaattttaaaaatctacataatgtcatacaaccatgtgaaaagtaaaactaaaatgccataactttttgggccagtagtggtggctcatgcctgtgatctcagaaccttgggaggccaatgctggaggatagcttgaagctaggagttggagatcagccgtggcaacatggtgagaccctgtctctacagaaaactttaaaaattaaccaggtgtagtagcatgtgactgtagtcccagcccctcaggaggctaaggtgggaggatgacttgagcctgagagt

SEQ ID NO: 58154 - DNA, 601 bp, Human
cccctgggcctaggggacctgcagcctccgcggccccacagaaagcaggaggagctgttcagcaacttgcagagacagccagagagtgcttcaaggactgcatggagctctggagaagtggcaaattcaggaccctcttttgtggggcatgagatatataggcaggatcatttctaccaaagaggctgtcactttggcttatcaatactttcatctccctaccccttccagatcacagtgggtgctttacttgtttttatggattattgtgtcaaccaagatgagaggtcagaatcacccyaaagatttgaaacttcttcaagatttgacaaatgcgcattttaatgcccctcctattttcaggaagctgtggctaaagaaaacattttattatatagcattgcccaaattacttatacagaattttaaaaatctacataatgtcatacaaccatgtgaaaagtaaaactaaaatgccataactttttgggccagtagtggtggctcatgcctgtgatctcagaaccttgggaggccaatgctggaggatagcttgaagctaggagttggagatcagccgtggcaacatggtgagaccctg

SEQ ID NO: 58155 - DNA, 601 bp, Human
cctcgattctaagtgacttgaggaccggacacatccatcacccacatgtaaacccagcacctagcacaatggttgccatactatggggtttaaaatgcatgggaggaatccaatcatcggactaccccagggctgctagtactcagacagggatccacataatttaagggattggacaaaggtcttcatttctgttctttccagcaccaacctccatggctccactcatccctactccttcatcctattaagattggctggtcaggagaggagtaggggcagaagcagctatacctggtcycctccacctcccatggtggtgggtgcacccttggtgggaccaggtgcgcaagacaacccctgggcctaggggacctgcagcctccgcggccccacagaaagcaggaggagctgttcagcaacttgcagagacagccagagagtgcttcaaggactgcatggagctctggagaagtggcaaattcaggaccctcttttgtggggcatgagatatataggcaggatcatttctaccaaagaggctgtcactttggcttatcaatactttcatctccctaccccttccagatcacagtgggtg

SEQ ID NO: 58156 - DNA, 601 bp, Human
cgtccactctcattggccacacgccagggaggaaagtttatttgattcttctcatctttccagggagtctttatgccgtttcaaacgaatataaatacatattctcaattcagacgcggatatttttgacccttgatgaaccctgtcaccctgtccttcaggaagcctgtaccagtttcccctccctctacggtggatgtttcaccatcctctgcccaagctgggtcatcacaatcacagacaagagtgtcgccagcattgccatcctatgacatgagatgctttaaaggtgcattacttygcacagcaattctgtgtctggaaatctattctacacaatgaaattgtgattcatgcaagcacagtttctgcagcatttcgcttctctaaaagtcactggagaccgtctggatcttcagacacagacactggttacttttgttgtgatgcagtcattctatgtaatgtgcagagataaaaaggaaaaaatctgtatgtgcaggtattgcaagatcttcaaagtgtgttattttgagatagaatctgtgttcagcagagtgcctatgggtttatatttgttttaaaaaccagaattgataca

SEQ ID NO: 58157 - DNA, 601 bp, Human
acgtctccacactgagccggtggcaaagtcgccgcgaggatgaaggaggaacctcgtgctcttcaccccaccaggccccgcatttcctgtctcctgccacggttccttgtcgcgaccggcgagtcctcccaggtcttcgaaaggccgttttgtccggaggctgtggacccggaggcccgggagcatcggcgggcagcgtggcacccactcggcggtctcaaccgggcaggacccgggtccggagctcgggcgaagcgggcgtcctgggaggagcgcgcagaacccggagaggacgcagcakggtgaaaactgaaaccgcatatgcgaactgtctccgaaagtcatctgcggttgaaatcagaaatcacctataatatcccctttgtgacaacaccgttgggtaaatatctagaaccggtgcctcgtcactgcagcagccccgcacgcagctgcccgggttcccctccccggaccctagtggcccccaacagatcaggcgggcccaccgtgtgaccgtccctgggactctcggccccactcttacttactacttcacctccacattttcacctgtttcagaatcaaaaccctgaaaagtcat

SEQ ID NO: 58158 - DNA, 601 bp, Human
ccaaccatcccaaggttttctctgcctcaagacgtccatgctcggggcccccagcccagtggagaaaccaggagccctggaccgcgagcggcggggtcggggaggcgacaacgggaagcccctgttggatcctgggcactcaggacctagtgcgccatgggcgccctcccgcagcagccccagggcaaggaggatgggggtcctcgtgggggccacactgtcggatccccagggatccgagcgggactgtgacgtctccacactgagccggtggcaaagtcgccgcgaggatgaaggaggracctcgtgctcttcaccccaccaggccccgcatttcctgtctcctgccacggttccttgtcgcgaccggcgagtcctcccaggtcttcgaaaggccgttttgtccggaggctgtggacccggaggcccgggagcatcggcgggcagcgtggcacccactcggcggtctcaaccgggcaggacccgggtccggagctcgggcgaagcgggcgtcctgggaggagcgcgcagaacccggagaggacgcagcagggtgaaaactgaaaccgcatatgcgaactgtctccgaaagtcatctgcg

SEQ ID NO: 58159 - DNA, 601 bp, Human
ccagaaaggtggcagccctaaacccccttgcacctgcctctctcttgagttcccctgcattccctttacatgagtgtgtactttcccttttacaaaaaaatctccgtcctttctctattttcctactggtcctagaattcatttccccaggcggtgtcaagagcccgacaccggctggggtcgaggtctcatcagagtttggggaccaccggttgcccactggcatcggaagaagaatgcaaatggcagtgagcccaggaaaaggtgctcagtgtccacagacctcagggaaatgccaacmgcacccacaaggggacgcctcaccccgctggaatgggtgaccccaaacactgtgaggctggagggggtggggcctgcgttccttacaaggcagagagcaggagactgagagttggtggagtgtagggctgttcctgtgtcatcctcttcccattttcctggcggaggtttctctttgttctctggccctacctgcttccttcctctccctttctctggttctccctcccgtccttcatttccaaccatcccaaggttttctctgcctcaagacgtccatgctcggggcccccagcccagt

SEQ ID NO: 58160 - DNA, 601 bp, Human
ctagaaaaataaactctagtcatttaaaataattataaggtgtatgatcataattttataaaaattgaagatgattctactaaaaccctaacattaaactgtgcataatggaatttcagatgatttccaccttgttctttattccttttttgttccattttcaagtgaccttttttgtttatcctcaggaactcattgctcccagctgtccccttctgtacccaccctctccttttccagggtccgccccagcccttcctctgacctgaaactatggcttccttggcactgaaggcacagkagctgcattcagcctcgggagagagtaggacaagggcaggtagtggaggtggtcttggcgcaaacgaatctaacagcgcccagtctccattgcagatggctgcatttctccacatgttatctacaagcaaaccaaacttacccctttcctgattggtttctcactctgcccaactcctacttgaaaattcatattcttccacctaacatttctttctacttcttgtcttcacaatatattctgatttattgtgcccaggaaacactggtctacaccacatcctaagttaccatctaaagt

SEQ ID NO: 58161 - DNA, 601 bp, Human
cggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggacccccccatcctcctcgccctggggctgctgcgggagggcgcccgggcagcactaggtcctgagtgtccagggtccggcaggggcttcccgttgtcgcctccctgaccccgccgcttgcggtccrgggctgctggtttctccgctggtctgggaggccctagcatggacgtcgtgaggcggagaaaaccttgggataggtggaaaagaaggattggagggagggcggcagaaagggagaggaaggaaacagggccggagaacaatgagaaacccccaccacgaaaatggggagagggggacacgcgcacagcccccacactccaccgactctccgtctcctgctctctgcccagtaaggaacacaggccccaccccctccaccctcactgtgtttgggatcagccatttcagcggggtgaggcgt

SEQ ID NO: 58162 - DNA, 601 bp, Human
gcggagacccacagtgggtgccccgctcccggacgatgcccctgggcttccagatccagagcctcgggacgaaactgtttcaggaagacccggaaggactcgccggtcgcggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggacccccccatcctcctygccctggggctgctgcgggagggcgcccgggcagcactaggtcctgagtgtccagggtccggcaggggcttcccgttgtcgcctccctgaccccgccgcttgcggtccagggctgctggtttctccgctggtctgggaggccctagcatggacgtcgtgaggcggagaaaaccttgggataggtggaaaagaaggattggagggagggcggcagaaagggagaggaaggaaacagggccggagaacaatgagaaacccccaccacgaaaatggggagagggggacacgcgcacagccccc

SEQ ID NO: 58163 - DNA, 601 bp, Human
tgctggctggcggagacccacagtgggtgccccgctcccggacgatgcccctgggcttccagatccagagcctcgggacgaaactgtttcaggaagacccggaaggactcgccggtcgcggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggacccccccatcctcctcgccctggggctgctgcgggagggcgcccgggcagcactaggtcctgagtgtccagggtccggcaggggcttcccgttgtcgcctccctgaccccgccgcttgcggtccagggctgctggtttctccgctggtctgggaggccctagcatggacgtcgtgaggcggagaaaaccttgggataggtggaaaagaaggattggagggagggcggcagaaagggagaggaaggaaacagggccggagaacaatgagaaacccccaccacgaaaatggggagagggggacacgcgc

SEQ ID NO: 58164 - DNA, 601 bp, Human
gggcctgagtgctggctggcggagacccacagtgggtgccccgctcccggacgatgcccctgggcttccagatccagagcctcgggacgaaactgtttcaggaagacccggaaggactcgccggtcgcggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgacagtgtggcccctgcgakgacccccccatcctcctcgccctggggctgctgcgggagggcgcccgggcagcactaggtcctgagtgtccagggtccggcaggggcttcccgttgtcgcctccctgaccccgccgcttgcggtccagggctgctggtttctccgctggtctgggaggccctagcatggacgtcgtgaggcggagaaaaccttgggataggtggaaaagaaggattggagggagggcggcagaaagggagaggaaggaaacagggccggagaacaatgagaaacccccaccacgaaaatggggagagggg

SEQ ID NO: 58165 - DNA, 601 bp, Human
cgctgtccccgagctccgggcctgagtgctggctggcggagacccacagtgggtgccccgctcccggacgatgcccctgggcttccagatccagagcctcgggacgaaactgtttcaggaagacccggaaggactcgccggtcgcggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgasagtgtggcccctgcgaggacccccccatcctcctcgccctggggctgctgcgggagggcgcccgggcagcactaggtcctgagtgtccagggtccggcaggggcttcccgttgtcgcctccctgaccccgccgcttgcggtccagggctgctggtttctccgctggtctgggaggccctagcatggacgtcgtgaggcggagaaaaccttgggataggtggaaaagaaggattggagggagggcggcagaaagggagaggaaggaaacagggccggagaacaatgagaaacccccaccac

SEQ ID NO: 58166 - DNA, 601 bp, Human
ccccagccactcaggcaatatcctcttttccccttctctctcagcctcttctcaccctagggctgtacccaaagctctgaatgagactgtccctgccccgccccatccactcctggtccagctcagcagtgaccttggaactccaggagcagctcagtacccctgtctccgagtcagctctgctccaggcagggccagaatctggagtgtgcaggaggccggatggcaggggcattgccccaggactgagccgtattctgagggttcccagagacctgacctcctacttgtatacagtctyttcagtcagcgtctgccttaaaggctgtgacccaggcaccttccctgggaattaactccagcattgtcctctgggtcgacacagtccttggcagcctctccttcctggggttacacccagttcctctgctcttctccagtggatggaatctccttctccttgacacacagcatctggagccaccaatctgctgccccactcaaatgtgaggaccgcacatgcctgagctcctgctgtctgcacaccacgcaccgtgggggttccttatgaccagagacacagtctgaaacagacctgaat

SEQ ID NO: 58167 - DNA, 601 bp, Human
gctcgcgcacttccccctgcttcagccagtcagactttgctggctgcctgcccgggaccagtcctgccaaaggcttctttccatgaccccctcatgtaatcatcaccgcaattttttcattttgtattaatccaatgtggataccgatgcacagaaaggtgaagaaaatgcacagaagtgttcagccgcgacagggtctccctgtcctcgcctgtacctgcgacacccgccttccctctccctgcgttgcagagtgctcccaacccaccgtcctgtgcgcagatccaagcccagtcccatmcccgcggcctcatcccaaatcccgagtggacgtggttatagcctgggctaggtttgtttgtttggttggttggtttttctttcttttcttttttttcttcgtgacagagtctcgctctgccgcccaggctggagtgcagcggcgcgatctgggttcgctgcaacctctgcctcgcgaattcaaacgattctcctgcttcagcctcccaagtagctgggaccacaggtgcgcgccaccaagcccggttaagttttgtattttggtggagacggggtttcaccatgttgcccaggctggctt

SEQ ID NO: 58168 - DNA, 601 bp, Human
tcccatcccccctgcacaggttctgtggggagcttggggtgtgtttgctggggtgtgtcctcaggcaagaggcagaaggtgtcacgtggtgtaagaggtcgcgagggccccttcatggatggggagacctctggggtgaccagctgggctgaggtggggagtaagaggatgttacctgggtggtggcagtggatggtgaggggagggtgggaagtgtctgctgagccgctgggtgcaggtgagtgtctacaggaaagtgcagggaaaaattcaagggcacgcagccctgggggtgctggarggtttgtgtggttgagagcgggtgagaacagagcaggctggtggctggtgggagtgtctgtgattgtgtccctgtgcaaccccacttcacccctgtcctgaccccagctcggattctgggggctctggtttctccttcccgagggcgggtgggactgccgggctgcactagggatccccgctccacgtcgccctctgcagccctctggcccctccactctccgggggttcctttccagcctcctctctgaccagctcctcccctcggaggataagtagcctctgggaacggacccggcgg

SEQ ID NO: 58169 - DNA, 601 bp, Human
atctggtcccccctatttgaaggttgccattgcctgctgttgctctgcaaagggacaggactggacactgagacagagaacccaaggcctgcaaagatcacagggcatccttcctccctttctagaaagggtttgctgacccctgtctacacactgactattctctatgacgctggcgccccagtaggaagaacaggcaggtctgggccccaagggcagaagtgggtgcctctactcaccagagttcccagggtcatcctggaggaaatggtgcttcccatcccccctgcacaggttctgwggggagcttggggtgtgtttgctggggtgtgtcctcaggcaagaggcagaaggtgtcacgtggtgtaagaggtcgcgagggccccttcatggatggggagacctctggggtgaccagctgggctgaggtggggagtaagaggatgttacctgggtggtggcagtggatggtgaggggagggtgggaagtgtctgctgagccgctgggtgcaggtgagtgtctacaggaaagtgcagggaaaaattcaagggcacgcagccctgggggtgctggaaggtttgtgtggttgagagcgggtga

SEQ ID NO: 58170 - DNA, 601 bp, Human
taactactcagctctgctgttgaagcgcaaaggcagccacaggcaatccatgaatgagcgaggctggacctgccttaagtgcccaatgacccaagaccccctaagatcctagaggtgcatgtggttccaatgtctaattggagaatcacaacatagattccatgtgaatgttcagaggcaaggcaacgccactcacagcaaggaaatctcaacattaaaaagtgtctcctgtagagtactgggccttggcagagatggggcctttagccatggaagggccgtgaccatccagcctcagagmtgcccattacgggtgggctcctcaccctctaggtcattaggaagagaggtctggcagtgagaagacacaggtggttctcctgggatgggcagaagtagggccacagggaaccgggaagctgcacaagcagttggccccgattcccaggacaccacgtggctgcacccccttaccctcagcttacacctcaggtttcagggaaggtcactgatggcccccgtggaccatagatgccactcagcagcaaaggaggggagagtagaccctgaaccatgggacccccactcccatcacatccac

SEQ ID NO: 58171 - DNA, 601 bp, Human
attagagaagtcacaatgccagctggagacctcagtcatacaaagctatgcccatggctcatagaacaaaggggtccaagatccagaagagatggaaacccaacctgaatagtgctggatttaaataattacaagaaacagagataaaacaaatgatggatgaccaggaggctgaaagtagccagtccttcaagaacaaggctgctttgcctaatttgcagaataaagccacttctcagaccgtgaacccatgactagaagaagacaccagtttccagtgaggaaggaccctttaaccccrcaacaagtgcaatgattctttgtgggcttctccaaacgtatttatggccactagagtttgctatgaagggcaattttgtaaacatgtaaaggtgtgcagggaatatattctccattgtaactactcagctctgctgttgaagcgcaaaggcagccacaggcaatccatgaatgagcgaggctggacctgccttaagtgcccaatgacccaagaccccctaagatcctagaggtgcatgtggttccaatgtctaattggagaatcacaacatagattccatgtgaatgttcagaggcaagg

SEQ ID NO: 58172 - DNA, 601 bp, Human
ctgaaggccagggttgggggtaggagatgctcttcctgaaatgggctcccagtagtaatgggatgaaaaatcccgaaataacagattccaggtggaggttgtcaactgtcaggaacaaggagggtgcaatgatggaaatgattagagaagtcacaatgccagctggagacctcagtcatacaaagctatgcccatggctcatagaacaaaggggtccaagatccagaagagatggaaacccaacctgaatagtgctggatttaaataattacaagaaacagagataaaacaaatgatggakgaccaggaggctgaaagtagccagtccttcaagaacaaggctgctttgcctaatttgcagaataaagccacttctcagaccgtgaacccatgactagaagaagacaccagtttccagtgaggaaggaccctttaaccccgcaacaagtgcaatgattctttgtgggcttctccaaacgtatttatggccactagagtttgctatgaagggcaattttgtaaacatgtaaaggtgtgcagggaatatattctccattgtaactactcagctctgctgttgaagcgcaaaggcagccacagg

SEQ ID NO: 58173 - DNA, 601 bp, Human
cacacctgaggcttcagggagggtccctgaatggcccctggggaccgttaatgctactcagcaacaaaggaggggagcagtaggccccgaaccatgggactccccctcacattcatcacatccacacctcccagaagccgcaggcagggtaggacacacttgtgactcttcaacttacacaacttagagatgacaccctaggggatggggcagcaattgccaggacacagcatgtgccctcatctggagtctgcaacctaggacagggtccatttcaggtttctcttttacttgcaggttkccattgcctgctgttgctctacaaagggacgggacttgacacagagacagagaactcacggccagcaaggaccaaagtgccttcagcctttcctttctagaaagggtttgctgactcctgtctgcttagtgactattctatatgacgctggtgtcacccatgtcttgaccccagctcgggttccgggggctctggtttctccttcccgaggacgagtggggctgcggggttgcaccagggatcccctccccacctcgccctctgcagctttttggcccctccaccctcctgcggttcttt

SEQ ID NO: 58174 - DNA, 601 bp, Human
ctcaccctttaggtcattaggaagataggccccacagtgagaagacacaggtgggtctcctgggatgggcaggagcagggccacagggaaccaagaagctgcacaagcagttggctctgatccccaggacaccacatggctacacccccccaccctcaggtcacacctgaggcttcagggagggtccctgaatggcccctggggaccgttaatgctactcagcaacaaaggaggggagcagtaggccccgaaccatgggactccccctcacattcatcacatccacacctcccagaagccrcaggcagggtaggacacacttgtgactcttcaacttacacaacttagagatgacaccctaggggatggggcagcaattgccaggacacagcatgtgccctcatctggagtctgcaacctaggacagggtccatttcaggtttctcttttacttgcaggttgccattgcctgctgttgctctacaaagggacgggacttgacacagagacagagaactcacggccagcaaggaccaaagtgccttcagcctttcctttctagaaagggtttgctgactcctgtctgcttagtgactattct

SEQ ID NO: 58175 - DNA, 601 bp, Human
acacactctgtgatgaggggtgtggctggacctgccactacagctatttgaccctggactccctaagatcccagaagcatgtgtggttggaaaaggtgctatgtggatttcatggctattcccaaccacagaatccaacagggtcccctagtgctcagaagcaaagctgtgccactcacagcagtgaaatcccctcatttaaaagtggctcctgctgtggtcctgggcccctgtggagatgggcctccagctatgggagggcagtgaccacacagcctcagagctgcccatcacagggtgkgctcctcaccctttaggtcattaggaagataggccccacagtgagaagacacaggtgggtctcctgggatgggcaggagcagggccacagggaaccaagaagctgcacaagcagttggctctgatccccaggacaccacatggctacacccccccaccctcaggtcacacctgaggcttcagggagggtccctgaatggcccctggggaccgttaatgctactcagcaacaaaggaggggagcagtaggccccgaaccatgggactccccctcacattcatcacatccacacctcccaga

SEQ ID NO: 58176 - DNA, 601 bp, Human
tcatactttcacacatgaaacttgcaaattaaatggaatcacagcaaacttcactcagacttactgtgaatattttctataatttacttttcaatcatcagcacttaaagtttggggtcataaccaaaataaggattgattttgttatcaagagcaacataagtaacatatctgaggaaaaattatgatgttaatcagttaatatggtatcatattaacctctacagaaactgtgaagttaagagcataattcttaactagtcacgagtctgaggccaacttctcaaagtagcctataagrcctgtccacaacacaaaacacagtttaacaccgttatcagcctctgcccaggtgtgctcagagaacctgcagaagaaatgtccacttccaacattattaaatagcacagcatttcataattactttcttttcttccagattctgggcaagttttatatattatatataattatagtcagaatacaacgatctgaggtaaacaaaaattaacgtatacagataagagccaaacaaatgtaagaaatttgtgggaaaaaacacacagcatttgatcagaaatgcaactttttttctttgtct

SEQ ID NO: 58177 - DNA, 601 bp, Human
ctgcatataggctaaatggatgctgagttattcagatgtctgctttccacatcagtctccattacctagcccagagctgctacgcactaaagtactcttgttgaatacttttgaaagcccactcagaattcctatttaattgctcagaataataattatataattcattacctagacctgtactaacagactagccactaactaaatgggctgttaaaattatagtggttactagaagcagagaaggatggcgggaaggggatagccaaaggttggttaactaacaccaaaatacagctasgtaggaggaatgaagtctagtgttctatacccctaaaaggtgactacaattaattacaatttattgcatattttcaaatacttagaagaaagaatgaattgtgaatgctcttaacacaaagaaatgttaaatgtttgaggtaatggatatgctaattaccctgatttgatcattacacattgtacacatctactgatgtatcacatgtatccacaaatatgtaaatcattatctgtcgattaaaataataaaagcaaaaaaatcttattacaggttattttaagctgctaacaagataac

SEQ ID NO: 58178 - DNA, 601 bp, Human
acagtggggagacaggaataaacttccttccaggtagccttggacttgggcccagacagaacaagagtagacatggggattcaatgacaccaacaccatccggaacatccttgaaaccatgcaattttaaatgcatctccaagtcacttaaaaaaaaaaaaaaaaaaaaaaaaaaaaacacaggttttgaatagccaaagcaattttaagaaaaagaacaaagctggaggcatctcattgcctgacctcaaattatactaaaagggtatagtaactaaaacagcatgatattcatataaaracagacacatagaacaatggaatggaatagagaagtcagaagtaaagtcacatatctacagtcaattgatctttttgacaaagttgacaaaaacatacactgaggaaaggacgcccttttcaatacatggtgctgggaaaattggatcgccccatgcggaagagtgaaactggacccttatctgtcaacatataaaaaaaaaaatcgactcaagatggattaaagacttaaaagtaatacctaaaacgattaaaatactaaaagaaaatatagggaaaactcttctggacattggtttag

SEQ ID NO: 58179 - DNA, 601 bp, Human
ggtggcctgtgacaaactgcagcagttctcaatgtaccattcctacagtccctgctgtggacaacgtggtgcctggcactgtgcacttccttgttcttccagaaataggtaaaaaacccagaaatcaccccaaatcagaataagggttattttataccactgtgcacagcagcacctttttagagtctagttttattctctttgctcctaaaacacactagcatctcatttaaataattcaggtagaggaacagctgttgaggagttaatgattagataaagaaacagagtatggtcattygaaaacactatttctgcaatgtgttaacattctgttaaaaagaatagccttgtaaggaactaggctgaagaataaaactatattaacatactccgaaggatgaaagagttcaggtaatgccccgagggccaaaccctgagagcaagactagaatcacccaaggtatctgattaaccataatttacaaacaaaaaaaagtaaaaaaaaataaaaaaataaaaacctatccactcaaatctgctataatgatttttttaatacatatcctgacgatgaatacttccgaatgaagtgccacac

SEQ ID NO: 58180 - DNA, 601 bp, Human
ccccactgccatcaccctggtgcaagccagcatccgagctctccccagacctctgtgatgaccagcatacctccctgctattccctcaatgtctattttctaagcagcagccaaagtaattttttcacagtgtagatctgattatgtctctcctctgcttaaatgcctccagtgatttccactgcctcttaaaatgaaatctcaacttcctgaaccacctgcaaggccccagctgacccgccagacccctctggtttcatctcctggcactcttgccccagatgctgtgcttcagccacaytagctttttcccttttccctattttctgagtatttcaagcccaggtctgcttttgaatttttaatgctagttattccttctgtctgaaatgccctttctctgaatcttctcactaccagtccctcctcatcctcattcaaagaccatctaaagtaaaggtagcttccccagtcacttgctctcacctcactttcactatattttctttacagaaagttaagttgctcattatttctccttactacactgtaaactacaatgagagcaggaccttatagattgtttactgctacattccta

SEQ ID NO: 58181 - DNA, 601 bp, Human
tgtgaagagaacctaaatgtggtgcaaagtatcattttattcaatcgcacccagtattattagcattaccaaatggggaaaaaagtgaactgaaatttcacacttctgcctttcacttccacgtgatttctgcatagcccttatcagtacacatacttgacagtagttagatttttaacaatactttatctaatctaaactccccttcatttagacattgaatctcagaattagaaaaagtacagtgatgactggtttcactaaattcatggccccaaatcttaaatgtatactcaacacwtttgctaaacccccttctttcccgcccattctctatctgatgaccttgcttcccatttcatttaagaacagacccactcaaacaggaaatctcccatgtttgcccaccatgtttccatctgtaccacacgtagcctcacctctatacggtggatgaaatgtgaacttgctagtggtccattcccatgccctcactttcaaaacatttcctttgcaattatacgcttaccagaatttctctgttgcagtgtaaaatggaaccctttctttgatcctctttctactttcatagcagagtctg

SEQ ID NO: 58182 - DNA, 601 bp, Human
tctaattacaggttaccttacttacagcatcttctctttaggtttcttttgtaaaatcagataattgtactgacacaatttcaaaagttgcaaatgtagtgtgaagagaacctaaatgtggtgcaaagtatcattttattcaatcgcacccagtattattagcattaccaaatggggaaaaaagtgaactgaaatttcacacttctgcctttcacttccacgtgatttctgcatagcccttatcagtacacatacttgacagtagttagatttttaacaatactttatctaatctaaactmcccttcatttagacattgaatctcagaattagaaaaagtacagtgatgactggtttcactaaattcatggccccaaatcttaaatgtatactcaacacatttgctaaacccccttctttcccgcccattctctatctgatgaccttgcttcccatttcatttaagaacagacccactcaaacaggaaatctcccatgtttgcccaccatgtttccatctgtaccacacgtagcctcacctctatacggtggatgaaatgtgaacttgctagtggtccattcccatgccctcactttcaaa

SEQ ID NO: 58183 - DNA, 601 bp, Human
tgagaagcaccggggactctgctggagaaggtgggaaaaggagacacggaacagattcaggaggccatgggctgccgaccctactcaaaaaccaggtggggaacaccttggaaagaggtgtctgtgcatcttggggccgatgaagtgattgggatgacatcagggatggagcgggaagccctcctacaccaggctaggggctgagaggcagaggaggaaagaaacagtccctcagtgcagcacagcacagcacagcacagcacagcacagcacagcacagcacagcacagcacagcacagcagagagaatagagcccttgagcagagaaatgggcacttccctctccctccacaggaatctcctgccaggaaaatcaaactcattccattgaaaaacaaaaaaaaatgggtagagtaaccacacaaaagactattttaaaatgtggaaaagaacagtaaaactccctaaaagaactcacagcaggagaacatgttgccacaaagtgaatatggtaaaaattataccccaaaatacccacaggattaaaagaaaaaaaaaaaactcaatgaagtaatcacagtttaaaggaagatcacaaaa

SEQ ID NO: 58184 - DNA, 601 bp, Human
ggagttgaacaatgagaacacatggacacagggaggggaacatcacacaccagggcctgtcaggggatgaggggcaggggagggagagcattaggacaaatacctaatgcatgtgggacttaaaacctagatgatgggttagtaggtgcagcaaaccaccatggcacatgtatacctatgtaacaaccctgcacgttctgcacatgtatcccagagcttaaagtgaaataaataaaataaaaaccatttcaaaggaaaaaacctttaaatatatgatagattctgtaatgtacagaatatrtgtaaatatgtatagatttttacatataaaatatgtagaatttataatatatcatctctctcattcctgatattagtaatttgtttcttctatttttttcatgttcagtctggttagacgtttatcagttctattgatctcaaagaaatagcttttggtttcattgattttttttctcccttcgatttccactatgatttgtatttcctttgttctgctgactttgcaatttcggttgttttttctaaatttcttagggtgaaaactgacgtcatgatttgagacctgtcttcttttcta

SEQ ID NO: 58185 - DNA, 601 bp, Human
gtcttgctctgtcatgcccagcctggagtgcagtggcgtgacctcagcttactggaacctcctgctgccagttcaagcgattctcctgcctcagtctcccaagtagctgggattacaggtgcccaccaccatgcccagctaattttttgtacttttagtagagacagagtttcaccatattggccaggcttgtcttgaactcccgacatcaggtgattcgtcagcctcagcctcccaaagtgctgggattacaggcatgaaccactggacccagcctagtagtgttctcttcttttactgkctttatctggtttcaatataaggattatgctgacctgctaaaacgaattcttcaattttttggaacagtttgtgtacaattagttaaatatttgatagattacattagtgaagatatttgagtctggttctttgtgagaaggttttaagttgtaatttcaatttcttgatatagagctaggcaggttactgacttctttttgagtgaactttgataatttgtgtctatcaaggaatttatccatttcatctaagatgtcaactttattgtcataaagttgtttataatactctcttaatt

SEQ ID NO: 58186 - DNA, 601 bp, Human
cttttttaaattgtagattccatcagattttctacatagacatttatgtctgtgaatacaaatggttttaattctttttttcctaatgtgaagtccttttatttgtttatattatccatctgcactagatggatcctctagtacaattctgaatagaagtggtgagggcaagacatccctgtcttgttcctgatcttataaaggaaagcattctgtctttcaccattaagtgtgacactctgtaagttttcatagatgatcttttgtcaggttaaagagctcacttctactcctagtttagtgagaatttttgttaggaatggaagtagaatttgtcaaatgctttttctgcatctattgagatgattatataggttttctttttaagtttgttaacataatgaacaatatttattgctctttcagtattaaaccaaccctgaattcctgggatatactccacttgttacatccttttaaaatattggtgatttgattagttaaattttgtttaaattttctgcatttatgtcatgagatgaaatggatgtgtagtgtttttttctgggttttttttttttttttttttgagacagagtct

SEQ ID NO: 58187 - DNA, 601 bp, Human
tgccctacaagtctttgtatgggcatatatttaatttttgtgtgtggataaatagaagtagaacggctggatagtatgacaggtgttacatttagctttcttaaatcagtcaaactattttacaaagtgatgccactttacacttccacctgcagtgtatgaaaacttctgttcctctacatcctctccagcacttggtatgctccgtcttttaaattttgccaaataggttaatagtggtatccgtgcttttaatttgtattttcctaataactaatgatgttgaacatctttttatgtsctatttgtcatctgtatatcttctttgttgaagtgtctgttcaaataacaatattgtcttctgatccatgatcaaggtatatcttcccaattatataagctttctttaatttcagcaatattttgtactgttcagtgttcaagtgtttcacttatattgccttctaagtatttcataatgtttgatgttattgtaaatgccagctttttaaatttcaaatttttattttgattgctcattgccagtatagagaaatacaatttatttttgtacattgatcagatacttactaaattgact

SEQ ID NO: 58188 - DNA, 601 bp, Human
agtttccttgttgtagtttgcaatttcctccctcctgcatatctgttccttcctccctccatcaccaagcaatcactaatatgctttctgttgctttctgtattttgcattttctaaagttttatataaatgtaatcacagagtatttattcgtttttgaaaaaggatggtgtctggcttaagttagcctaattattttatgattcatccatgctgtgtatatcaatagtgcattccttttattgctgagtattccactgtatgatacaacactattgatggacatttgtgttgtttcccrtttttgtccattacaaataaagctcctataagtatatgccctacaagtctttgtatgggcatatatttaatttttgtgtgtggataaatagaagtagaacggctggatagtatgacaggtgttacatttagctttcttaaatcagtcaaactattttacaaagtgatgccactttacacttccacctgcagtgtatgaaaacttctgttcctctacatcctctccagcacttggtatgctccgtcttttaaattttgccaaataggttaatagtggtatccgtgcttttaatttgtattt

SEQ ID NO: 58189 - DNA, 601 bp, Human
aaccgagaacaatataggtaggcaccgtgtactggatatagtaagcgctcaacagagtctgttgttctcttgaaggtcagaaatgaataataggaatattcttattaacgttttttatttaaatgccactttattgaggtacaactgacaaagcgcataaactatagttttacaagtttggacatatgtgtacatctgtaaaaccatcatcacacttaagacagttattagattcttcaccctcaaaagtttccttgttgtagtttgcaatttcctccctcctgcatatctgttccttccyccctccatcaccaagcaatcactaatatgctttctgttgctttctgtattttgcattttctaaagttttatataaatgtaatcacagagtatttattcgtttttgaaaaaggatggtgtctggcttaagttagcctaattattttatgattcatccatgctgtgtatatcaatagtgcattccttttattgctgagtattccactgtatgatacaacactattgatggacatttgtgttgtttcccgtttttgtccattacaaataaagctcctataagtatatgccctacaagtctttg

SEQ ID NO: 58190 - DNA, 601 bp, Human
aaggtatggatagtaggatatgtggttcacaggatcttctgcgacaccccaattgaccatgttcaaaaatgcttgagaaaaataagcttagagaaagggagataagaggtttctagtcagatgacaagcagtatggtgatctggaaaaataaataatcctcctactttctcccaagtccagtctgtaggatttcacttcattatctagccttaggtgctatgaatttataggacagtcatcttctattttgattggcataggtccaattaaagaaaaaaactcatgaaacaagccgcagtytttccaaccataaaaagaattaagaataaacagtttcttgaagaaaagttcatctaatgcatacaggtaggattaaatcaacatgtgtctctacgagaatacaaagaaaaaattatttttgcattatctacaattttgaactatctgtaccactactcacttccacagacgtgacttcaaagagtatgttacatttttcataacagaaaaataataccatttcctacacatccgaaaaagatgcactactgggtcatcaaaaacaaaacagtgtcccgtttctggctcttctacagcaat

SEQ ID NO: 58191 - DNA, 601 bp, Human
agcactctatcatgttattactctctggtttttggccatctcctaagttcttccccttctagaaggtatggatagtaggatatgtggttcacaggatcttctgcgacaccccaattgaccatgttcaaaaatgcttgagaaaaataagcttagagaaagggagataagaggtttctagtcagatgacaagcagtatggtgatctggaaaaataaataatcctcctactttctcccaagtccagtctgtaggatttcacttcattatctagccttaggtgctatgaatttataggacagtcmtcttctattttgattggcataggtccaattaaagaaaaaaactcatgaaacaagccgcagtctttccaaccataaaaagaattaagaataaacagtttcttgaagaaaagttcatctaatgcatacaggtaggattaaatcaacatgtgtctctacgagaatacaaagaaaaaattatttttgcattatctacaattttgaactatctgtaccactactcacttccacagacgtgacttcaaagagtatgttacatttttcataacagaaaaataataccatttcctacacatccgaaaa

SEQ ID NO: 58192 - DNA, 601 bp, Human
ctccctccatccacctcccaaagacaacaaaatctgcagatgctcaagtttctaatataaaatggcatagtatttgcatataacctatgcacatcctcctggaaatcacctctacacaacttacaatacctaatatataataaatgctatgtaaattgttatagtgtactgtgttttatttttaaaatttttctgaatatttttgttccatggttagttgaatccatgcagaatccatggaaaaggagggcctactgcagtcactgcattaagtctatctagtaaaatatttaacaatgtyacaaaatttccattgaacatgcatgtacactgagttgaagttctttgattctcagaatatgctattcacccatcataggtgctggcttgagtacctcattttcatctgctgctcttatactaatttagaaacaaaacactttttcattgttttggatgagcatttttatagcatatttgctgcaaaaatattgttagcactctatcatgttattactctctggtttttggccatctcctaagttcttccccttctagaaggtatggatagtaggatatgtggttcacaggatcttctgcg

SEQ ID NO: 58193 - DNA, 601 bp, Human
attaatctgtagataactggcatacttctgcaaagtgcttttctttgtagcctcaagtacaaatgagaaacagactttttatgctgcttccaccctttactgaatgacccaaaggttaccagctttagcttcaactcccaaaaagaaaagaccatccagcgagttcaagtggtggtataagcagatctacaacttggctttaatgacccagctgatgcaatggtacatcaagcctgtgcaatttcagggcaccgaagaaaactagtagcaaatcccaataggaaaaacacaggggtccctyagaatgttggagcaaaaccttccttttgagacttgttctggccttgctactgagccctggatagaataaacaatggtacaaggtaaccaagtgactctagctgttcaccatgaattgtatcttgttggtacagcctttctacattttgctctacgtatgtcagtcagcctatccctcaccccaactcctgaagcacttgttcagtgaaataataaactagcaatggctgtcagaacaaaagccacatatagactcaacaatatggatttcctcttactcagactgacatgaccatgggta

SEQ ID NO: 58194 - DNA, 601 bp, Human
gaaggaagaaatcattggaagcccctggggacccactctaataaaaaaataaaaccaagggcattatctattccctgggaattactcagaaatgccaccatcaaggacagaaagagcagggagtggacatgcctctcattcccatttaaccggcctatctggagaatgcagaaggctaatgctcatgataactagcaaaagcttattcaggtggtgactccaactgcactgttcctcaaaatgtgatggatttactacaacagagcatcacaatctctagcaacctgtatatacctgcttmtatggcaaatactttttgctctaccctaaaggacagagaacatgagaaaggatttgctatcaatgggatgggacatcagcgagccttcacaggcttatctcacggttatgcacactgtctatctttgtactacaatttcgttgtcaaggatacggatcatctcctcctacaggacactacattagtccaatacactggttacgtctgcttttaggaccagaaaagcaggaggcaacatgtactcttagatgcctgcaaagcataagtaagccagcaggtagaaaataaatccatgaaaat

SEQ ID NO: 58195 - DNA, 601 bp, Human
aaaactaaaatccacagaggaaaatattgacaaatttgactacataaaataacttggttaaatgttatacaaaaaatgtgtacatatatcacaagtatatatgtaagtgtgtgttcatatacacacaggagacagtaactgcaggttatgatgaggaaagaggttaaactacaatggtaattatttttggtaacagaacaacagcccagtaaaaaatggacaaaggttataatcttgcaatttacaaaaggcaaatgtgtacataacaaaacttcaacttcactgataattaaacttttaygtttctgattggtaaaaattatgaaaagcagttgagaatataattacaatcaaaggccttaaaaacaaaaggtaaagactacataatatataagaaagagggagcaatagtcaataactataaataatttagaaaatgtcagacaatccagtagaaaaatgggccaagacacgtgtatatctatataacaaacatgcacgttctgtacatgtatcccagaacttaaagtataataaaaaaaaagaaaaatgggccaagaataggaactttaatattcatgaataaactgaatagcaaaaa

SEQ ID NO: 58196 - DNA, 601 bp, Human
ttagtaacaaaaattttcaagaggaaattgtgtgagaatgttaacttgtgaaaatgcacttatgacccaaaaatactatcttcttccttatcccatcaggatattattaagtaaatacaagggcacacagactttaacactactagcataaaaattgtgaggaaataagtaacaattacatatttcattagaatataatataaataagttattgttaataaatgagaggaatagaattacaaaaaatcatttttcaattatccatgtaataactgatttcagcaaggtcatcaaaaaatgytaaaatcacaggacattcatacaacttaaattaccaccacacagatgacattaattacaaaagatataactttatcatatataaatctgttgtctgaaaacaaatgaccaaatttagcagtgagaatggaaaaaactgacattatgaaccttgtggcatgctgcagcgagaaagccacaatatgatctgaggatttttcttgccaaaatatttaacatgaatctaatcacaaaaagaaattagaccagtctagactgtgggacaatctacgagataacttgcctgggcatttaaagacgt

SEQ ID NO: 58197 - DNA, 601 bp, Human
atagtatgtcaaatactgtgcatatttaacttgaggcaaaagacccattatgctggatttctcacctcaggttttcacgctgctaaaaactagcttattattttgaggctattttaaagtaattctttttcaggcaaataaagccttatacttttagctaagtaataacttccactaaataagcagggaaataaatatgtgcccccaggacacctcacatcttgaatgagcctgcatgttccacgcagtcagccccggaaggccaggaaataattactcaggaagcattttctgagaactwacttaattatgggtcagggcaaatgcatggaaataatttttgctttattgaaccacaggatactacctgagcaattaaatatagttttgtgttctgtgaactaatctcaaacagaattatttttgatttcctttctagcataatttcctttctagcgtaacagttcaaagatcctacagtgcactgggtttttttcacattcaatacatcaacaatgtgtcttaaagcttgatacctgttcactgggggtggtgggcagagatccaaactctttaatgtacttatctgtttctttggcaa

SEQ ID NO: 58198 - DNA, 601 bp, Human
aagccaactagaatctagctgtgaagttcaactgaatttgcggtagttggctctttatttaaccctgaagttttcacttactccccaattacagggccttacagattaactctcagtaacattctgatagtatgtcaaatactgtgcatatttaacttgaggcaaaagacccattatgctggatttctcacctcaggttttcacgctgctaaaaactagcttattattttgaggctattttaaagtaattctttttcaggcaaataaagccttatacttttagctaagtaataacttccaytaaataagcagggaaataaatatgtgcccccaggacacctcacatcttgaatgagcctgcatgttccacgcagtcagccccggaaggccaggaaataattactcaggaagcattttctgagaactaacttaattatgggtcagggcaaatgcatggaaataatttttgctttattgaaccacaggatactacctgagcaattaaatatagttttgtgttctgtgaactaatctcaaacagaattatttttgatttcctttctagcataatttcctttctagcgtaacagttcaaagatcc

SEQ ID NO: 58199 - DNA, 601 bp, Human
gacagacatttatctctacactggtattttctcaatactaaggtggtccatagatggcttgatataacaataataatttttaaaaagctgcagtaggagggagtatgatccctcgtcctagcacaaacagtaaggacaatattatttttttaaaaaaggaattattccaactcatacattacaaatgctaccaaactgatacattaattttctttctctgggccagacatggtggctcacatctataatcctagtactttaggaggccaaggcaggcagatcacttgagaccaggagtttkagaacagcctggccaacatggtgaaaccctttctctgctaaaagtacaaaaaattagccaggtggggtgacacgtgcctgtaatcccagctactcagcaagctgaggcacaagaatcgcttgaagctgggaggcggaggttgcagtgagccgagattccaccaccgcactccagcctgggtgacagagggagactgtctcaaaaagaaaacaaaatttttctgtctcatgcattctcccagcattacctaagcatcttgagaacaaactcactaagaccagagcagcagcccaagtctac

SEQ ID NO: 58200 - DNA, 601 bp, Human
ccttataaaaggtcttactcatgcaggtatgatgtgtatcatgtgctctgggaagacatccagactcttggacagacatttatctctacactggtattttctcaatactaaggtggtccatagatggcttgatataacaataataatttttaaaaagctgcagtaggagggagtatgatccctcgtcctagcacaaacagtaaggacaatattatttttttaaaaaaggaattattccaactcatacattacaaatgctaccaaactgatacattaattttctttctctgggccagacatkgtggctcacatctataatcctagtactttaggaggccaaggcaggcagatcacttgagaccaggagtttgagaacagcctggccaacatggtgaaaccctttctctgctaaaagtacaaaaaattagccaggtggggtgacacgtgcctgtaatcccagctactcagcaagctgaggcacaagaatcgcttgaagctgggaggcggaggttgcagtgagccgagattccaccaccgcactccagcctgggtgacagagggagactgtctcaaaaagaaaacaaaatttttctgtctcatg

SEQ ID NO: 58201 - DNA, 601 bp, Human
taacataaagaattcatcccacaagtgcctggcacatggaaggtcttcaataaattgtagccattgttagctattattagccttctttctaggaactaagtaggttccataagaactatgacttaatacatcctttagatctctttgatgtcataaacatagtaaagagaaataaaattctttgaaggccttataaaaggtcttactcatgcaggtatgatgtgtatcatgtgctctgggaagacatccagactcttggacagacatttatctctacactggtattttctcaatactaagstggtccatagatggcttgatataacaataataatttttaaaaagctgcagtaggagggagtatgatccctcgtcctagcacaaacagtaaggacaatattatttttttaaaaaaggaattattccaactcatacattacaaatgctaccaaactgatacattaattttctttctctgggccagacatggtggctcacatctataatcctagtactttaggaggccaaggcaggcagatcacttgagaccaggagtttgagaacagcctggccaacatggtgaaaccctttctctgctaaa

SEQ ID NO: 58202 - DNA, 601 bp, Human
cccttaaattaactctttctttcacactcatacccagccagtcagtaaatcttttcggctgtccacttaaaaaatatctgaaatccatgaacttctcaccatccctctagttccatcctaatccaagccaacaagattgagcatctggatgactgcaatagccttttaggtgacctccttgcttttggtctttttccagcagccaagtgagtctttcgaaactgaagcagggttatagcactcttctgctcaactcctccttggcttctcattcgtttgtaaaaactgaaatcttcctacmtgacatcatcccctgcacttggacatgatctccatctccttcttgctcattaaaaatgtcaggtatgcttctgcctcaaggcctttgtactcgctgttctctctgcctggaacactttctcttacttgctcccttaaatctaccaagggttcactaaaatgttacctatcagtaagtacctatcatacctaactaccctgtgtcaagcagcaacaatttccacccctagcagtcccatccctctaccctggccttattttctccatagcacttatcaccatttacttgcttttctcgcct

SEQ ID NO: 58203 - DNA, 601 bp, Human
tgccatcttaaaaacaagcaaaccaaaaacctctcatttattccacatccatttttgcagctatgactgcattctctgtttcacttcccctctttactccttgaaagagttatctatacttggtatccaccactgttctcctcccattctctcttgagcctacttttatcatgctttcacctacactatttcaccaacacagctcgtattgaggtcacctatgccctacacactgttaaatccagtagtcaaatcttaatcctcatttttcttggcctaacagcagcacttgaaacagctgaccatctattgttctggaagcactttttttcacttcccttctaggacgatgcattcatttggatttcctccatatcactggctattccttagtctttttatttgttcttcttcaactgtctgggctctaaatcagaggttaagaagctttttctgcaaagagccagaaaatgaataagctttgtgggttgtatgatctctgttacaagtattcagctaccccttcactgtgcaaaagcaaccataaaccatacataaatgaatacatgtagtttgaagacactgttctaaacatttagag

SEQ ID NO: 58204 - DNA, 601 bp, Human
aaagtactgtcaccctgacattatcaaatcagtgtcagcacaagagatgtctcagtgtcaaactccacagcttggactatgtcaagaccaatgcacaagagatcaactctcttctttctactgctgaagattttgttcatcatgataaaaactggtaccttgacttttcaaagaatattatgtcctcagagggaaacaaacagaaaaacccaaatgctaaaacttgatcccttaatcattatgttagtcattaatgtttctcaatttcttttccctctatgtctttgtaaatggaatgtamtttaagttactggagcataatacctatgctctacttagtttgtgttctgtaatggccgactcagtagcaagcatgtgacaatgtttatttaaggtaaatacagagtgctgaaggccatttactctgtggtcatcaacatacttctgtgctaaaatctagccctcaccgagggcccatgaagccttctcaattggtggcagtttttcttcccaccctccaggggcctggaggtggaacgggtgtcattttgaagcatgagaccctttgcccttgtctcttcctccctaccagctctcagct

SEQ ID NO: 58205 - DNA, 601 bp, Human
gtaacaaatcactaaatttcattcaaggtaagattaaatatggtcattattcaaaggttaatagtagtatatcataaagttgaatttttttaagctggctttaagaattatagtatacacctatactatttttcaggtgatccaaacaatataagagcatttgtataacagaaccttaatcatcttcattacagagcaactccagctctacctggcaacccctgaaaagtactgtcaccctgacattatcaaatcagtgtcagcacaagagatgtctcagtgtcaaactccacagcttggwctatgtcaagaccaatgcacaagagatcaactctcttctttctactgctgaagattttgttcatcatgataaaaactggtaccttgacttttcaaagaatattatgtcctcagagggaaacaaacagaaaaacccaaatgctaaaacttgatcccttaatcattatgttagtcattaatgtttctcaatttcttttccctctatgtctttgtaaatggaatgtactttaagttactggagcataatacctatgctctacttagtttgtgttctgtaatggccgactcagtagcaagcatg

SEQ ID NO: 58206 - DNA, 601 bp, Human
attatttacttatcactgaatatgcagtaatttgtccagtaaaagatggactgtgaaataaaggcaacttctaaggttagtgagaaaaacaaaaagcaattgaaaatgtctgagaaggtgacaatatcttagatattttataagaagttaacagcggctgggcatggtggctcccatctgtaatctcagcactttgggagactgagatgggtggatcgcttgagcccaggagttccagaccagcctgggcaacacagcaaaactctatctctacaaaaaatacaaaaattagccaggcgtrggggtacacactattcgggaggctgaggcaagagaatgtcttcagccaggaggcagaggttgcagtgaggcaagatgacaccactgcactccagcctgggcatcggagccagactctgtgtcaaaaaaaaagttaataaggtcaagaaaatgataattatgaatgatagcaacaaaggaatggagttttaaaaaggaaatcaaatgctacatggtatttaggggtttccaaagagcctggccttatccaatttgaacatcaaaggtctgcatattgtatgatgtattaatagttgatagt

SEQ ID NO: 58207 - DNA, 601 bp, Human
ttccacaaggaagaggaagagtaaaacttggcagaatatccacatttcccccaaatccaaaagcaaaataaaataccatgtgaacctagtcactgatggatcctgttaagtttcagcagttatatgctaacagctccagaagacttctggcatttgcaggggtgtgtgtgtgtgtgtgtgtgtgtgtgtgtgtgtgttttcaattattcgtgagggatacctaaagtccatgacacagtgatatagtgatattaatttcactgagctgcatatctgaatgacatggacaaagataataaamaggagtgactgtcagtgaatacaactggttataactcagcaatctccatagcttcattattatttacttatcactgaatatgcagtaatttgtccagtaaaagatggactgtgaaataaaggcaacttctaaggttagtgagaaaaacaaaaagcaattgaaaatgtctgagaaggtgacaatatcttagatattttataagaagttaacagcggctgggcatggtggctcccatctgtaatctcagcactttgggagactgagatgggtggatcgcttgagcccaggagttccagacca

SEQ ID NO: 58208 - DNA, 601 bp, Human
atggccatctcgtcccgcttcgggagctgggggaattaagcctaggggcagcttccagtcctggggtgtagcttgggacatgtgctttttcctgtaggcttggccttccacaaggaagaggaagagtaaaacttggcagaatatccacatttcccccaaatccaaaagcaaaataaaataccatgtgaacctagtcactgatggatcctgttaagtttcagcagttatatgctaacagctccagaagacttctggcatttgcaggggtgtgtgtgtgtgtgtgtgtgtgtgtgtgtgtgttttttcaattattcgtgagggatacctaaagtccatgacacagtgatatagtgatattaatttcactgagctgcatatctgaatgacatggacaaagataataaacaggagtgactgtcagtgaatacaactggttataactcagcaatctccatagcttcattattatttacttatcactgaatatgcagtaatttgtccagtaaaagatggactgtgaaataaaggcaacttctaaggttagtgagaaaaacaaaaagcaattgaaaatgtctgagaaggtgacaatatcttagatatt

SEQ ID NO: 58209 - DNA, 601 bp, Human
ataagggaaggtaaataatggcccacaaaaccagatgatatggttaagataactagtttagtggaataacaaactggggtcttaagaatccaaacgcaataggtattggtattggttgttcatactcttcttccaaattatgttaaacatttttagtaactacactttcccccgtaaacatcagacttaaatagaccatatgtaaaaacaacctatccttagtaattttactaggcaatctacagcaaaagcttaatatatacacagaaagagtatcaaataaactagaaaagtattcacygacttcagggtaaaaaagatcttaaaagaaaaccaacaaaaaaatgaaagacactttgtgctgttgtgaaccagaaaaatacaacccatgtatagaccttaattattttacattattgagaatattttccctgctgaagcaaatcaaaattaaatttgagaattttaattgaagtaacacacatctaggtgtgtcacagtgacagggagatgcaaacagaatacacacacctttaaatttacgaattcccaaaactaagtcaagcagggtaaataaattataaatgaaaggcatatgcaa

SEQ ID NO: 58210 - DNA, 601 bp, Human
taggtaaaatcgatgacaccctaaaataaaaacctggagtgaactggtgctccagaaagatgctgaatggccacagtgcatgtggtgatgtctccatgctgaggtttcaggcagcacagcactaagtatcaggtgacctgtggtcccaccagagcatagtcctcatgaaataggcctaaccagataccttttaactcatctttattttggttgcaaagatgtggtttacttagctacttactatttgttcccatttgaagtctcagagcttgccaagttaaacaccgccttcagtaccgarctgctatacaagaacattataaaatacaaagtataaactaagataatcctctttacagaattcagattagtgcattaaaacaacattgatttaaaaagggaagtgagataactggcaaacctccaattgcttttttaatgaaggatgacacaaaatggcacgcaaggtaaacactaaattttgtcaggtgctcaaaaacagttaattgtgggaaagttactttccaaaagtaattttgacctaaaaatattaaccattattctataagacataagggaaggtaaataatggcccacaaaa

SEQ ID NO: 58211 - DNA, 601 bp, Human
ccagcctgggcaacatgatgaaacccatctctacaaaagatacaaaaattagctgggtatggtagcatgcgtctatgtcccagctacttgggaggctgacatgggaggttcagctgagccagggaaagttaaggctgcagtgaactgtgattgtgccactgcacttcagcttgggtgacacggtgagaccctttattgttgaaattgctatttagctactgaactgaaagtgcaaactcgtattcttctttcccttccctacttcaatacctttttcccccaaccccgccccccccccaaraacttccccaaataatgggcttccaaatggaaaaggccccaaaagcatcctgacaattgtcgtcaaagagctctgggatatgtcttctagaaaggagctgcaattatagaattccttttgttttcagattaaacctcagcacacttttcataaagctgcagaaacagattgaactaattgcaacctggggttgggattaggagaggcccagcactatgatcctcagctacactgttttaatttagcaggataaatagaagagttgcgttgccttgcctttcagaggcaatcatgttgcag

SEQ ID NO: 58212 - DNA, 601 bp, Human
gcttgtgcctaggtactgagccaaactgaggaaaacagcaagagggaaaaacaagtattattctctacatgtgtcagtaggtatgttaaatattagatgcctttccttggttgtaaatgaagttttgaactgaagtgtagacttccaccgagatgtgttgacttggagatgtatttaaatatccttcttgtttcttggtgtgattttacagtcatgtaattctcaactacattgcaatacatttctccagttagctcctcaaaagcattttttttgtgttgtttgtgaccttctgctatayttatgaatacatatatctgtgtatctgtgtatgtgtaaagggcttgcgtatgggtggtggtcactgaagactactttcatgtttcagtgaaagagttctttaaaaaaacatatatctatatctatatctatatatctatatctatatctatatctatatctatatctatatctatatctatatctatatctatatatatgtagagagtccgtttggctcaagtttgaggactgcaacccaggagcatagattcaagttgccctgagtagatgctcctattagcagcagttacaaatgggt

SEQ ID NO: 58213 - DNA, 601 bp, Human
aatgaccaacatggtgaaaccccttcaaaaaaagggtgaaacctctttttttgtaaaaatacaaaaaaaattagcagggcatggtagtacatgcctgtagtgccaaccacttgggaggctgaggcaggagaatcgcttgaacctgggaggcggaggttgcagtgagccgagattgcaccattacactccagcctaggtgacagagcaagactctgtctcaaaaaaaaaaaagggatgttgtaagttaagcatgatgctatgtagcaaaattgatgggtgtgcagacatgacttaaccctcyccttgcatacccttaaggtcttgtttataacttggtgtcttattgccacagagacgttttcgcggtcttatttctattgtaacattaatgctggtcaattgttacgcctcaactccaaaagggagggagtagaattaagtgcgtttgacctctcttcctattttgactgagagctcagtttttgaggtttctctggggtctccttggcagagagtgggtccactcagttggtcgagggctttggattttatttttagtttacaacttttcaggagagctggttcgtagtctccttcatcc

SEQ ID NO: 58214 - DNA, 601 bp, Human
gcttccttttccttcccttatgatccattatcttaactctagaatatggaaggaagaatgttcaagctaagtctctgctcttaatcagacttggagttgacattgctcctttggtttataaaatttgttatctgtccagccatagttgaacattttaatttcagaataaccagagcatcttaagaggccagagaagtgttctctgtgtcccttatggtatttgtttcacatgttctaataaaatacataaaggattcctaggaacccaagactgttgtttttactattaggcagaggatartacctgacactcaatgtcagcttttaattgcttgaatgaatgtactgcattttttgttagactgagccacactttgatttggaaaaggggaagatgggaagactaaatacacaagcagggacccatagggtctgtgatggtcaggaatccacatagagatgacacttgggtataaattcaggggtaagattaaaactgggatataattttatttgggtatagggagatggaggagatagtgaaggaacagaagtacccaactaaggtgaaggtgcctaagaagaaggcagacggggcctc

SEQ ID NO: 58215 - DNA, 601 bp, Human
gaggctcagtcagggattcagtcaggtttccatgcagacattattgtgcataaaaaccacctgggaagtgttaaagacagagattcctaggctccaatctcagtgattatgatttaatagatttggaatggacccaaagaatcctcactttttaacaagcacctcaagttattcagatgtaggtggttgatttactctacttctagcaacaatgggctaaatttataggcaaaagccacaccattagtacataatagactatgatggtaactggaaggacttttatctacagatttttatyacggactaatagctaatgccatcccattcatttgctaaatgttatatcctattcatcaagcttggcctgctgttgggtttccaactctcctttgcctgcttcagtataacaatgtgtaattagaacctaagaaatttctggtgtggtgatgctaaagcttgcctctatattgagatatatatgtgtctttggtagttcagtgatgagattttcctgggtggaagccaaaattagtgcactttattagtgtgaagtcaacaatcagctgtttctgggagcttccaaagtaggtatactttt

SEQ ID NO: 58216 - DNA, 601 bp, Human
cccatgtctatctctctctctctctcaatctctctctgtctctctttctttctctctctccatacacacacacacacacacacacacacacacacgtgtgtatgtacatatctccatattttatatatatgtataatatgcataagaaaatcattttggaggaagtaaattgtcacagcgaattgtcacaagtgtttctcatttatggattgaccattttctcaccgtatttcaggactttgcacagacttagctggcaaacatcctataacaggtgtgatttgagagtcttaaaaaaaaatcactatcttggttttcaggtgaatatttttgagaaactagcttgttcctaaagatgtgtttcccgatccccctcctgcttagaaagctttttttgacgttagcaagcatctgggggatcttgatgctctcttatggttagagagagagaattgaaaagaaactcagtagattaagacattatttgccctttcactgtgttgacttttacaccgtggtattaaaggagtgatggcaccttagcagacgtcattgcaatgacaccaattgtacaagtagtcatgcacttgcaataaaaaaa

SEQ ID NO: 58217 - DNA, 601 bp, Human
ctctccatacacacacacacacacacacacacacacacacgtgtgtatgtacatatctccatattttatatatatgtataatatgcataagaaaatcattttggaggaagtaaattgtcacagcgaattgtcacaagtgtttctcatttatggattgaccattttctcaccgtatttcaggactttgcacagacttagctggcaaacatcctataacaggtgtgatttgagagtcttaaaaaaaaatcactatcttggttttcaggtgaatatttttgagaaactagcttgttcctaaagrtgtgtttcccgatccccctcctgcttagaaagctttttttgacgttagcaagcatctgggggatcttgatgctctcttatggttagagagagagaattgaaaagaaactcagtagattaagacattatttgccctttcactgtgttgacttttacaccgtggtattaaaggagtgatggcaccttagcagacgtcattgcaatgacaccaattgtacaagtagtcatgcacttgcaataaaaaaaaagccatttcactaaaaagaacaccttagatgttttattgcttagatgaagcaat

SEQ ID NO: 58218 - DNA, 601 bp, Human
gacgtcattgcaatgacaccaattgtacaagtagtcatgcacttgcaataaaaaaaaagccatttcactaaaaagaacaccttagatgttttattgcttagatgaagcaataaaaatgtccttgatgaggctggtcgcggtggctcacatttgtaatccttgcactttgggaggccgaggcgggtggatcacgaggtcaggagatcgagaccatcctggctaacacggtgaaatgccgtctctactaaaaatacagaaaaaattagccgggcatggtggtgggcgcctgtagtcccagctmcttgggaggctgaggcaggagaatggcatggacccaggaggcggaggttgcagtgagccgagatcgtgccactgcactccagcctgggtgacacagcgagactctgtctcaaaaaaaaaaaaatgtccttgatgaagcagatttaataatctgaaacctagattacctgtctttttgatattctatgtgacacaattggaagtatgcatgtagcatatctgctgcatactgaagtactgttttctagaggaaaagcagctgtgcggttgtttaagttgcaagctgaactaattttttttc

SEQ ID NO: 58219 - DNA, 601 bp, Human
gatgaggctggtcgcggtggctcacatttgtaatccttgcactttgggaggccgaggcgggtggatcacgaggtcaggagatcgagaccatcctggctaacacggtgaaatgccgtctctactaaaaatacagaaaaaattagccgggcatggtggtgggcgcctgtagtcccagctccttgggaggctgaggcaggagaatggcatggacccaggaggcggaggttgcagtgagccgagatcgtgccactgcactccagcctgggtgacacagcgagactctgtctcaaaaaaaaaaaagtgtccttgatgaagcagatttaataatctgaaacctagattacctgtctttttgatattctatgtgacacaattggaagtatgcatgtagcatatctgctgcatactgaagtactgttttctagaggaaaagcagctgtgcggttgtttaagttgcaagctgaactaattttttttcaaagaacaccatttttatttgaaagaactgacaagctttttatttagacttatttatttgacatattttctcaaaaatgagtgatgttagcttgtcccttcaaggaaaacctatgaagctatc

SEQ ID NO: 58220 - DNA, 601 bp, Human
catactgaagtactgttttctagaggaaaagcagctgtgcggttgtttaagttgcaagctgaactaattttttttcaaagaacaccatttttatttgaaagaactgacaagctttttatttagacttatttatttgacatattttctcaaaaatgagtgatgttagcttgtcccttcaaggaaaacctatgaagctatcagctgtctatgataaaatctgagcttccaagcaaaaattagaattttgaaaaacttgtatttgccatttgagtgtaacagcttcctgatccttacacaaaaytgatgaagatagcgaggaatgtggttttttttcatgttgtttaatgacatgcgttaacatttggaagaatgatagaacttagtgaaccaatattttccaaaggatgagtggatgatgttacaaaattatgcattggtataatttccattcaaagtgcaagatagactaatggattttaatgtaacagtatgtaaagttcagtaataccttttccatttttatgccataatttacttctttcaaaagacaaatataagataaaaattaattcaagagcacagatatatgcattctatcgaa

SEQ ID NO: 58221 - DNA, 601 bp, Human
acaaaaaagataatgagacaaacgtgcatttgtggaactgcatgtcagtcagccagttccctgcagagggaattcccagcattacctcattcatctgtgagaacacagagcagtccctatttagacacacacatttgtctactgctccagcatggccagccccccacttcttgatggtttctttctgctatgaatatgcatgtccagttgtctgcttcatagagcagacatttaccttcctcatccaccagccattggaggaggactggggccacgcaaatgattgattcgaccaattctytggggagagtttcccagtggccctcttccatcatcatatctggaatcagatgagtttccatagcttcttttttttttttttcgcatcttgctgaagcagagttttgaaaagcaaaaccacaaactcagctgttccccataagaaatctgttatcaaagataatctccatggagactgactccagctgtccagcacttgtccatttgcgatgtaaaccatcttgccccccttccctgcttcggagcgactggtcatagtttaagagattactacttttagaattttggtgtggttttaaag

SEQ ID NO: 58222 - DNA, 601 bp, Human
ttacctcattcatctgtgagaacacagagcagtccctatttagacacacacatttgtctactgctccagcatggccagccccccacttcttgatggtttctttctgctatgaatatgcatgtccagttgtctgcttcatagagcagacatttaccttcctcatccaccagccattggaggaggactggggccacgcaaatgattgattcgaccaattctctggggagagtttcccagtggccctcttccatcatcatatctggaatcagatgagtttccatagcttcttttttttttttttcgcatcttgctgaagcagagttttgaaaagcaaaaccacaaactcagctgttccccataagaaatctgttatcaaagataatctccatggagactgactccagctgtccagcacttgtccatttgcgatgtaaaccatcttgccccccttccctgcttcggagcgactggtcatagtttaagagattactacttttagaattttggtgtggttttaaagaagaatgtccataatcatctgaaaaggcatcttagggttgttagtaacttttagaagtataatgggatcctgataagaaaa

SEQ ID NO: 58223 - DNA, 601 bp, Human
tatgcatgtccagttgtctgcttcatagagcagacatttaccttcctcatccaccagccattggaggaggactggggccacgcaaatgattgattcgaccaattctctggggagagtttcccagtggccctcttccatcatcatatctggaatcagatgagtttccatagcttcttttttttttttttcgcatcttgctgaagcagagttttgaaaagcaaaaccacaaactcagctgttccccataagaaatctgttatcaaagataatctccatggagactgactccagctgtccagcrcttgtccatttgcgatgtaaaccatcttgccccccttccctgcttcggagcgactggtcatagtttaagagattactacttttagaattttggtgtggttttaaagaagaatgtccataatcatctgaaaaggcatcttagggttgttagtaacttttagaagtataatgggatcctgataagaaaaatttcgtgaatatatttacaaatatttaggaaataggtgtacatccagtaatattttcagtaatatttttcagaactaggggatgtgagggcgatctggctgtgacttctatc

SEQ ID NO: 58224 - DNA, 601 bp, Human
ctagtttttctaaaataatagcttctctgcattatgtttctgctcagaatttttctgggactgccacagcacacaatgagaaaatatatactcctaagccgagactagtttttatttcccacacgcgggataacagtagacgttaatcaatgtagggctcaccatgaatagtttcatccattcgtagcagtgctgagtctgtgacatatgtgttcagtcatttatgagttaatatttgtcaaccacttagagtagacccttgctggtagtaagtgctatgtgtgtttgttaaatacatacrtatctatttgtgtttactatttgtccggccctatgctaaagacttatctcctttaatgggtacagttctgtgaggtaggagggagcaaatctgttggcttgggagtgtctggcctagctcccatacctcagtgggactcagtatcctatatgatgtatagtacatgcaatattatgtgcatactttgtattaaggagattgtagggctcagatatgtttcagtcaactgctgctgtgatggcactttgcccatttagagagtcaaaaaaggactgaagatgcatatctctcttcagcatt

SEQ ID NO: 58225 - DNA, 601 bp, Human
aatcccagctactcgggaggctgaggcaccagaattgcttgaacccgggaggtggaggttgcagtgagctgagatggcgccactgcactccagcctgggtgacagagcgagactgtgtctcaaaaaaaaaacaaacaaacaaaagcaattgaaagcaattggaaatcactgaaatatttttctgtttggtttcttttttatttttgttcttagtgacaagttctgatttacttttggaaaaatcattttataatagctttagtggcacaaacaaatcaacgggaccctgaaaactataatrgctttagtgacactaacaaatcaaagggagcctgaaaatagaagagcacactgtctttttgttgttgttgttgttaattgaccacttcgtaactttttttattcctgctagattttgagtccgtagatgtgttcactccaggatgataaccactagctacatgtggctatttaaattaaaatttcatctaattaaactttaatgaagcaaaaagtttatttcctcaatcactcttgccacatccgtagtgctatgcaatggcgcacggctagtcactttcatattgacagtacagatctg

SEQ ID NO: 58226 - DNA, 601 bp, Human
aaagcaattgaaagcaattggaaatcactgaaatatttttctgtttggtttcttttttatttttgttcttagtgacaagttctgatttacttttggaaaaatcattttataatagctttagtggcacaaacaaatcaacgggaccctgaaaactataatagctttagtgacactaacaaatcaaagggagcctgaaaatagaagagcacactgtctttttgttgttgttgttgttaattgaccacttcgtaactttttttattcctgctagattttgagtccgtagatgtgttcactccargatgataaccactagctacatgtggctatttaaattaaaatttcatctaattaaactttaatgaagcaaaaagtttatttcctcaatcactcttgccacatccgtagtgctatgcaatggcgcacggctagtcactttcatattgacagtacagatctgtggaacatttttagcatcttaaaaacttcacttggatagcatgtaaaaattgtgatattatagtttttaaaaaataccttgatagttctccaattaacaatgatgaaaatgtacatagtacttgttcaagaaacatttact

SEQ ID NO: 58227 - DNA, 601 bp, Human
gagtctcttcattaggtcaacatttgtctaagcacgtctgtaaatattctgttacaggaagaggaagagtattgagcaaattctcttcaacaatcagacagctctgctttagggactgatatccttccagttcaggaggaagtgtttccaggtaatttccaatgaactccagatgagtaaggtttgacagctgacccacatgaggggacaaattcatcaagctacttttccccaaaggtaaacattgcagctttttgcactgaaacagcccatctggtagcatctcactgttgttgttggytacagcacagtactgcaaattactcagatactggatttcttctggaatgaaggtcaagtggttatagcttagattcaaataatgtagtttgctgcataggaaaagctgctagggcagattctcaatattaataggaccccaaaagagctgctctaggttagataatgccccagtttatccaggaatgtaagtaatgttattgtgccataagtttaagcaggaaagattctgaagatgctgacagccaatgatctcttccacagttttaaggttattttcctttaggtctaactcatgcaa

SEQ ID NO: 58228 - DNA, 601 bp, Human
gctctgctttagggactgatatccttccagttcaggaggaagtgtttccaggtaatttccaatgaactccagatgagtaaggtttgacagctgacccacatgaggggacaaattcatcaagctacttttccccaaaggtaaacattgcagctttttgcactgaaacagcccatctggtagcatctcactgttgttgttggttacagcacagtactgcaaattactcagatactggatttcttctggaatgaaggtcaagtggttatagcttagattcaaataatgtagtttgctgcatagsaaaagctgctagggcagattctcaatattaataggaccccaaaagagctgctctaggttagataatgccccagtttatccaggaatgtaagtaatgttattgtgccataagtttaagcaggaaagattctgaagatgctgacagccaatgatctcttccacagttttaaggttattttcctttaggtctaactcatgcaaattattcaggctgaaaatggagtatggaatgcattccaggtcacagctgatcagttctaggcttttcttattgaccatcattttcaagttgttcagcaca

SEQ ID NO: 58229 - DNA, 601 bp, Human
attcatcaagctacttttccccaaaggtaaacattgcagctttttgcactgaaacagcccatctggtagcatctcactgttgttgttggttacagcacagtactgcaaattactcagatactggatttcttctggaatgaaggtcaagtggttatagcttagattcaaataatgtagtttgctgcataggaaaagctgctagggcagattctcaatattaataggaccccaaaagagctgctctaggttagataatgccccagtttatccaggaatgtaagtaatgttattgtgccataastttaagcaggaaagattctgaagatgctgacagccaatgatctcttccacagttttaaggttattttcctttaggtctaactcatgcaaattattcaggctgaaaatggagtatggaatgcattccaggtcacagctgatcagttctaggcttttcttattgaccatcattttcaagttgttcagcacagccagtttgcttccctcattatcaagggacaattcttcagtgaaggcaagaggtctgcaatgacttgtgggatctgggagaggctactctgcaagtagagggtccttggat

SEQ ID NO: 58230 - DNA, 601 bp, Human
ggaatctatgtcagttgaacaccctgaggacgaaagcaaaatcttggactcggagagtttcagaggcctcactgactgctcggccactgtttctgacagggtgcaggtggtccgtggagaatcgaagcacttataaaggatggccacaaaatgctcaagcttggagctggtacctggggtagtgaagccataagttgctgcaggctgcaaagaacagtgtgtgcaagagcaccaggtaggggaagaacgttgcaaaccaatggagctgtttctcgtaacagacagcgttgatgtaggagtmctgctgtcagtggaggtcgttctggattccgagtgggatcggaaactgatgtcccgggattagaggatgtgtttatgctggctttcaggatgttccaaggcatggtgcaatgattgtcaaattccactttgtaagaagacagcacagaaccctgctctgtgtcagctggagagctccagccagcatgtccacatgatcagcatgatgtaataccagaagacatcctaccatgattttaagatgtgataagatgactgggtgtctgctagtaaacattttagctcggttagtgtaatcatg

SEQ ID NO: 58231 - DNA, 601 bp, Human
gactcggagagtttcagaggcctcactgactgctcggccactgtttctgacagggtgcaggtggtccgtggagaatcgaagcacttataaaggatggccacaaaatgctcaagcttggagctggtacctggggtagtgaagccataagttgctgcaggctgcaaagaacagtgtgtgcaagagcaccaggtaggggaagaacgttgcaaaccaatggagctgtttctcgtaacagacagcgttgatgtaggagtcctgctgtcagtggaggtcgttctggattccgagtgggatcggaaastgatgtcccgggattagaggatgtgtttatgctggctttcaggatgttccaaggcatggtgcaatgattgtcaaattccactttgtaagaagacagcacagaaccctgctctgtgtcagctggagagctccagccagcatgtccacatgatcagcatgatgtaataccagaagacatcctaccatgattttaagatgtgataagatgactgggtgtctgctagtaaacattttagctcggttagtgtaatcatgactttcccttgtaggaggacagaaatataatgaaaaaatattaaat

SEQ ID NO: 58232 - DNA, 601 bp, Human
aaaacagcaaataaattacagaaacttaactgcacattatgttctttccaccctttgtttttcatctctgacccactatctgcataggcaagattcttgcctaggcaggaaaaactatgttttttggataagattcatgaggcttttccttgcagtccatctgttgggtcctctgcctgagggcagaaagagctgttctgcaccattaataaaactgctttcctccctttcctatcttatgagctgaactaaactttacaattcttttctaaagtaatttaatactacttttatttaacgrcatatctttcttgatagttgctgcaaaagagaccaactattttcaggattgggggacaatttttcttttctttttttaaaccaactgaagaaagatctaattaaaatatgtttttgcatcaaagggatttgagaattagaaaacaagataaccctcaaaatggagagttctttgcctatattaaatttagtttagattgtgccttgggatgtctgtctgtctatctatccatccatccatgtatttatctgtcttggtctgattatttactgtttgagtccaattagaaaaacaaagctc

SEQ ID NO: 58233 - DNA, 601 bp, Human
agtaacttaatcaaaataatttaatataggaaacaaataccaaaagtgttagaagagctaacggtcaaacagggaatggtaggacccttaggcaaccctgagaagagtaacagaaggaagccgctaccacctggagagcaggaagggcaaaagaaaaaggtgatgaaaccagagcttgggagctagggcttcgctgtagcagctgggaccctgggcagatgcagccactgcaggggtcccacccggagcagggaggacaaggtagatacattctgatttctcctttcctcccaccctccartgttctctttcctgttggcctctcctggtctgatgcttggagtctgggagtctgggaagtgtagtagtcaaagttacttctctgagttggcggatcaaaagaaaaggcagtaacacaacttgggtttcttgggaaacagactattagatggaaatgagcatgcctgggatttcattagagtatgttcttgagatcagcacctgtggaaggcaagacaaggaattggggtcatacagaggatgactgtgagctgcagtgctcattgggtgtgatgctctttggaggctgtgcacctgtgga

SEQ ID NO: 58234 - DNA, 601 bp, Human
aacggtcaaacagggaatggtaggacccttaggcaaccctgagaagagtaacagaaggaagccgctaccacctggagagcaggaagggcaaaagaaaaaggtgatgaaaccagagcttgggagctagggcttcgctgtagcagctgggaccctgggcagatgcagccactgcaggggtcccacccggagcagggaggacaaggtagatacattctgatttctcctttcctcccaccctccaatgttctctttcctgttggcctctcctggtctgatgcttggagtctgggagtctgggaartgtagtagtcaaagttacttctctgagttggcggatcaaaagaaaaggcagtaacacaacttgggtttcttgggaaacagactattagatggaaatgagcatgcctgggatttcattagagtatgttcttgagatcagcacctgtggaaggcaagacaaggaattggggtcatacagaggatgactgtgagctgcagtgctcattgggtgtgatgctctttggaggctgtgcacctgtggaaggcaacgcaagaaagtagggctgtgcagagggtgaaggtgagctgcaatgctcagtgg

SEQ ID NO: 58235 - DNA, 601 bp, Human
caggaataccacattacactgagttgtcaggcctccttaggcttttcttggcgaagcgtctcagactttccttgtttttgatgaccttgacagttttaaagagtatgagtcatgtattttgtggaatgtccttcaactgggatttgtctaatgtttttctcatgattatacttgactgacgtatttttgggaagcacatgacagatggtaaagtgccattcttaactcatcatttcaagagtatctgctattaatgctattaataggtcttgtcattgatgatgttaaccttgactacccrgctgaggtagtctttttcaggtttctttgctgtaaagatactcttttttgtccctttccatactgtacctttggtagagagttacattccacctccttgatggtggagtatctgcataaattatttggaattcttctgaattggaaatttgttctcccccttatatttatttattcagtctttttcagtatggagtcattaatgtctattttatactttgaattataacccagtactctgtttttcatgtttttgcttaacttgttccagccatggccacttggcagttaatttctgtga

SEQ ID NO: 58236 - DNA, 601 bp, Human
ttaaccttgactacccggctgaggtagtctttttcaggtttctttgctgtaaagatactcttttttgtccctttccatactgtacctttggtagagagttacattccacctccttgatggtggagtatctgcataaattatttggaattcttctgaattggaaatttgttctcccccttatatttatttattcagtctttttcagtatggagtcattaatgtctattttatactttgaattataacccagtactctgtttttcatgtttttgcttaacttgttccagccatggccacttgkcagttaatttctgtgaccctttgacgtgtgtgtgtttgtaagtgtttagcacttccttactttctggccctacaggatgttccaggcttttaggttctcttgacttgtttttttttttccttacagatttcttaatattatataaccataaaactagtgtgtataatcaaaagtcagtttctccaccctgcaaattaggagtggacttacataaacctttgtgcctgaactctgtgcatttcccagaggtgggcatcacaccacccatgcctccattgcactatatgtgtggattagttt

SEQ ID NO: 58237 - DNA, 601 bp, Human
cctccttgatggtggagtatctgcataaattatttggaattcttctgaattggaaatttgttctcccccttatatttatttattcagtctttttcagtatggagtcattaatgtctattttatactttgaattataacccagtactctgtttttcatgtttttgcttaacttgttccagccatggccacttggcagttaatttctgtgaccctttgacgtgtgtgtgtttgtaagtgtttagcacttccttactttctggccctacaggatgttccaggcttttaggttctcttgacttgyttttttttttccttacagatttcttaatattatataaccataaaactagtgtgtataatcaaaagtcagtttctccaccctgcaaattaggagtggacttacataaacctttgtgcctgaactctgtgcatttcccagaggtgggcatcacaccacccatgcctccattgcactatatgtgtggattagttttcagacatctccctttctccaatgaagtgataaataaccaggttattccctcagaatgaagctggccagatgtgcactttaccttgggaatgatttaggcataagatc

SEQ ID NO: 58238 - DNA, 601 bp, Human
atgatttaggcataagatctgggagaaggagaaaggcaagcatgcttcctcaggtgggcagggagccatcttggtttgtgtgaccaacttgataaattcatctctgttcagcacctggtcatcagctctgtaaactcaaaaatctctcatagtttttggtgtgtcaggagtccacgaaaggcttgactggacctgtgtgaatcagggtctttcatgcagctgcagttagatggtgacttagagttggaacagcaagggctggggcatttaggggctggccaggcatctttctgtctcttcwtgcagtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctccatgatttataaacagaaatttaggttatttgcaagtttttgcaattccaaacactgctacaataaatatctctgtgtgcatatctttgtgtgcttat

SEQ ID NO: 58239 - DNA, 601 bp, Human
caataaatatctctgtgtgcatatctttgtgtgcttatgtgattatttctagcagataatagaaatggaattgcaagagtggtaaatatgcacactttgaatttaggtagattcattgaaatgaccttttagaaaggaacttacacttctgtgaaggcagtgtgaaagaatctatttctccttatgtgcttgtcagagcttgtgattatcagtctttttaatgtttgttcattttgttgggtaggaaagggactcattgatttgtagttctttgattttttttaatgaaaatgaatgtttyatatttttattagctattttctttaaatagttggtttattacttttggtatttttaaaaattggattttttttctacttgatttttataccctattatctattgtcatgtaccaaaaatgtcttatccttgttcccccatcccaatgtggtggatttttgtttttttggctttacaggaatttccaatttttatgaactcaaatgtatcaacttttccattatcatttttggattttgtgtcatacttgtaaagcaaaattgtaaaaatatttgctcatcttttcttctggtgattttat

SEQ ID NO: 58240 - DNA, 601 bp, Human
aaagcaaaattgtaaaaatatttgctcatcttttcttctggtgattttattttatacctttaaacatttgctccatttgccattgtattttgttatcaggaaagagagagaaattttgtttactaagcacttcaagatcttttttctcaatagattgcttttcttaagatgctgaagtaaatcagtacaatagataaagaccacaaaaacagcattttgcgacagtgacagtcctactgaagacaggagacagttaaaaccatcagaccaagaacagaggagtggatatttaataattctrtgattacttctgggggttaactatctgtgaatctaaatagaagttccagtggctggaggctgtatctgaggagggaccctttagccttttaaagagtgattctgctgtgcagttgaggtgttttctgtcactctccttattgatgaaatgcttgtgtctcaagatacaatgacggtctacaagtcatggagtgaaggtgaacatgaaagctcaatgaaaccattactttatactatgagatggatgttttattctttgacctttaacttcagagagaaatgacctgtgaaagcacttggt

SEQ ID NO: 58241 - DNA, 601 bp, Human
gctgtatctgaggagggaccctttagccttttaaagagtgattctgctgtgcagttgaggtgttttctgtcactctccttattgatgaaatgcttgtgtctcaagatacaatgacggtctacaagtcatggagtgaaggtgaacatgaaagctcaatgaaaccattactttatactatgagatggatgttttattctttgacctttaacttcagagagaaatgacctgtgaaagcacttggtgagatcttagtaaagaagtgatttgcccactgaggcagaagttataggtgctggttaarttttatctttttctttgaaaatgtttggtacttattgaaacaaaaatgaatgagcatgacagaagaggagaataattgccctagaaatatcagctgtctggagggcttgcagaaacccaggaaagatttcaaatataaagggcctgctgcaggtgagtttctggccccttttctgctttgcctggggaagtaaggctcctgggctggtgttacaggagcatctcaagacaagcttctcattctaatagcctgtgttcaaccaagaatcttatgcatgtacatatttgaggtaatagtctt

SEQ ID NO: 58242 - DNA, 601 bp, Human
tatgaggatgtagggcattctgctctaagacaattatcatagtagatgttcccaggcatcacataggcaggcattaatatttaatctttagtgtcttctaccatgtctcttttgctcttaaatcattgagttaattttattcattttatttttcatttctagaaattttatttttttactttctagatcttttttaaaataatatactgttttctgttactattatctatcttgccttatttcttattttgaacagtatttgaataaatgacaattcaagaactcatgaaagacaccaatytttagattcaggtagcttattgaatcttaagtagaatagataaaataaatatatgttgacaacagaataacattgtagaacacaaagttgaaaataaaaaagtttaaagctattagagaaaataagacagattcacttcaaaaggatgatagtctgatgactggattctcagtggtgatgattaaagcataaggtagtgtaatgatatcatcactgtgccaaaagaaaataattgccaaactggaatttgcatatccagtagaaatatctttcaaaaacaagaataaaccaaagacatgt

SEQ ID NO: 58243 - DNA, 601 bp, Human
gttattataaacaactttataaccatatgtttgaaaaggtaggtgaaatgaaaaattacaagaaaaaatacaacttatcaaaattactcaagaacaattagaaaatctaagtaattctctagcccatgaagagattgaaccacaaattaataaacttcttacacagatttttctaggcccagatatgttctccactgagttcttctaaacctccaaggagaaacgaactctaatcttaccatccttacagcctagtttatgaagttagcatggcctttcacttgaagatctttttactgtygttgtcctggaattttgcagtgatgtgaatcggtatgagccttcttctatgatttattattttggatacttgatattaggactctttgatgtgaagttttgtatatgtctttttgaatcccattgaatatacttaataagatgtctttttatttctattttttttttctattcccctctcccctttaccgttctgtgttgatcttagacttttgtcttaggcttacctccaatgactggtgaatcatggtggttcatttatatttaaggatgagagattaggtagatttcatggagcttt

SEQ ID NO: 58244 - DNA, 601 bp, Human
aggactctttgatgtgaagttttgtatatgtctttttgaatcccattgaatatacttaataagatgtctttttatttctattttttttttctattcccctctcccctttaccgttctgtgttgatcttagacttttgtcttaggcttacctccaatgactggtgaatcatggtggttcatttatatttaaggatgagagattaggtagatttcatggagctttgagtattcaggcagaatttgtttattgaagtttgcttaaggtaaataggcagagaaggagcttactgttatgctgagracccctaaaatgccagaatgaggaagagtttactctgggtcactaatacccacattagtcctgtggttgtcctgtgtactgattccaaaagtacatgggtccattggagaaactttggaaaataaatataaacactaagaagatgacaaaataacttgtaagcccatccatcaagtgtagatttatgtataaccaaaaattgggaccatattacccattctgttttatcatctgttctttatacccaataatgtgtcatttttccatgtcaattaaatattcttctaaatcatggctgta

SEQ ID NO: 58245 - DNA, 601 bp, Human
tgatgttatagtttggattaaatgatttaatataaaactcttagaaaagtgcccggcacgtaggaattactagagaagtgacagccatgattgttgttgttattttctccttcccaggctggtgttgtctttcctacctctgtggctttgcatgaagcaccatggcgtatatatggtcaccactatgtcatttcttaggttgcttctaactatgtcatatctttatcatcagcctatggcatcattccagagttgttgttgcctttattagatttataaactctgacattaggacttcacygcaaattattttttttttttgtatttccccacagaatctaaatacattgcatcttgcagatactcaaacctttgtttactgacagagggagaggtccctttttctccaaatctctctttgtaaagccttttgaaacccttttcttcttttctgctctccactgtgttgttagtatgttagcattttttacatgtttctactgaagtccattgcaatcattcgttctaatgcttcccccggccaacttcctttgtttctctgtaagggtaggagttgttttatttgtatctctggtcttta

SEQ ID NO: 58246 - DNA, 601 bp, Human
tattctaaatttcatcttttatggatgtgactgtcaatgagaaatgatcatttctattgtcatacttttgtttcagttctatgctatgcctcatcttataaaaggtaaatcaagaacttctttttaataatgaagaggtgatttttaaaagtcagcatgtgtcttcagctacttaacaagaggataaagagctatatataaaccatgtgtattttaaaccaatggttaccatttaaatgcttgcttaccacctagtctttccatagtagttttcctgtccatctagttcttctactcatawactcatatccaatttgtcctgcccctttcagccattccacccatgccttaattctcttatccccttttgtattctgttttccccacctttccctctcccagggcatgtcgtcttttttttttttttcccccattttcccacttccactcttagaatttcaggccattcaagtttgttatattccatgatttcagattaagctgggctcccagagctggagggtctttttactcttccctcgttgacagtctttgttgtcgccactggtttgttgccatctttcacatgggatgccctaag

SEQ ID NO: 58247 - DNA, 601 bp, Human
ataatgaagaggtgatttttaaaagtcagcatgtgtcttcagctacttaacaagaggataaagagctatatataaaccatgtgtattttaaaccaatggttaccatttaaatgcttgcttaccacctagtctttccatagtagttttcctgtccatctagttcttctactcatatactcatatccaatttgtcctgcccctttcagccattccacccatgccttaattctcttatccccttttgtattctgttttccccacctttccctctcccagggcatgtcgtcttttttttttttttcccccattttcccacttccactcttagaatttcaggccattcaagtttgttatattccatgatttcagattaagctgggctcccagagctggagggtctttttactcttccctcgttgacagtctttgttgtcgccactggtttgttgccatctttcacatgggatgccctaagccctctctattccttccacactcccacccagatgcttcttacttggccaagaagattgaagaggttcctcatcagctgtttctagcttcctgttgctataccttagtttgttttgtgtgtgtatgt

SEQ ID NO: 58248 - DNA, 601 bp, Human
agcttatgtgaaaacattggaaactgatctaaacttagaaaggaatatggaatatgacaattctccaaggcacagaaaatattctcactctgtattgtgagttatgtgatagatgagaagaaggtaagtactgtttggactattctagataagtttacagataaatacaatttcaattcttcatggtttttttttttttttttttttttttttttccttgagacagagtttcactgtgtcgcccaggctggagtgcagtggtgcgatcttggctcactgcaacctctgcctcagcctcccragtagctgggattacaggagcctaccactgcacctggctaatttttgtatttttggtagagacggggtttcaccatcttggccaggctggtctttaactcctgacctcgtgatccacctgccttggcctcccagcgtgctgggattataggcatgagccaccgtgcctggccaattcttcatgtttttaatgttttaaattataatacactaaatatagatgttttactatgttttattttcttatacatttataattgacagtaaaacagtttttgttgttgttttggcttgttttttt

SEQ ID NO: 58249 - DNA, 601 bp, Human
gggattacaggagcctaccactgcacctggctaatttttgtatttttggtagagacggggtttcaccatcttggccaggctggtctttaactcctgacctcgtgatccacctgccttggcctcccagcgtgctgggattataggcatgagccaccgtgcctggccaattcttcatgtttttaatgttttaaattataatacactaaatatagatgttttactatgttttattttcttatacatttataattgacagtaaaacagtttttgttgttgttttggcttgtttttttttttttttttaattttttttgagcatcttgctctgtcgcccaggctggagtgcagtggtgcgatctgtgctcactgcaacctccgcctcccgggttcaagcgattctcctgtctaagcgcccccgagcagcagggattataggcgtgcatcaccatgctgggctaattttttgtatttttagtagagatggggtttcaccatgttgaccaggctggtctcaaactcctggcctgaagtgatccccccacctcagcctctcaaagtgcctggccgtttgtgatgtttttgatagatatttttagagatt

SEQ ID NO: 58250 - DNA, 601 bp, Human
ttagttgtattcgttgatgtttactttgaattatataatgattagaaacatctgacttatcgttcaattttttcagttaaaagttgcaaaggtcgctgtttcgagagaacatttgggaactgtcgctgtgatgctgcctgtgttgagcttggaaactgctgtttagattaccaggagacgtgcatagaaccaggtaaggatgagcagggaaaaaagtggagttatggtcattaggaaaagatcaaggaaagttctgtgtctttcaggtatgtgatttacctaattcatttgaattttttttagtttagcatacatacacgttttgacattagcttttatattttctttcaacagttccttaagagaaaaaaatttacagaatttctctgttaaacattttatggatagcagaactttgtctatttttaatgtatgctgaaagcctttgtaatctaatttgcattcaaattctaaaagcctgcttgaaatatagaaatattttcattatggttctttgacggcaagagatcttatatgtccacctatatttttcaaaataaaactatcagaatatgaaaattttcttagttagatttggaat

SEQ ID NO: 58251 - DNA, 601 bp, Human
ggacttttagtgaaataataataattggttcctacatattttaccccattagttcagagtggccatggtagtggcagattctgtgagtgactaagagctgtgaaattgttcattgttgctcatggatcatactcaggaagacagcaattctgtgttcactttggacatgttgaatttgagacataaaacacattttgctgatgtttgtttctagaacatatatggacttgcaacaaattcaggtgtggtgagaaaaggttgaccagaagcctctgtgcctgttcagatgactgcaaggacmagggcgactgctgcatcaactacagttctgtgtgtcaaggtcaggtgctcgttgggctctgcagcagcctggtatcttccagcgtcttagcggggctttacataggtgttatcttttatattaggagtcatggctattggccaactatattagctgaaaaaaataattttaaaactttttattaaagaaacttttaaacatacacatggggagagagagtatgtaatgaacattatacccatcacccagcttcataattatgattatgtgcacacggccaataatattttatctataacc

SEQ ID NO: 58252 - DNA, 601 bp, Human
gtgcacacggccaataatattttatctataaccactcattcccctgccaccaccctctcatgttattttgataatagcagcacacttgatgttgtatttgtggaaagatccctcttacagtcctggctgacttttatgtcccggcttccctcctagtaaatggggacactgtctgctgtgcattgagagagtcgatgtgaaattgtttagaaagattcgagggcattttgtaaggtgatactattatgatgtcttgtccaggtattattattatttttttttcaaatttcttgacagaacytgactctatatgagagagaactaagacaccaaaataccaaggattttgatgagtggatagaaggggagggttgtaaattttggctgaaaatattaagaatttgaaaatggaaaagataccttcaagttctcacaaatacagtagtatgttttagtcttacaattgtgcatccatttttaattcctgatatcaactaactcttattttgaagcacaataattctctttattgattatacacctccagagtcatgtcctgtgttatctatcaatctgttcacatactttgtttttggaatct

SEQ ID NO: 58253 - DNA, 601 bp, Human
ttaagtgtatttatctttgttccatttgaggtctaccatctcatacatttgaattactcatcttcagaaatgtatttttacctctttaaaatgatagttttcccagactattaaaatttttaagctgtattttagttcattttgttcatgtatgtaatttttgttatatgtcttcttttttttcttttggaaggaaaagtacttttgatttaaataagcagtagcaacagcagccaaaactaaacctcaaccaaataatttcaacagaagagcctttttttaaggaaaattttcatgtacsctaaactgtcttttaaatccaaggaatactgggaatgttagacttagtgaatttcaaatctttctttttcttctaaatattgcttataatttttcagttgtaatattgaatcttttagtggaaaacataaccctttctttacaagaagattgtaacttaggacacttattattacactggataatttaccagtatgtttacgtgatggcccactaacctgcttttatgatttctgttgattgaataaaactagttttgtatggaccgttaagactatatacactggttctacagagtctc

SEQ ID NO: 58254 - DNA, 601 bp, Human
aaagtacttttgatttaaataagcagtagcaacagcagccaaaactaaacctcaaccaaataatttcaacagaagagcctttttttaaggaaaattttcatgtaccctaaactgtcttttaaatccaaggaatactgggaatgttagacttagtgaatttcaaatctttctttttcttctaaatattgcttataatttttcagttgtaatattgaatcttttagtggaaaacataaccctttctttacaagaagattgtaacttaggacacttattattacactggataatttaccagtaygtttacgtgatggcccactaacctgcttttatgatttctgttgattgaataaaactagttttgtatggaccgttaagactatatacactggttctacagagtctctcagtggagctatgttacagatagtagctagtgaaaattgtataaaaatgttctccttgtggggttgcttttgtgtttgtgtgtgagggtaaggtgggaggaggcagagttgaaaaggcaaggtaaggtatttcctgtcaagttttaaatttactgagtaaactttcagtgggaagtctaacagttatccagtgt

SEQ ID NO: 58255 - DNA, 601 bp, Human
cttttgatttaaataagcagtagcaacagcagccaaaactaaacctcaaccaaataatttcaacagaagagcctttttttaaggaaaattttcatgtaccctaaactgtcttttaaatccaaggaatactgggaatgttagacttagtgaatttcaaatctttctttttcttctaaatattgcttataatttttcagttgtaatattgaatcttttagtggaaaacataaccctttctttacaagaagattgtaacttaggacacttattattacactggataatttaccagtatgtttaygtgatggcccactaacctgcttttatgatttctgttgattgaataaaactagttttgtatggaccgttaagactatatacactggttctacagagtctctcagtggagctatgttacagatagtagctagtgaaaattgtataaaaatgttctccttgtggggttgcttttgtgtttgtgtgtgagggtaaggtgggaggaggcagagttgaaaaggcaaggtaaggtatttcctgtcaagttttaaatttactgagtaaactttcagtgggaagtctaacagttatccagtgttataga

SEQ ID NO: 58256 - DNA, 601 bp, Human
acgtgatggcccactaacctgcttttatgatttctgttgattgaataaaactagttttgtatggaccgttaagactatatacactggttctacagagtctctcagtggagctatgttacagatagtagctagtgaaaattgtataaaaatgttctccttgtggggttgcttttgtgtttgtgtgtgagggtaaggtgggaggaggcagagttgaaaaggcaaggtaaggtatttcctgtcaagttttaaatttactgagtaaactttcagtgggaagtctaacagttatccagtgttatasaagttccctaccacctaccatgtatcactagatgctgaaaaatttctgagccatggccgttttggggtagccacatggccattgtccatagctattctcgtttgtcaagtatattagcatcctctgtggtttttggcctcctttttgaaatttccacactacacgttaactgtttgtatatgtatgtatgtgttgttgaaacctcattgatcattcccagctttgaattatttctttgttgtttatatatttaaatatagtatctctcaaacttttgtattaagtatttatatcttttaa

SEQ ID NO: 58257 - DNA, 601 bp, Human
aaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatcctatgcagccataaaaaatgatgagttcatgtcctttgtagggacatggatgaaattggaaatcatcattctcagtaaactatcgcaagaacaaaaaaccaaacaccrcatattctcactcataggtgggaattgaacaatgagatcacatggacacaggaaggggaatatcacactctggggactgttgtggggtggggtgaggggggagcgatagcattgggagatatacctaatgctagatgacgagttagtgggtgcagcgcaccagcatgacacatgtatacatatgtaactaacctgcacaatgtgcacatgtaccctaaaacttaaagtataattaaaataaataaataaatacagccctttgttaccattatcaggagagcttgtctccatggtgccaaa

SEQ ID NO: 58258 - DNA, 601 bp, Human
actttggaaggctgaggcaggcggatcacgaggtcaggagatcacctggctaacacggtgaaaccctgtctctactaaaatacaaaaaaaaaaaaaaaaattgccaggcgtggtggtgcacgcctgtagtcccagctactcgggaggctgaggcaggggaattgtttgaacccgggaggtggagattgcagtgaactgagaccgcgccactgcactccagcctggtgacagagtgagactctgtctcaaaaaaaacaaagaagagtttgtgtactaagcatgggggattcaaagattaatmgtatatgatctcttggctttttaagatttagtagagtatacaactaattgtacttggggtggggcaagaactctgattagaggtgtgtaaacaaagcctgtgtccagaggaaggcatattcaattctgctcaggaaatactgcgtagagaactgctgtctgctcctcaggggcctgcttcacagctgtgctgagtcatcagtgagtgagtgcttcatgatgtatgctttgcaaagtatattaacatatgagttattcatgtggtatgcagttactgttttcaggtccatgaatattatcc

SEQ ID NO: 58259 - DNA, 601 bp, Human
cattttaatggcaaaaaaacacaattacttttgcaccaacctagtattttggaacacaggaagcattagaacagaaaaggatctgaaggctcggcaccatggctaacgcctgtaatcccagcactttgggaggctgaggcaggtggatcacctgaggtcaggaatttgaggccagcctggccaacatggcaaaaccctgtctctactaaaaatacaaaaaaattagccgggcctggtggtgtgtgcctataatcccagctactcaggaggctgaggcaagagaatcgcttgaacccaggakggggaggtttcagtgagccgagatcgcaccactgtactccagcctgggcacagagcgggactctgtctcaaaaaaaaaaaaaagagaaaaagaaaatgatttgagcatatttccttgtacctctaagttgactttccttctgatatatattttgttggtgacctaagatatgaaaggaagtaaaaagtaaggatcttgactattttgggtcatgaaaaaagtgaaaagaggtattgccaggatccctcctgtcagaatccttgtgtagtgatcttgtgccccctgtgattccaaggggtc

SEQ ID NO: 58260 - DNA, 601 bp, Human
ctgaaggctcggcaccatggctaacgcctgtaatcccagcactttgggaggctgaggcaggtggatcacctgaggtcaggaatttgaggccagcctggccaacatggcaaaaccctgtctctactaaaaatacaaaaaaattagccgggcctggtggtgtgtgcctataatcccagctactcaggaggctgaggcaagagaatcgcttgaacccaggatggggaggtttcagtgagccgagatcgcaccactgtactccagcctgggcacagagcgggactctgtctcaaaaaaaaaaaagagagaaaaagaaaatgatttgagcatatttccttgtacctctaagttgactttccttctgatatatattttgttggtgacctaagatatgaaaggaagtaaaaagtaaggatcttgactattttgggtcatgaaaaaagtgaaaagaggtattgccaggatccctcctgtcagaatccttgtgtagtgatcttgtgccccctgtgattccaaggggtcatagactattaaaaaaaacactctttcttaattttctagggcttcactcccaaattcctatcagttctcccgcccaggtagc

SEQ ID NO: 58261 - DNA, 601 bp, Human
attatgtcttcctggataattgagatatttgaataattatttttgttgttgagtatttcctagggaacaagatgtacaaaacagccttacaaaacacatacagtttttatttttacccagtgaaaccataccagatctagatggatagatattttgagggatggatggatgatggatattggttactaactggatggaaagatggttggacaggtggatggatagttaggtggatgaatggatatgtgggttaagagatggatggataggtagatgttctgtaacttgtctttccctttawcaatatgacactatatcatgggtgtcattacagggtgatccctaaaggtctgtctaattcctttcagtggctacaatgtaatgacttaaatgaactctttaaaacctgccttggtatttaaatgcagagtttggatctgacattctatatttttgtattatgttttaattatagtatacaatcaactattaattcttatgtttgttcccctccagttaactatgaaggcattgcccgaaatctttctgtgagtatctttattttccattatctagttatttttacttttgtataatatat

SEQ ID NO: 58262 - DNA, 601 bp, Human
ctgtgcaatatatccatgtaacataactgtactcatacccctaaattcataaagttaaaaaattaataaaattttatattcatgtttcataaacatatgacatatctcctattatatttctaataattatttttcaaatttttgtgctctgttgagagtattgctttacagttgaagaaaaccagtgctataatagataagaaagtatcagacttatgttctgagaaggataatatcttacatttacccagcactttaacattttcaaaataaacttacaataattatttaatttgatccctgcatcactgtgtaaggtgggcaggatgaggtttatattgcatgtcatagatgaaaaaaaaatgttatcattcattctgttctgattgtcaaaccaagaattgtagtaaaactaagagacctatcctagatgtccttagattatgtgtgtgatagggttaaaactatatttcccacaaagtccactgagcgtggtagttttcctcttatcttatcataaccagtttgtatatgtacaatgtggataacagaatttttgggaccaacttgtagacagctgaaatgcactgataaacttcct

SEQ ID NO: 58263 - DNA, 601 bp, Human
ttaaaatgcataactttacagtcattgcgatgcttgaggtttttacattgctgttcggtgactgtcctcctttgctccagcaacttttggcagtgtagttgactatggaagatagactcagatctctaaaaatcaacattttactatataaaagcttaaaattgaccagcgcggtggctcacgcctgtaatcccaacactttggggggctgaggagggcagatcacgaggtcaggagttcgagaccatcctggctaacatggtgaaaccctgtctctactaaaaatacaaaaaattagccrggcgtggtgggtcacacctgtaatcccagcactttgagggggctgcagcggatggagcacctgaggtcaggagctcaagaccagccttgccaacatggtgaaaccccatctctaccaaaaacacaaaaattagccaggcgtggtggcagatgcctgtagtcccagctactcgggaagctgaggcaggagaatcgcttgaacctggggggcagagttgcggtgagccgagattgcgccactgccctctagtctgggtgacagagtgagactccatcttaaaaaaataataataataaataa

SEQ ID NO: 58264 - DNA, 601 bp, Human
attatatatatatagctatatatatatagctttgtttatttattggtgaaaaattgtggatttggtctagaactaccaagggaaaaattttaatcatctaaaacttgaattttataaaattttctttttgttgggagggtagttgatgtagtgcagatatggtaagcagaacacttcatggttcctttctgcatttcttttaaacaatttgagaatattgtgaaggtggaatatatatatcaagttggaagaatatatcaaggttcttaggaagataactttgttaggataaataactttsttgtttaaaaagaaaatgcgtttgtcagagaagtaggtaaaggtagaggcttacatatgcttgctttttcactgatccagaatctctagggaatggcttttttgaagctaagtattctattttttgaaatggcaaatttgtatgttgatgagaagccattttggggccagccttaaaaggcaaaaatcagaaagctccaggtgctcaactaccgtcagcatccagttcagttcccagagtatgtgtctgaagtcagaacttggctattgcattataaaaatagaccaggtccaagcctca

SEQ ID NO: 58265 - DNA, 601 bp, Human
cagagtatgtgtctgaagtcagaacttggctattgcattataaaaatagaccaggtccaagcctcaaattcatacagagaagccttgtatggtgtttcgagacagacatcctgtgatgttttttctgggtagcaggtgttgttctggagccagatgttctcttttttcttttcactgtgaaaaagtgtaaggaaagaagattgtcaacacaattccttttagttgaaatgagggcaataacgtttgaatatgtttaatttggggctcttgttattaaagtttatgtttcgttgacatgctsatcttgaaaagacttcttaaatattttatttttgtaaaggacttgaccaaacacattacattttcccttgaccctgtacttgggaaagttttacaggtttaagatggtactcagctaatttttaaaaatgctcccctaaccatgagaaactataatttcctatgttatttgtgaagaatgaaaaagttgtcctcttttctctttgtagaactaaataaaaattcaagtggaatatattctgaagctttgcttactacaaatatagtgccaatgtaccagagttttcaaggtaaataatgt

SEQ ID NO: 58266 - DNA, 601 bp, Human
acaccaagtaagtctaaacctgaatctgcaaaaagatgtagctttcataccagtcccaatgaatgggtggtaggtacctggagttaggatcttgagacccagtatgagctcagcaggaaagagtgctgtatccactcattcattcactactactttgattcaccattcattcctttgatatttataatcaggtgctctaggtactgaggacacagcagtgaacaaaatagtgagctcttctctgggcccaagagtagaatacaatgatccgtttgccatccctgatggtagtagtctttcyatatatcgttaaaattcatgaagatatgtctctccttaattgtttctatgataaactttcagaattacttgttcctatagaacacatttctcattatttttccctttattctttagaattaaatacagaatagcaagattttagttggttgcctgatgattatctgactccactgaaagttgtcagttttgtgggcattgttggaaacatgcagctattccctgcttcattatttcgtttgagagattatattgtcattgaatgtatcaattagagtagggttctgcagcaaataacaga

SEQ ID NO: 58267 - DNA, 601 bp, Human
gcaggaccatctgttccaggtatagtttcttttccccaaacttgaagcatctaattaaacaaacatgcatggtatgtattagaaggaaagctactcaagaggagagatgatgcctaacaaatcatgtggcacgttccacttcagagctgaaatctcgtaaatgattaaactggggagatggagcacttatagaagtgaactgagtgttctcttggtaacttttcttttatatttcctattctcctagcatgggaagcatgactcctcatgggttgaagaattgttaatgttacacagagcrcggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttg

SEQ ID NO: 58268 - DNA, 601 bp, Human
tatttcctattctcctagcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacrgagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtga

SEQ ID NO: 58269 - DNA, 601 bp, Human
ttctcctagcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcsgtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatcttta

SEQ ID NO: 58270 - DNA, 601 bp, Human
ttgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagyagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagt

SEQ ID NO: 58271 - DNA, 601 bp, Human
ttgaagagatgtttttgtggcgccacactactgacttaggcataatgcctagagatggattagaactgcacaatgaactagtggtgaggttcagtttaatggaaattggtgaaagcttttaggataaaatgataatctttgtttctttcaggaaaatggcagacaatttttcggtaagtgttttatgcctgtttcttccccttgatcagctccacatggttgagggttgggggttttgtttttaccatgactttcccttttcactctcccactgcgtggcttcccctggactcatttgtcyaatgagggcttgcaagctggagccttgtttttccagcagcagatttgggaagaaagccaggcagagcgaggcctgggactcactcacagtaaccctttcaccaaaaggcccagggcggaagggagtggactctgccggcaggagctgagaaatcctctgagtagcgggaagtgcggtacagtctgggcattctgatgtttgtgattgtttttctcacggtgatgaaaaagtatgtgctataagtagaggagcgctaactcctgacttgagctaattatgaaaatgcagccctccctgatc

SEQ ID NO: 58272 - DNA, 601 bp, Human
caagtgccaccggagcctaccctgccactggcccctatggcgcccctgctgggccactggtgagatggcattccttctttcatgtacttgacatgcagagggcttcagggagaccctgagctttaaagctgctgcttagagccacttctcaagggccagccatgggtgtatgttggtagagtcaaaaaattaagtgttcatattgagcttattgtgtgtggttagtataaacagaaggtaatgagtattttgaaggcactgataaaactgcttatgaatataaatcaagattgtagtaatggagaacattttggttattattaacacttacggagtacatgtcaatagtatgcatctacatggataatctcatttaaccccattaccacgctataagatactgttaataaccccatttcacacatggggaaatggggcaatagagaagtgatataatttgtccagggtcattgagcaaacatgtagaggaaccagggtaatctggttttgaaaaaccttctaaagataattttgtgatctaagggttgaattttcacgcaaattaaaatatgtcatagcaagtgaattctaagtgtaaaac

SEQ ID NO: 58273 - DNA, 601 bp, Human
gatatcttttcgtatcagaatattgttacttaatagcactttttttttttttcgagacagagtctcgctctgtcgccaggctggagtacagtggcacgatcttggctcactacaacctccgcctcctgggttcaagcgatgctcctgcctcagcctcccaagtagctgggattataggcgtgcgctaccatgcccagctaacttttgtattttctgtagagacggggtttcaccatgttggccaggatggtcttgatctcttgacctcgtgatccgcccacctcagcttcccaaagtgctrggaggattacaggcatgagccaccatgcctggccagtagtatttcatttttagatatgtgataatttaaccagtaccctactgatgaaaatttacagaatagaaacactccaacctggaaagattttactaaaatactgtaataactatccttacaaatctttgcttcctagaagcaagtcttctagaaatctttgcttcctagaagcaagtcttctagaaatctttgcttcctagaagcaagtcttctagaaatctttgctttaaatatacatgtttacaatttagatattgtcaaatt

SEQ ID NO: 58274 - DNA, 601 bp, Human
cgtgagccaccacacccaggctcttttaagtttttatgcaggcaaatctttagcctccacctttatggcttcacttatgtatccttctaataaatttgctgctttaaaaaaaaaacctgaataacttggaatttttttgttgttgctttttgtttttttgagacggagtctcactctttcgcccaggctggagtgcagtggcactatctcggctaacttcaagctccgcctcctgggttcatgccattctcctgcctcagcctcccaagtagctgggactacaaggtgcccgccaccacamtcagctaattttttgtattttcagtagagatggggtttcactgtgttagccaggatggtctcgatctcctgaccttgtgatccacccgcctcagcctcccaaagtgctgggattacaggcgtgagccaccccgcccagcataacttggcatttttgctgtaaagttactttctctggatcttaactggtcccacaaatgataaggatgaaatgttggacatcctgggctcaggccagactggtttgaaattaatggacattttttccctttatttcagttgacaaaaaattgtttctata

SEQ ID NO: 58275 - DNA, 601 bp, Human
tttgctgctttaaaaaaaaaacctgaataacttggaatttttttgttgttgctttttgtttttttgagacggagtctcactctttcgcccaggctggagtgcagtggcactatctcggctaacttcaagctccgcctcctgggttcatgccattctcctgcctcagcctcccaagtagctgggactacaaggtgcccgccaccacaatcagctaattttttgtattttcagtagagatggggtttcactgtgttagccaggatggtctcgatctcctgaccttgtgatccacccgcctcakcctcccaaagtgctgggattacaggcgtgagccaccccgcccagcataacttggcatttttgctgtaaagttactttctctggatcttaactggtcccacaaatgataaggatgaaatgttggacatcctgggctcaggccagactggtttgaaattaatggacattttttccctttatttcagttgacaaaaaattgtttctatagtgcagatgaaatatgtatatattgtggaatgcctaaatccagctgacatatgcattacctcatgtaacagtttatgtatatgccatttcagat

SEQ ID NO: 58276 - DNA, 601 bp, Human
gaaaagaaagtaacgaatatttaaattttttctcttcaattaggatattttcacatgatttagaaatggaaggatgttttctactccttctagttaccacttgtcttatttttcatagtatatatgaattgtagttggcaaataaatcaagaatgtgatttaaagaactaacctgtttagatttgtaggtcaggttagatttgaaatgccacttgaaagagcagcagttttgactttaatttttatgagactgacaggttctttttttttttttgtccccaccttcttccctatttaggtkttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggca

SEQ ID NO: 58277 - DNA, 601 bp, Human
atacaacgtgaggtatagagagtggtagggaacagagctgaaaagatagcagtggctagatcatggtggtttttggatactgtgccagggagctaggacttcttaggttagccattgttgaagattttcaagcagtttagttacatggtcatatttctgttttagaaagatttttttggcagagctagcaagaacagatttcatggggcagtatttgatgccggcagactagttaagaggttattttagttttctaaaattaagatgtaggcctgaactatggtagtgacagaagaaacamagttgagaagtatgcaaagtaagaatgacacgaataacctcactatatagaggtgtggcagataaaggagaagataggattaaagctgatctcccaagttctgagttaggttggggttggcaaactgcaacctgtgagccgcatgtagcccacttcctttttttatgcccatgaaccaagaacactttttgcattttaaatggttgggaaatagaataatattttgagaaatgtaaaaatgtaaaaaaaagtcaaaatctcagtactcataaagtgtttttatatgcagctacattcatt

SEQ ID NO: 58278 - DNA, 601 bp, Human
gtaggcctgaactatggtagtgacagaagaaacaaagttgagaagtatgcaaagtaagaatgacacgaataacctcactatatagaggtgtggcagataaaggagaagataggattaaagctgatctcccaagttctgagttaggttggggttggcaaactgcaacctgtgagccgcatgtagcccacttcctttttttatgcccatgaaccaagaacactttttgcattttaaatggttgggaaatagaataatattttgagaaatgtaaaaatgtaaaaaaaagtcaaaatctcagtaytcataaagtgtttttatatgcagctacattcattcactcattcataatatgtttatgactggctttcatgctgcagtggcagacttgaatagttgtaccagagaccatatgtcctataaggtctaaagtttttactacgtggccctttgcagaaaaagtttgccaacttgtgcttggcagatggttggtagcactaaaataggtaatactggagagagactagatgtgaattgagaagagaacacttccagtttgtgtttccaatgcctgtggggccatctacgtagagcaactcaggat

SEQ ID NO: 58279 - DNA, 601 bp, Human
gattaaagctgatctcccaagttctgagttaggttggggttggcaaactgcaacctgtgagccgcatgtagcccacttcctttttttatgcccatgaaccaagaacactttttgcattttaaatggttgggaaatagaataatattttgagaaatgtaaaaatgtaaaaaaaagtcaaaatctcagtactcataaagtgtttttatatgcagctacattcattcactcattcataatatgtttatgactggctttcatgctgcagtggcagacttgaatagttgtaccagagaccatatgkcctataaggtctaaagtttttactacgtggccctttgcagaaaaagtttgccaacttgtgcttggcagatggttggtagcactaaaataggtaatactggagagagactagatgtgaattgagaagagaacacttccagtttgtgtttccaatgcctgtggggccatctacgtagagcaactcaggatgcagtagggtatgtaaatgtagaaaagtagattcagaagccttaagcgtgaaggtagtagaaggcatgggagtagatagctcatccaagggaagtattttaattgaagcccc

SEQ ID NO: 58280 - DNA, 601 bp, Human
ttcgtggaatgaaagagataaaaatcaggttgcaattagctgaggaatgattggtagaaaaggaactaagagtattttgtcaatatgtaaggaaatggatgtgggatgctgggaattatggtgatggggaagggttttctcttccttcccttcccttccttcttttccttcctttccttcccttcccttccttcttttccttcctttccttccctttctttcttccttttcttctttctttctctctttctctctctcttttctttcttctttctttcctttttctttcgacagggtcttkctctgttgctgaggctcgagtgaatggtgtgatcttggctcactgcaccttcgacctccggggctcaagctatcctcccacctcagccccagagtagctggaactacaggtgtgcgccaccacacctggctaattttttttatttttttcgtagagatggagttttgtagagatgaggtttcaccactttgcccaggttggtctggaactcctgggttcaagtgatactcctgggttcaagtgatccacctgcctcagcctcccaaagtgctgggattacaggtgtgagcagctgcacct

SEQ ID NO: 58281 - DNA, 601 bp, Human
tcatgccctcctactggtcccccaaagtcttaactaatttcatcattaattcaaaagtccacagtccaaagtctcatccgagacaaggcaagtcccttccgcctatgagcctgtaaaatcagaagcaacttagttacctcctagatacaggggtaggcattgggtaaatacagccactccaaatgggagaaattggccaaaataaaagggctacaggccccatacaaatctgaaatccagtggggcagtcaaatcttaaagctccaatatgatctcctttgactccatgtctcacatccasgtcatgctgtttcaagaggtggattcccatggtcttgggcagctccgcccctgtggctttacagggtacagcctcctttctggctgctttcatgggctggcgttgagggtctgtggcttttccaggctcacagtacaagctgtcagtggctctaccattctgggatctggaggatggtggccctcttctcacagctccactgggcagtgcttcagtggggacttagtgtgtaggtttcaacctcacatttcccttcctcactaccctagcagaggttctccatgagggccccacccctgt

SEQ ID NO: 58282 - DNA, 601 bp, Human
aagctccaatatgatctcctttgactccatgtctcacatccaggtcatgctgtttcaagaggtggattcccatggtcttgggcagctccgcccctgtggctttacagggtacagcctcctttctggctgctttcatgggctggcgttgagggtctgtggcttttccaggctcacagtacaagctgtcagtggctctaccattctgggatctggaggatggtggccctcttctcacagctccactgggcagtgcttcagtggggacttagtgtgtaggtttcaacctcacatttcccttcckcactaccctagcagaggttctccatgagggccccacccctgtggcaaacttctgcctggacatccaggtgtttccatacatcctctgaaatctaggcagaggtttcccaaaactcaaatcttgacttctgtgcacccacaggttcaacactacgttgaagctgctaaggcttggggcttgtaccctctgaagccatggcccatgctgtaccttggtttcttttatccatgcctagagtggctgggttgcaggacaccaagtccctaggctacatacagcaggggggccctgggccctgct

SEQ ID NO: 58283 - DNA, 601 bp, Human
gagggcccttctgcaaaggtctttgacatgctctggagacattttctccattgttttggtgatttacatttggttcctcattacttatgcaaatttctgcagctggcttgaatttctcctcagaaagtgggattttcttttctatggcatcatcaggctgcaaattttccaaactttattctctgtttccctcttaaaactgaatgctgttaatagcacccaggtcacctcttgaatgctttgctgcttagaaatttcttccgccagagaccctaaatcatctccctcaagtctccctcaratctctaggacaggtgcataatgccaccagtctctttgctaaaacatagcaagagtcgcctttactccatttcccaacatgttcctcatctccatctgagatgacctcatcctggatttcattgctggtatcatcatcagcattttggtcaaagctattcagcaagtctctaggaagttctaaactttcccacatcttcctgtcttcttctgagccctccaaactgttccagctctgcctgttacccagttgtaaagtcacatccacattttcgggtatctttacagcagttcctcactc

SEQ ID NO: 58284 - DNA, 601 bp, Human
tggggtttcaccgtgttagccaggatggtctcgatctcctgacctcatgatccgcctgcctcggcctcccaaagtgctgggattacaggtgtgagccaccgtgcccggccagatttatattacttttaaagtcatttggcccttggctaaactgtaccgtgctttgctctgactagaagtgctaaagtcaaagtcaggtgatttctggatagcatgtatgaacggtttttgtgactgaagatcacaccgttcaaagaacctcaggactattgttgtgggggggatgtgtgtgttgtgtttrtaatagtactcttctaaaagaaatgatttgaatggcataatcactgctatggctgatgttttaaaaaaattgtaaaataaaaaccccatgcagccaacatctatattcttatgggtcatattcactataatatcatatgtactatgtcatactgggaaaggtgacaaattttcaagggttacctatgtaaaataaagtgatatgttgtctgctattcaatattagatggtgcatttaactgtctttattctaaaaacacacacatgcacacctttccccataacctcttgcctactttca

SEQ ID NO: 58285 - DNA, 601 bp, Human
gactttaaatacaaagacagatgctttattgcaaggaactttcttgattatttttatttttgtttttatttttttgagatggggtctggccctgtcacccaggctggagtgctgtggcgcaatctctgctcaccgtagccttcaactctcgggctcaagcgatccctccatctcaccctcctgaggaactgggaccacaggcaatgcctggctagtttttgtattttttgtagagatggggtttcactgtgttgcctatgctggtttcaaggtcctgagctcaatcagtcgtcctgccttsgcctcccaaagtgctaggattacaggtgtgagccacggctcctagccttgatattgattaaagaatttgtccttcggtttattttattgtaattgggtgagtaaatacttaaaaaagttgttagttatatgtggggattgggaaaagctcctagcagggaagaaccttgctgaagttactatgttactatattgctgtttagagttaatgctttttaagattaaaagtaattgctttaagtgtctctcttctaatgaaagatgttgctggtagcttatgggggcaagagtaatcatttta

SEQ ID NO: 58286 - DNA, 601 bp, Human
cctgttttgttttgttttgttttgtttcattttatttactactactgttcttccaatgaggggtgtttttcttggatcatctttgtgctagagcttggtgttgttgaagggtcagggatggctggtgttctccttggggactgtgtatgtaaaatgatttttttagcctttgctgcttttcagataagaggcttagggtctccctgtagagaatcttttgactgcctcactggctagttgctccctttgagtgatgtttttcctcttgagatgtgggattttatctgcaactttttttttyttttccttcttgagaccttcttccaagaaagttcctgcttgcaatctttgcacttgtttgttgtttcccatgtcaagttggggatggctggttttacctttcaggatgtgcctgttaatttcagagaactacacatctatggcacctctgtagccatgggtatattctgacagggtcgtggagcatctgaatttgatctttactatatttggtggtctttccttatatgctttgagattacaggttactgtcattcatagcagcttacattttggtttcatattctctcttttgatctag

SEQ ID NO: 58287 - DNA, 601 bp, Human
ttttgttttgttttgttttgtttcattttatttactactactgttcttccaatgaggggtgtttttcttggatcatctttgtgctagagcttggtgttgttgaagggtcagggatggctggtgttctccttggggactgtgtatgtaaaatgatttttttagcctttgctgcttttcagataagaggcttagggtctccctgtagagaatcttttgactgcctcactggctagttgctccctttgagtgatgtttttcctcttgagatgtgggattttatctgcaactttttttttcttttccttcttgagaccttcttccaagaaagttcctgcttgcaatctttgcacttgtttgttgtttcccatgtcaagttggggatggctggttttacctttcaggatgtgcctgttaatttcagagaactacacatctatggcacctctgtagccatgggtatattctgacagggtcgtggagcatctgaatttgatctttactatatttggtggtctttccttatatgctttgagattacaggttactgtcattcatagcagcttacattttggtttcatattctctcttttgatctagcagg

SEQ ID NO: 58288 - DNA, 601 bp, Human
tttcccatgtcaagttggggatggctggttttacctttcaggatgtgcctgttaatttcagagaactacacatctatggcacctctgtagccatgggtatattctgacagggtcgtggagcatctgaatttgatctttactatatttggtggtctttccttatatgctttgagattacaggttactgtcattcatagcagcttacattttggtttcatattctctcttttgatctagcaggagaaggaggaaattactgtcttgactctgagtttaaaactggaattcctgtagttcttcrtaaaaatctgttccttggttgatatgtatctagttggaaatttcaggatacacaacattaaagagatttttctgaatatttcactgatcagtatttggcagttattttactttttatgtagtacagaactctgcattgacccaagaacacttgatgttagatacttcattttcataatttttttttaatcttagcaccttttattttttattttatttatttatttttcttatactttaagttctgggatacatgtgcagaacgtgcaggtttgttacataggtatacacatgccgtggt

SEQ ID NO: 58289 - DNA, 601 bp, Human
tctttggaaacaagatgaaatggttgcattcactttattagcaaacttttaagtggctagtatgtacaaggccctttcttgggccatcaacatacagtggctagtgaagttcactctgcgtcctaagtaaaacaacttttctaggtggggatgaggtagggaggccggatgcagataaatatgatgatagagataagtattggcgactttagagcaatggtgatgggaggtaaggaagaaaaggatttgatagggaagactttttagaagtgatatgcagactgtgttaaatcttttaaawcaattaggcattatcaagtaagagagtaaagaaatgggcactgaggataagagttacttggtgtgatttcttagtccatctctggaggtgatagttcagtgggtatattttgggacccaggactgagctttttaatgagtgcactccaggtgttaccagtacagattgtctagagtaactgctctatgagaaatacagtaagagttgtggtatttggtaatgagggctggaatgaagaagggatattgagaagtagatagaggccccatcttaaagggccttgtatacctgaagactggg

SEQ ID NO: 58290 - DNA, 601 bp, Human
ttttttttcaggccaatcatgagcaatgatgtttttaatattttgaggcattattatctttatgcttgaatcctgtgacttttctctgcctggcttaggctacaatttgttctgaaatcttaaagacactttatttctatggctaggtgccgtggctcatgtctgtaatcccagccgaggtgggaggatcacttgaacccaggaatttgagaacagcctgggcaacatagtgggaccccattctataaaaaaattaaaaagtttgccaggcatggtggcatgcccatggtcccaattactyaggaggctgaggtgggaggcttgagcctggaaggatgaggttgcagtgagccatgatcacactattgcactgcagcctgggtgacagggtgagaccctgtctcaaaaaacaaaaaactccaaacctctttatttctagttactcttgcattcaattcttagacatgtctttagtttattattacatactgggataattatggctgatattaataggtttgtcattttcattccgtcttgtatttggtaccagatttttttttggtaaaatattgctttgataatatcgctagtctgctaa

SEQ ID NO: 58291 - DNA, 601 bp, Human
ttccttgtgatagtgattggctctgaggccatactttgagaaatagtaccttagagagactagtaataccggtacacagtaccctgactggctgatttttaatacgttttcagaagaccagtttgaaggtgacactatttatggtcatccatttttcttgatattttacagtgattttagaatttgaataactcattagaattatataggaattatacaactaaactttattgttagtagtcacttgtgttctgtttcagttgggctgtaaatggaactactagctcagctcagcaaaactaacaaagtatgttttgtttatttcttatatatatttgtaataacggaaggctcctaatccagttactgttttcaggcagtctgcagaactaaataaactacgccaggattatgctaggttggtgaatgagctgactgagaaaacaggaaagctacagcaagaggaagtccaaaagaagaatgctgagcaagcagctactcagttgaaggtgatatattctcacctttatttgtcatttcatgaataatataggcgtattagttcgttttcatactggtatgaagaactgcccgagactgg

SEQ ID NO: 58292 - DNA, 601 bp, Human
agtaccttagagagactagtaataccggtacacagtaccctgactggctgatttttaatacgttttcagaagaccagtttgaaggtgacactatttatggtcatccatttttcttgatattttacagtgattttagaatttgaataactcattagaattatataggaattatacaactaaactttattgttagtagtcacttgtgttctgtttcagttgggctgtaaatggaactactagctcagctcagcaaaactaacaaagtatgttttgtttatttcttatatatatttgtaataayggaaggctcctaatccagttactgttttcaggcagtctgcagaactaaataaactacgccaggattatgctaggttggtgaatgagctgactgagaaaacaggaaagctacagcaagaggaagtccaaaagaagaatgctgagcaagcagctactcagttgaaggtgatatattctcacctttatttgtcatttcatgaataatataggcgtattagttcgttttcatactggtatgaagaactgcccgagactgggtaaatttttaaggaaagaggtttaattgactcacggttcaaca

SEQ ID NO: 58293 - DNA, 601 bp, Human
tcacgaagcagcaggaaggagaaatgccgagcgagggggaagactcccttataaaaccattagatcttgtgagatctcactattacaagaacagcatgggggaaaccatgcctatgattcagttacctccacgtggtctctcccttgacacgtggagattatggggattacaattcgagatgaggtttgggtggggacacaatgcctaaccatatcagtaggtatttaatttgatgacttaaatgtgtatataggtttgaaaaatatagtttgaagcttaatgggacctgtagtctaaatrctatgccctgatgaaagaaaaagaagcatgtgccctattgaaagaattgaatataggcttgaatttgaagttaaagaccgtttgaagatatggtaaatgatgttagctgattgacagatataaattgtagaattttatcatatatatgggggttagggtctacagtatagggcagaaatcatgtagttaaaaattacccttaataccactttatcacccatagcttggatttttcagtaggtccagcagaacctagttttctttcagcactggaataggtagtttttcctttgcttcagc

SEQ ID NO: 58294 - DNA, 601 bp, Human
tcccttgacacgtggagattatggggattacaattcgagatgaggtttgggtggggacacaatgcctaaccatatcagtaggtatttaatttgatgacttaaatgtgtatataggtttgaaaaatatagtttgaagcttaatgggacctgtagtctaaatactatgccctgatgaaagaaaaagaagcatgtgccctattgaaagaattgaatataggcttgaatttgaagttaaagaccgtttgaagatatggtaaatgatgttagctgattgacagatataaattgtagaattttatcwtatatatgggggttagggtctacagtatagggcagaaatcatgtagttaaaaattacccttaataccactttatcacccatagcttggatttttcagtaggtccagcagaacctagttttctttcagcactggaataggtagtttttcctttgcttcagcacaagactaagtagtgttccagtggcttgcactcgacccatgatgtacaaaaagtcacatactgtatctttagacgccagagtgtcacttggtccagtgagatgcttatactatgaagagatgcatggctttgctcaggc

SEQ ID NO: 58295 - DNA, 601 bp, Human
cagtaggtatttaatttgatgacttaaatgtgtatataggtttgaaaaatatagtttgaagcttaatgggacctgtagtctaaatactatgccctgatgaaagaaaaagaagcatgtgccctattgaaagaattgaatataggcttgaatttgaagttaaagaccgtttgaagatatggtaaatgatgttagctgattgacagatataaattgtagaattttatcatatatatgggggttagggtctacagtatagggcagaaatcatgtagttaaaaattacccttaataccactttatcacccatagcttggatttttcagtaggtccagcagaacctagttttctttcagcactggaataggtagtttttcctttgcttcagcacaagactaagtagtgttccagtggcttgcactcgacccatgatgtacaaaaagtcacatactgtatctttagacgccagagtgtcacttggtccagtgagatgcttatactatgaagagatgcatggctttgctcaggctgactgagggaggagcagattcatttatctcattttatatgcattctgaagcatatgtacattgaatagaatgat

SEQ ID NO: 58296 - DNA, 601 bp, Human
gagagattcaaagaaggttttctagaggagagaatgcctacacgaaagatgagtatgagtaactaggcaaagaaagagacctctgtaaaatgtaatgttttattacagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggtattttttcttcttttttttttttwaaaaaaatacaggtggtcacttattagatctgtgtgtctagaagagagactaaagtctaccttatcctaattctgaaatgatgatgaataattataactttgtcttttgagcacttgtcacaatatggtgtgtttgaaggtgtgctcacccacagtcttaggctctttgtgttagattaggaatagcacaaacatatctttaacttctgtcttataagctaactcagattgtctaatcattgtttaaaataatgccttttggaatctaagaatgccttaaaaaaaaaaaagaaaaagata

SEQ ID NO: 58297 - DNA, 601 bp, Human
gagagttatttgtagcaaaaagtattggcttagaagtctgacatttctgtataaaaagtggtttttaacattaaaattttgtttttaaggttcggagaagttcagactcccaaagctttgaccatataaatatatttttcccagttgctttatctgtagaaattatagtctaaagtaattgaggaagaattaatgcaggaaagggtgctggtgtggatgtgtatgtatatgtgaattaccaactcagattgaattgtgatctttagttatcagctgagaagtagctctaaaaaatttatcwggagttaaatacatagagaatgctgtaagaatcttttaaatagtaaacatgaacatgggtattactaaactatattagtcatggaatggataattttattattaaaagttgttactaaggagaagaaacacaggatgacaaatggcctttctggctgtttttcctactcatttgttgcttgtcaattatttagtttccaggcctgtcaacttgttttattctaaatgtcttgtgatatgtaattcgtgactactggctgttggtgatcaaacttgctttcagaatgatagttactcttta

SEQ ID NO: 58298 - DNA, 601 bp, Human
tcggagaagttcagactcccaaagctttgaccatataaatatatttttcccagttgctttatctgtagaaattatagtctaaagtaattgaggaagaattaatgcaggaaagggtgctggtgtggatgtgtatgtatatgtgaattaccaactcagattgaattgtgatctttagttatcagctgagaagtagctctaaaaaatttatcaggagttaaatacatagagaatgctgtaagaatcttttaaatagtaaacatgaacatgggtattactaaactatattagtcatggaatggawaattttattattaaaagttgttactaaggagaagaaacacaggatgacaaatggcctttctggctgtttttcctactcatttgttgcttgtcaattatttagtttccaggcctgtcaacttgttttattctaaatgtcttgtgatatgtaattcgtgactactggctgttggtgatcaaacttgctttcagaatgatagttactctttattgaacacttaccatgggccagatactttcataacaatttatatacattaacttctcttaaaatttaaagctgttatgattattgtatagc

SEQ ID NO: 58299 - DNA, 601 bp, Human
atctagtcgttcatacatttatgtttaattataattgttgcagaaaatattgctgcttataactgatagttgtgcccataattcttgtagattttctgaatgtatgaagtattttaattttttttttcaccctcatagtgtttatgttaaagatgataaaataagattgctggaagagcaactacaacatgaaatttcaaacaaaatggaagaatttaaggtgtgtgattaagcttgtacactcaggtttcttagaacaaccttgtatacttttcagttgagtgattccagaaatactacrttttgtatgaagtcactctgaaacaatgtttctgtagtttattaggggacttatgcaaaccatgaattttatcatagactttccccctagattatctgttcttttagtggagcttggagatttatttttggcccccaatcttttctcagctgatagtttctatttgggactgtcttatttgtctccactgttgctgtagttctagtttctggtcatggccaaccaagtgctagggtgcatctctgtgtccagtgaaatttgaattatgtcagtgtataattcacctgtcactttgaggac

SEQ ID NO: 58300 - DNA, 601 bp, Human
ctaatgccaatctgctcaaaagcacattccagaaaaataaaaatgtgtaataggatgcataaaaataatttaagccattttgatacatttgactttcagaataaatgtcctgccttagacttggagcctcagctttttcttttagggagcatggtgtctttaaaggttgaaacttattactagcacttaaaagcagtgtgatgttgatcaaatagcttaacctttgtgacacctctcattccaagcctttcacatggagattatattatatttacaccataaagttgttagatttgaaaggagaagcttatgtatggtgcctagtctagtgctttgtttatgacaggtatctaaaccttaattcttttcccttagagtatttattttatccatctcatctccatcccctgccaccatcactattcattttatatttatagcaagacatcaaaactatatcagctttgaataagcatggttccataaattagagcccagtggtatctgttctctgcctgttcctcagtgctgccttcgtactcttcttctacgcagctcttacaattacaatttattaataaaacacaaactcttgatgaca

SEQ ID NO: 58301 - DNA, 601 bp, Human
taaccagtgtatgaagttttaaactttaaaattaacttcatggaggtaaaacaaatgcttagaaacttctgaaactgtcctagaattcttatattctagtagtatccaggtgctggcgactcttatttaaacagaaaacttctgttctttgctaaaaatggtattttccatcattagataaaagtaaaaccaccagccttaaatttttcttttcctttaaaatcatgtaataccttgagaaatgccattgtaataccttatgtaaaattcccaatcatatttatgaaagttaatattattrctatcttattaagtcagccttttattataatgtttctacgtacttttagatgttttgttaaagtgacaacttttagtatgagatgtgcttttgttatgaagaataattcacaggataaaattttatagccacattttttgatttatttaaaagaattatttgataagggggaaactcattttgtgatactaatttaagatctgttgggtaattcttagaattgttcttctgactctgaaagctttttattaatagtctagaaagcatatgactgaggttttggttatagttgagacttct

SEQ ID NO: 58302 - DNA, 601 bp, Human
caataatggtgccaagttgttgtttcttcaggtgtaggaagcagaaagacaacaggtaccaagtaagttaacctgttgataccctaaaggagggaaggctgcatttggatttaggcttgcagatggtcagataatgcaaataaatcatttactaatatttcatttactcagaataagactttttttttttttttttttgctgtgggggagcacattttgacttttagtgaaggagcagcatgacattcttattccagtagatttttaagattcagtgatcaagattattaagtgaaaactrtaagaagtttcttctttttgccctactgccttgttaaattgtattgcagaatatattgtatatggtttagttttggaaatcatctaggggaggaaacagtaggattggattaaaccaataaagtatgaagtaaagtaaaaatgttggaggagatgcaaactaagctgagtcaggtttatgcaatagagtatttgatgagctgcagaccaagaatactttctaaactggaacttcattaaaaaaaattcatcaaatacttatttactagttgagtatatgctagttgcttacctacatgct

SEQ ID NO: 58303 - DNA, 601 bp, Human
cagaataagactttttttttttttttttttgctgtgggggagcacattttgacttttagtgaaggagcagcatgacattcttattccagtagatttttaagattcagtgatcaagattattaagtgaaaactataagaagtttcttctttttgccctactgccttgttaaattgtattgcagaatatattgtatatggtttagttttggaaatcatctaggggaggaaacagtaggattggattaaaccaataaagtatgaagtaaagtaaaaatgttggaggagatgcaaactaagctgrgtcaggtttatgcaatagagtatttgatgagctgcagaccaagaatactttctaaactggaacttcattaaaaaaaattcatcaaatacttatttactagttgagtatatgctagttgcttacctacatgctgaggttgcagagatgaatgagacttgattcttgccctcctaatatggagatagatatgttaaacagaaagttatggtgaatgaagtttctgaactctatacaggtttagaggaagagataatgcattctattaatatttgaaggaggtggggaggtaacacagggaac

SEQ ID NO: 58304 - DNA, 601 bp, Human
ttagaaagaatactctggtaggtaggagtaactaaaggtacaatacagtaaatggttaaggtgcaggtaacttagacttaatagtgttatgtctttttgtgagatggcattcattgaaaatatagatggacaaaagccatcttcatgaatgatttaaaggcttaatgcatgatttgtttttcatagtataaacctgatttaatgtacttttgacaactcctatttcccttctcatgtttggattattttttcccattgggaagttttttcctgtgcctcctacaaaacaattcttatgaamtagaagcagagagaagaattagggtattatgatatttgagatgagtaagctgagggccaaaacttaggcattaaagagaagggtttaatttcataaatatgtacagagtggaattttaggacttggatagggcagtggaaaaattaatatcatttgtaaaaaatgattgtaataagattgggaaaaacaaaaaaatgggaaaaaagtaagaaactagcaagattgggaaagaggtgcacagaagagaatgttctaggagaaagaccctaaatctttttggtcaggctgcttggctgtctg

SEQ ID NO: 58305 - DNA, 601 bp, Human
cctttcctttcctttcctttcctttcctttcctttcctttcctttcctttcctttccttctctctttctctctctttctctttctctttccttctcttttcttcttttctttctttttttttggacttgcgaggtcttagagtctggattctttgtatttgaagaattgaattaatgtaaaggaagtgaggcagattgtcttaaggttatcttttctagtgattaagatttttttcataagatactaattcattttgccagcccattttacactgctactttttctgtgtctcttgtgtaratgtatctctttgttttgtgttttctgaattttttaattatcaagtcttcagataagttattgtcctaaattttgtatctatttaataaccctaaacaattttcacaaaattacatttctcatctggttttacttcatgcaaatttggtaaagttaaactttttttggtgatttttattttagcctaataaggatgttgtggaacaaatggaaaaatggtaagagtttagttttctttttatattttgatgagttacttctaccaaattaactacattaattagagttttaaaattctct

SEQ ID NO: 58306 - DNA, 601 bp, Human
attacatttctcatctggttttacttcatgcaaatttggtaaagttaaactttttttggtgatttttattttagcctaataaggatgttgtggaacaaatggaaaaatggtaagagtttagttttctttttatattttgatgagttacttctaccaaattaactacattaattagagttttaaaattctctttaaactttgtaatggaagaaatgtagtatgctgttgatttgggattacattaccgtttgtgggtttcacgtgtggcagtaattttacttgttgaggctagcatataagmatgaattacttgagtacattttacttgtaaagaggaagtatcctcagaccatgatcaaagatccctagaagcctttctagaattaaaagtttataagaaatgatggacaaaagagttgatccatttaaaatgattagaaataatatcattaactgctgggcgtggtggctcacacctgtaatcccagcactttgggaggctgaggcgggtggatcacctgaggtcaggggtttgaaaccagcctggccaacatggcaaaccctgtctgtaccaaatgtacaaaattagccaggcatggtg

SEQ ID NO: 58307 - DNA, 601 bp, Human
gtttataagaaatgatggacaaaagagttgatccatttaaaatgattagaaataatatcattaactgctgggcgtggtggctcacacctgtaatcccagcactttgggaggctgaggcgggtggatcacctgaggtcaggggtttgaaaccagcctggccaacatggcaaaccctgtctgtaccaaatgtacaaaattagccaggcatggtggtgcatgcctgtaatcccagctacttgggaggctgaggcaggagaatcgcttgaacctgggaggcagaggttgcagtgagccgaaatcrtgccattgcactccagcctgggcgacaagagtgaaactctgcctcaaaaaaaaaaaaaaaaaaaaaaaaaaagagccaggcatggtggctgatgctggtaatccccagcactttgggaggccaaggcgggtggatcatgaggtcaggagatcgagaccatcctggctaacatggtgaaaccccatctctactaaaaatacaaaaaattagccaggcgtggtggcgggcgcctgtagtcccagctactcgggagggtgaggcaggagaatggcatgaacccgggaggcggagcttgcagtg

SEQ ID NO: 58308 - DNA, 601 bp, Human
ggacaaaagagttgatccatttaaaatgattagaaataatatcattaactgctgggcgtggtggctcacacctgtaatcccagcactttgggaggctgaggcgggtggatcacctgaggtcaggggtttgaaaccagcctggccaacatggcaaaccctgtctgtaccaaatgtacaaaattagccaggcatggtggtgcatgcctgtaatcccagctacttgggaggctgaggcaggagaatcgcttgaacctgggaggcagaggttgcagtgagccgaaatcatgccattgcactccarcctgggcgacaagagtgaaactctgcctcaaaaaaaaaaaaaaaaaaaaaaaaaaagagccaggcatggtggctgatgctggtaatccccagcactttgggaggccaaggcgggtggatcatgaggtcaggagatcgagaccatcctggctaacatggtgaaaccccatctctactaaaaatacaaaaaattagccaggcgtggtggcgggcgcctgtagtcccagctactcgggagggtgaggcaggagaatggcatgaacccgggaggcggagcttgcagtgagctgagattgcacca

SEQ ID NO: 58309 - DNA, 601 bp, Human
cacacctgtaatcccagcactttgggaggctgaggcgggtggatcacctgaggtcaggggtttgaaaccagcctggccaacatggcaaaccctgtctgtaccaaatgtacaaaattagccaggcatggtggtgcatgcctgtaatcccagctacttgggaggctgaggcaggagaatcgcttgaacctgggaggcagaggttgcagtgagccgaaatcatgccattgcactccagcctgggcgacaagagtgaaactctgcctcaaaaaaaaaaaaaaaaaaaaaaaaaaagagccaggcrtggtggctgatgctggtaatccccagcactttgggaggccaaggcgggtggatcatgaggtcaggagatcgagaccatcctggctaacatggtgaaaccccatctctactaaaaatacaaaaaattagccaggcgtggtggcgggcgcctgtagtcccagctactcgggagggtgaggcaggagaatggcatgaacccgggaggcggagcttgcagtgagctgagattgcaccactgcactccagcctgggcgacagagcgagtctctgtctcaaaaaaaaataataattataataataa

SEQ ID NO: 58310 - DNA, 601 bp, Human
acctgaggtcaggggtttgaaaccagcctggccaacatggcaaaccctgtctgtaccaaatgtacaaaattagccaggcatggtggtgcatgcctgtaatcccagctacttgggaggctgaggcaggagaatcgcttgaacctgggaggcagaggttgcagtgagccgaaatcatgccattgcactccagcctgggcgacaagagtgaaactctgcctcaaaaaaaaaaaaaaaaaaaaaaaaaaagagccaggcatggtggctgatgctggtaatccccagcactttgggaggccaaggygggtggatcatgaggtcaggagatcgagaccatcctggctaacatggtgaaaccccatctctactaaaaatacaaaaaattagccaggcgtggtggcgggcgcctgtagtcccagctactcgggagggtgaggcaggagaatggcatgaacccgggaggcggagcttgcagtgagctgagattgcaccactgcactccagcctgggcgacagagcgagtctctgtctcaaaaaaaaataataattataataataatatcattaactttgaaaaatagttaatacatgtgttacaaattta

SEQ ID NO: 58311 - DNA, 601 bp, Human
gcaggagaatggcatgaacccgggaggcggagcttgcagtgagctgagattgcaccactgcactccagcctgggcgacagagcgagtctctgtctcaaaaaaaaataataattataataataatatcattaactttgaaaaatagttaatacatgtgttacaaatttataatttcagcattcaagaaaaagatgagaagttaaagactgtggaagaattacttgaaactggacttattcaggtggcaactaaagaagaggagctgaatgtaaagcattttgtagttttgttttccttgtgwttattcagtgacataaaaggatttctctgtaatttgtgtaaggtttttcccatagatcttaaacttaatagtacctctcacatttataaatttatataatgcttttttaattaaagtttttttagaagttaaaaatgcataacattgactgccttaatgaggtagatactattgttatagtttgtcagtttccccacttgcaccaaaattataaccaaatgataactagcagacttaattcatgaaatagtactggaggccagagaagagattgccattctattttatggttgtcattag

SEQ ID NO: 58312 - DNA, 601 bp, Human
gtgcatttctatttctgacccatttctattttgaacaaattactaagtaggatactttcctatttccaggtttcttttgcctctctagttgaagaacttaagaaagtgtaagtgataacattattataaactggtttttcttctttggtccattttttttttgtgtgtgcttagaaatctagttttattgtgcagttgggacagctgatgtatgtttaactttcactctataatttttcttaatggaataagagaacttagctgtgctttcccaaattcagtataattaaaaaaaaaaaamcaaaaaaaaactatttccagaggatgggagtcagtatagttgaatggaacttgattctcctctgtattcctcagggtacaaatcttatatttctgatgtacttctgaagcacttaactgacttcttgtgtgcataggcttcagctgtctgttaggaggagctttatgttcaccctggccattctacaaagacatgttgctattttatttaaaatgggaaagggttgatttggagagccatttcattatttggtgctatttttatatcttggtgggtcttggtgatttctaatcaaattat

SEQ ID NO: 58313 - DNA, 601 bp, Human
agaacttgagattgtgtaagtatgctttaagaccacattttgaagagaaacaaacgtctcattattttccagggtgtgcttgaatataatgatgagtttcctgtacatcattaactttattgttaagtggaaattataattccagacgcaaataggctaagtctctgttgggtaaaataaaggttatttaaatgctttcagatacctggagactttatcctttccaaatccatcaaacccattttttcaattattctttctgcaaatataggctggttttaagttattttttaaaacaaartatgcaattattatagagattaaacttatttcaaatgaaaattagtatttgaattagatgttagtaacatctctgaattaaccaaaagataatcttagccataatcttgataatgaattttaaacctttctgtaattttaatttatttatagggaaaatggaacttgtcatattatcctgtgctgaataggaaaactgaatctagtcagcataagaggtgtcagtttctgtagatattaatcttagaaaatgttttattctagagagtctgttgtcttaaggtacagcaggttacaatgg

SEQ ID NO: 58314 - DNA, 601 bp, Human
gtcatattatcctgtgctgaataggaaaactgaatctagtcagcataagaggtgtcagtttctgtagatattaatcttagaaaatgttttattctagagagtctgttgtcttaaggtacagcaggttacaatggtgggaaagggtatctggacctgatctttttggccccctttaaaattgcttttaacaaatttttcttggtgataccattactctttattgatatttgttttaaagaagtgccccgttttaaactgtcaagatattgaggatatttattaggttattatctttctaaatgggagattactctgttcttggaagattactcatttgtacaattattgtttgtcttttggctatggtgtaactgtcgaggtgcttatctcttatttgcttggaaagcttagggcctcatttctggcctgtttatagtagagatatgtagaccattaaagtaggtaattttaggtatatttctgccttacattttttttttttttgccattttcttttttaaattaatagattttattttttgtggtggagaactttttatatttataggaaaaagagaaataccaattctccctattaaca

SEQ ID NO: 58315 - DNA, 601 bp, Human
ctatggtgtaactgtcgaggtgcttatctcttatttgcttggaaagcttagggcctcatttctggcctgtttatagtagagatatgtagaccattaaagtaggtaattttaggtatatttctgccttacattttttttttttttgccattttcttttttaaattaatagattttattttttgtggtggagaactttttatatttataggaaaaagagaaataccaattctccctattaacatcttgcattagcatggtacatttgttacaagtgatgagccaatagcagtacattgttatygttgttattaactgaagttcatagtttccattaggaaactatgtgggttttaacatgtataatgacatgtatctatcattacagtatcatacaaaacagttttactgccttaaaaatctcctgtgttctacctgtgtatccctccctcccttcctccacatcccggcagcaccccccggcaaccaatgatcttactgtcttcagagttttaccttttccagaatatcgtagttgaaatcatacagtatatggcttttctggtttggctcttttcttttctttttttttgggacagagtct

SEQ ID NO: 58316 - DNA, 601 bp, Human
cagtacaaaggttagacatattttgtaatttccagggtcaacaaattatgactaagattcttgggggcaaaactccttgcttttgaagtggtaatttttgcaacaatttgataaaatatagttttgttcttagtttttgttttagagtttcttcctagataaagccacatttgcttaagaaatgttaagtatgactgagtagaatgatcctagaaatatcttttaaaacaaacttctaagttggtataatatgggggaaaaaaagctggtatgtattgtttctgccatcttttttcttagrggtgatattggagtctggttttccttttttatgtactttagttaatgcagatctttgtaaaaaattctaggttgaaagaaaaggaaaatgaattgaagaggttagaagccatgctaaaagagagggagagtgatctttctagcaaaacacagctgttacaggtgaatatggtgacttaaaattaattattttgtaaattattgtctttgcatgctttaaaataatttttaactgctgccaaaaaatagagtacagaatgagtctccctcccacccagatactaggtgtcattattggcat

SEQ ID NO: 58317 - DNA, 601 bp, Human
ctactatttaaaagaggttttcaagttataattctgcttggtaaatcaaaagtgtgtttttataaaagatgctacccaaaatagcctgtaaattaatttatgcatgtatatggatagacttgatagtattttgagaaacaaatgaattggagtccttgcaaacaagaagcttgagagattattgtcaccaaggaataaataccatatatgaagggctgtgtacctttgcatgttgatgtataaataactttgttaaacgtgaggaaacataacttgtcctagttttgcttttgatttctgktttttttttttttttttaacttggaagcttaacagttttatgtagtcaaatttgaattgtgcagtttgaaaatgtaaggtgtgcttccatgcacatagtgggaaattgataaatacttattaaatgaagagttcaagtacgttgcgacagtagagattggatttagcattccatacattttacagatttgtacatgtttttattaaaatcacttgattaaagtcagggttactggcatatgaaatatatactatttttacttttgttgttttcttaatttatatttgagaaaagcttcaa

SEQ ID NO: 58318 - DNA, 601 bp, Human
gtaagtaataagtttgagtcacagtttataaagtcgtaactatttttatgtggtaaaccattctcaaataagcaatttagtgtaactgcaaatggcacctgatttttacagttctatttggatatcttgaattgcagtttagagttgagtagtacctttggctaagatgctttttttatggtatttggatttgaatattttgttgagggagatgtttgtttttgtttttttaggcattcagaaaacatcaaatcaagttaaactatactttgcagggttttctaaatcaccttctattatstcagttatcttactgggtcttctttcttctagatgtgattgtgtaattgaatgatgcaaattttgtcttagcttcattttttaaagaaattttaggatagatgtggtagctcacgcctgtaatcccagcagctggggagactgagacgggaggatcactgagctcaggggtttgagatcagcctgggcaacatagtcagacctcgtctctacgaaaagtttagaaattccgggtgtgatggcatgcacctgtggtcccagctactcgggaggctgaagtgggaggatctttttagcccag

SEQ ID NO: 58319 - DNA, 601 bp, Human
cctcttatatggacactgattctcagggaagagctatttgttatttaactttctactccagccactctcaactataacagaatcaaattatgaatctttgccattgccttctgcgtttctgggaaacagtagcagaaaaaaacatgaatgttgagattggtatgaaaatggcaggaaaacactgagctcattttaatattatacttttgttgtgggttagccatttaaagttataactgattcattgccctctggaaaaaaaaatatatttaagggactgcttctacatcagttttaactsctctaaaaatagctactgtgtactgacccaggtaaaactataaatagctacaacagttcatatcttcataatatgtttcttaggggatgagatttctctttagcacaagcctgagcataccatattaggcataaaaacttatattagaaatcatttctgaaattcataggatgggctttgtatggtcaacagtaggtagactctttaatgtacttttcaaggtgctatctcttgatatttttattttgtaatagcaaatgttgataggtagggatctaagttgtattactgtttacctaa

SEQ ID NO: 58320 - DNA, 601 bp, Human
aagttgtaccattgggtgtgaagatttctaatgaattgtaatagagaagttgtttttaaagattgagaaaattgaatctgccagtccagttaagtattttgaaaattcctgtcaagtgtaaatgtgaaacaggggtattgaattttgcagacaggtaaaagaaagaacctacatgattaattttagcactatgaaaatattttgtgtgccatggtactctattgaatctttaatataagtcttagtgacacctgaaggaatgtttaagcataaaatagttctgtaaattttttttttttttagcaagtatacgtttgtagttacatttcctgtagcttagtggatttgtatttaactatatccctatttatctagccataattttcagtaaaggttaaattcgagatagctgagaggtatattgggaccagagagtaggaaaatctaggtcagataggacatttcattattatttcactgggagtagttgcaattgtacagtcatttctgtcagcgatgagggttttagtgtggtttctggttgtttatattactttgtttttgatggttaagagccacctttttggttttatttttttag

SEQ ID NO: 58321 - DNA, 601 bp, Human
tttttgtgtgtctgattttgaattgttcctggacaggcaaatcacttgatttctaaatgccagggaaaatgtccatattgtcagatattgctaaggcattatttgatatttaggatgctttagagattttgcagattttttcttatgggagcattttaatatcttaaagtgggaaattttaatatttgttagtattaaaaattttttttaaactttttcttcccgtagaattataaaacactatagtttttttcttttctttttttaaaaacattctgtgatcttgtaagtttgatttggytcatcttctgctttaggaaaggcagcaacaggtggaagctgttgagttggaggctaaagaagttctcaaaaaattatttccaaaggtgtctgtcccttctaatttggtaagactaatttattatttttttaacatgatgacattattcaagaaaggtgtgaataagcaacatcatttgcactccacttggtttcagtagagtgctgatttcttgatctttcctattgttaagctggtgcttttcagtaaagattaataacttggttcaaaactcatttctatttacctgatactattgtt

SEQ ID NO: 58322 - DNA, 601 bp, Human
cattcttaatggctttatttaaaacttaattttaagtgattgcttcttagttttagcaacacttccttaatgtacttgatactatgaactaggctctttacattttaaaactcaagatttttggtcatctattaccttcttcaagcagaaatcttacagataatatagaacaacttggtttacttgaggtagtacatgttctcctttgttcagagaattaataattatttgagggcagagaaagtcagtgaatgtgcatgtgagtttcctaaaatagagtgtagggtctttttttttttttcttatttaatggaaaactgttcaacagtagagagacgagcataatgaggcctgatgtacccaacatctctccatagcacttatcagtacatggcacgcatataagcaatcttcttttagctcccaccttgcattccctagattattttgaaggaactcaaacatcagagcatttcttctgtaaatatttcagtacacatttctaaaacataagcatttctttttaaaaagtgtgatattacacttaaaaatacattcttaattttgtatagtatgcatttctccagttgtcataaattgt

SEQ ID NO: 58323 - DNA, 601 bp, Human
cttttagctcccaccttgcattccctagattattttgaaggaactcaaacatcagagcatttcttctgtaaatatttcagtacacatttctaaaacataagcatttctttttaaaaagtgtgatattacacttaaaaatacattcttaattttgtatagtatgcatttctccagttgtcataaattgtctgttttattaaataataacttactgtagtttgttttaatcaggatccgaataaggtcagtatgtaactggtttgagacatctcttagatattttttaatcctcgggttcccygactctttctcagcaacaccccacctcctttaaaaaaaaaacaaaaacaaaacttagtggtttcctatgaagtttcccacagtttggatttagttgactgcatccctgtggtgttagcatgttcctcttttctttatgtatcttttatgtatcaaatctgtaatcaggaatctgattcctggtcagattaaggctcagtattttgggggtagggtagagtaggggcaagaccacttcatgggcggtggtgtgcactttcatgaggagattcgtaatgtctgcttgtcttcctttggccca

SEQ ID NO: 58324 - DNA, 601 bp, Human
gattattttgaaggaactcaaacatcagagcatttcttctgtaaatatttcagtacacatttctaaaacataagcatttctttttaaaaagtgtgatattacacttaaaaatacattcttaattttgtatagtatgcatttctccagttgtcataaattgtctgttttattaaataataacttactgtagtttgttttaatcaggatccgaataaggtcagtatgtaactggtttgagacatctcttagatattttttaatcctcgggttccctgactctttctcagcaacaccccacctsctttaaaaaaaaaacaaaaacaaaacttagtggtttcctatgaagtttcccacagtttggatttagttgactgcatccctgtggtgttagcatgttcctcttttctttatgtatcttttatgtatcaaatctgtaatcaggaatctgattcctggtcagattaaggctcagtattttgggggtagggtagagtaggggcaagaccacttcatgggcggtggtgtgcactttcatgaggagattcgtaatgtctgcttgtcttcctttggcccattggaacttatttaggtttgttaccaa

SEQ ID NO: 58325 - DNA, 601 bp, Human
ttttaatcctcgggttccctgactctttctcagcaacaccccacctcctttaaaaaaaaaacaaaaacaaaacttagtggtttcctatgaagtttcccacagtttggatttagttgactgcatccctgtggtgttagcatgttcctcttttctttatgtatcttttatgtatcaaatctgtaatcaggaatctgattcctggtcagattaaggctcagtattttgggggtagggtagagtaggggcaagaccacttcatgggcggtggtgtgcactttcatgaggagattcgtaatgtctrcttgtcttcctttggcccattggaacttatttaggtttgttaccaagtcgttttgacacaatgctgctaaactttgatagcttctatgctttgtggtatgataaggtgctcctgatttatcatatacatttcctgccccaaacatagaatcaactatttctccaaggagctctgtgggtgctaggggtggggtaagtaaacttaatggcttgttctatttgtagtctgagttaagtatagcctacatttatttcaagtaaggagagaaaactcctttgtttccattgtaactatcgagga

SEQ ID NO: 58326 - DNA, 601 bp, Human
cagtaaccagatctttttgacactagaaatatttataagtcatcataataaatggatgatactgtttggcttttgttcatatacttgtcaaaagttgaatatttctgcatatagtctacaagaaatgtactaaactttctatgtgctaacattagagtctggcattttaggtttgtaaagatttgaaggacaataaactatttatgttataaaataataaagcaataagcttcattaatattaagataagtcaagataattagtagatataaaaatatataaatttttttactgtttcctyttgctgttttgctgagcagtcaacataggagagatctaaattatatgacctagaaggaaatttacaaactttaagcaacaaaactagttttttatcttattttaatttatgttgggtaccaatagttgaaactgttaagtaggattctgatagtgtacatttagtcttggttcagatttataatgtgagaatgttaaatagtgttttaaaactaatttgatattaaaggtattgtactatggagtgactcagcatctacttttgttttttgttatttgatagtttccagagaatcctgat

SEQ ID NO: 58327 - DNA, 601 bp, Human
ttttactgtttcctcttgctgttttgctgagcagtcaacataggagagatctaaattatatgacctagaaggaaatttacaaactttaagcaacaaaactagttttttatcttattttaatttatgttgggtaccaatagttgaaactgttaagtaggattctgatagtgtacatttagtcttggttcagatttataatgtgagaatgttaaatagtgttttaaaactaatttgatattaaaggtattgtactatggagtgactcagcatctacttttgttttttgttatttgatagtttmcagagaatcctgattctgctgcatatgtaacagtttatattatagcagttaataaaaatttcatgagtttttttcttaaatttaatccaaagacttaaaagaaggaataagaggaaatttgatttaaagtatgtaacacacagatacactttatcaaagtgtaaaattcagataagcatcaataatttagagtaatttattctaaaatttagaataaatgccaaaactgtaatacatgcatatttacatcagctaacctgtcagcacaaattgagtttttgttggatttaaacaagtgaa

SEQ ID NO: 58328 - DNA, 601 bp, Human
aaaagaaggaataagaggaaatttgatttaaagtatgtaacacacagatacactttatcaaagtgtaaaattcagataagcatcaataatttagagtaatttattctaaaatttagaataaatgccaaaactgtaatacatgcatatttacatcagctaacctgtcagcacaaattgagtttttgttggatttaaacaagtgaatgtgtatgcatatcacttctcattaggatttttaaaatactgaataatatttcctaatttgaatgaaataattttagagtccttggagcattttcayagaatttgaaatcctccaaatggaacatctttatgaactcaaaatacttcactttcactttatgaactcaaaatacttcatttttgagaactgatttacctggaaacagttttgaaaaattagtctgggttttttgtgttttaaagattatttgtcctggtgctagtaagtggtagaggccagatttgaacccaggtttttctacatgcaactgcagaattcagttgaaaatactcttggttaggtatataatattttattttgatggtaggtacataggtctgtttttagtgcttgttt

SEQ ID NO: 58329 - DNA, 601 bp, Human
tacttagaaaggttgaaatgtagtgtttccttataaaacactttgaaaccatttatcataatacagtattaagtactaaaacaaacttgaagcataaaactttctggtagaattatggagtttttctttatttcgttctttgcaggttctagagcacaagttgaaagaagctgatgaaatgcacacattgttacagctagagtgtgaaaaatacaaatccgtccttgcagaaacagtaggaaatgatttttaatctacattttgattttactttaaatcattaccttcttccttcatggcytaaatagttttatcttggcattagaacatgaatttttcaaaacaactatgcttttgtctgtaggaaggaattttacagaagctacagagaagtgttgagcaagaagaaaataaatggaaagttaaggtcgatgaatcacacaagactattaaacaggtatttacaaaagaaaagcttagagcagtggttctcgatgtgtggggcttgaaccagcagcatcagcatcaccatgcacattcttgggccccaacccagctaccaaatccaaaacatgtatgtggggtggcagcagtctgtgtt

SEQ ID NO: 58330 - DNA, 601 bp, Human
taggaaggaattttacagaagctacagagaagtgttgagcaagaagaaaataaatggaaagttaaggtcgatgaatcacacaagactattaaacaggtatttacaaaagaaaagcttagagcagtggttctcgatgtgtggggcttgaaccagcagcatcagcatcaccatgcacattcttgggccccaacccagctaccaaatccaaaacatgtatgtggggtggcagcagtctgtgttttcatgagccctccagaatagtctaatgcccacccaagtttgaaaatcactggttttaaartatgactaaagggtaatcatatagaatgtagaatgctagttacagaactattgtgtgataaggtaaagaatactgggttcaaaatcagttttaaagtatttaacccataatatagaattcaagaaaaagtcattcttctattcctgggacctgaatgttattttgcaaccttaatttttctcccttttacttcagcgtgataaagagtaccattactcacttattttttggggccaatgtgcagaatttacagttgctgatggtactctaatgcacttgcagaataaatacagctgaata

SEQ ID NO: 58331 - DNA, 601 bp, Human
gtatagattaagaaagcctttaaaaactaacgggtaaagtatctatttggcttttaatttgaaataatttcagtgactgttataaatagtgatatctttaaaaggtactttactggaatttgatggttttgtttttgcatttgcagttttctactctaaactgtagttcatttctgtggcttttcttatgtttagctttacagatgggaacctctactgcttagcctttctatacatctggtgcagcatattggctaatccactgtacataataactgttagcagtcccattcattcttcrgtcctagaggtatcagcataatcaaagaatgatgcaaattaagttaattgtggtgttcctttatttttacagttgaaggcacagttaaatgaaacactcacaaaacttagaactgaacaaaatgaaagacagaaggtagctggtgatttgcataaggtaggcactgttcgtcctagagatgtagtatcatgagcctgtgttgtgtgttcaatcttaagcaaacttatgctgctaattctggatttgttgttttgcatcataatattaaccttttataaatttaagctgcttgttattagt

SEQ ID NO: 58332 - DNA, 601 bp, Human
acctcattatttcctcacatttctataattaattgctttataaagtacagagtaaaatttagttggagttattaaaatttggctgcatccatatattttttaaaattgggatttggctgtgtattcatttacaaagtatgtttctcttggtcttttggataaaacaaagatataaatttctattttttttagatgtttttccttcatttatttcttcatacaaatatatttttcctaatctcaatgcaaatgaatgatttttaggactgcatttctttgcattggtttgacaggttatttrtaattctgttttgagatctatttttaatagtagaattcacatattcttatatcaaagctgttttagagctatgatagtgtttatggatatatcatcattagcaaaacaagtgtcactttttggaattgcaagaacaagaggtacgcacttaaattttgatagtataaaatggaatcccagaaacccaacagtagtaatttatactcctctcaacatggtatgagaacatgtatttccctataccctcaccaatattagatactgtctaacatttaaatatttgatattctaatagatttt

SEQ ID NO: 58333 - DNA, 601 bp, Human
agagtatagactctggagctagactgcctatgtttgaatcctggctctgccacttagtagccatgtgaatttgggcagatctttagccactttgtgctttagttgccccatctgtaaaaggcaatgataatagtacctatcctgtagggtttttgaaagaagtaaatgagttaatacataaaacacttaaaatagtaggtggtacttacaacagtgcctggcacttacttactaagagctcagtatatgttaactttttttactgtttggaatgtactttcttttgcggggcaaattttcyttttctgaaagaaaaaatggatatatttctgatattcatagattctagattttttttccttttgtgtccaagtgacaacatttataacatagttttctttggtgccaactagtttgcaccactagttagcaaacagtatttctctatgtggtttttgttattgttgattttcatgtcattgttcagattttttaatgtttgtgtttaaatcagcaatataacattttctgttgtttggttttacatttcttttccttgtgtatggagtttatcatcacttccatcttctttttaggagtc

SEQ ID NO: 58334 - DNA, 601 bp, Human
agtatagactctggagctagactgcctatgtttgaatcctggctctgccacttagtagccatgtgaatttgggcagatctttagccactttgtgctttagttgccccatctgtaaaaggcaatgataatagtacctatcctgtagggtttttgaaagaagtaaatgagttaatacataaaacacttaaaatagtaggtggtacttacaacagtgcctggcacttacttactaagagctcagtatatgttaactttttttactgtttggaatgtactttcttttgcggggcaaattttcttyttctgaaagaaaaaatggatatatttctgatattcatagattctagattttttttccttttgtgtccaagtgacaacatttataacatagttttctttggtgccaactagtttgcaccactagttagcaaacagtatttctctatgtggtttttgttattgttgattttcatgtcattgttcagattttttaatgtttgtgtttaaatcagcaatataacattttctgttgtttggttttacatttcttttccttgtgtatggagtttatcatcacttccatcttctttttaggagtctt

SEQ ID NO: 58335 - DNA, 601 bp, Human
atcctggagaccctgaggggcaactcatcactgaattatccctttcagaacccctgataatactgtgttgggctatacaaggcctcagggagagcttaggtatcctggaaaagttgggatggacttccattttgatcttacaggagcgttttgtctcactttagagtgatcatcctctggcctaccttgacacatgctctccttcaaaatgctaattcaggtcagttatctctaacatgactttccatataataagcccagctcattcttcaacatatcaacaaaagtaattaagcctcakctcaaatcttttatccttggtaagctgacttctccagtttcccaatgtaaaaattctgccacatttcctcgcttttccaaattaggaaataaccttgcttcctagggaaacttccatcgcttcttcccaggacttcagccttattctttccactggctccctctgttcagtcttgaaaacatgctcagatggcttattttaaccttgtacttccttcaggttaccacccttatttttttacttttttactatttagtattcttaagaaaatactctctatctacttatttattgttattg

SEQ ID NO: 58336 - DNA, 601 bp, Human
agaaaatactctctatctacttatttattgttattgattactttatacactctagaatggcttttcttcctgctatttcaatgaaatcatttttgcaaaaatcattaatgatccctaattgctagatccaatataggcccttcttttgcatgtgatcagatactgaaagtacttaatgaaatatgtcaaaaatgctgacattagacctttgtcttataagggaagggtttcatttctagagagcttaaacaattaaaagattgcctattaccccttgcctttcgacctaagcgatattctstctttagcatctcatagatgttctttaatattttccttttcttcctaaatacatagtctgctcattttaagtcttgtgaactatttttggcttgtccattgccacatttgttttaattgtattacacttgagacatatgaatcattgataataacactttttctttttgatttgcagaattatagtaatttattaaaatatgtctgtataccctcacaacgcagttggcaggcagctcccctcctaactgatagcacaacattcttttgtcagctgataaacataagtccaagtttggca

SEQ ID NO: 58337 - DNA, 601 bp, Human
tgatcagatactgaaagtacttaatgaaatatgtcaaaaatgctgacattagacctttgtcttataagggaagggtttcatttctagagagcttaaacaattaaaagattgcctattaccccttgcctttcgacctaagcgatattctctctttagcatctcatagatgttctttaatattttccttttcttcctaaatacatagtctgctcattttaagtcttgtgaactatttttggcttgtccattgccacatttgttttaattgtattacacttgagacatatgaatcattgataayaacactttttctttttgatttgcagaattatagtaatttattaaaatatgtctgtataccctcacaacgcagttggcaggcagctcccctcctaactgatagcacaacattcttttgtcagctgataaacataagtccaagtttggcaagtgggtggttgacagtattatatcatgaatgataggctggattgttatgaaaatagaggcccaccaggcactctcgaacttcttcattccttaggctctacctggcattgacattgataattcttccttgtgtacttatgttttggttccc

SEQ ID NO: 58338 - DNA, 601 bp, Human
tgataaacataagtccaagtttggcaagtgggtggttgacagtattatatcatgaatgataggctggattgttatgaaaatagaggcccaccaggcactctcgaacttcttcattccttaggctctacctggcattgacattgataattcttccttgtgtacttatgttttggttcccgtagctcttctttatacccgttaaatgtttgtgttaccctcaggtttttatccttagctatcatttttgctacatatattctccctcctgtatactctatttaaactgacacgagatgattamattgaaaatacacatttctcaatcattagaatgtaggtaatagcttaatatatctaatgtcaagaaacctttaaaaatatacacaagtacttatgaattgtttatgataatgctgcacatattcaataaagggagagttgtttttaaaaacaaatatgcaagaaataatatgcattgatgtagtttttctaaatcctgatacatagtacttagcgtttcttagagctgtaggggtaggtgtatttaactgatatctttaatttgtgaaaacttttcttttggaaatttttttccccatta

SEQ ID NO: 58339 - DNA, 601 bp, Human
tgcctgttagcataagcatgcttccaacatgtggcaactcctttaatcttcacaaccaccctgtgtgttaggtaggtaggtattattattaccatgttacaacagacccaaagagattctataacttgtccaaggtcatacggctaataaatgggcgagctggggtttaaatcaaggtaatttgggtacagggcttgtgttcttaatcagtgcttttcttctccctaattcaggcactgtgttcactgatcccttttgtcactgttttcttttctcctcattttgtctttttatttttttwtggccagcctcttagaagttttgtcaatcaattctgactttttcctaaagttgatatttggtttgtcagtagcgtattggagaggcttacagtagtatccagaagaaatggaggtgaagctctgtgtgtactctctgtactccctttaacaaatagattcttaagtgtttctgaaagaaaaagtccttttgtagggctcctgaagtacaagagttaatgctctggagaaaaacttatcttatttctacactgaaccttagctatcatatggatcaggttttcattttctgtgtttacata

SEQ ID NO: 58340 - DNA, 601 bp, Human
agaaccctgaataataccaacatgtggccagctgcagaggctcacgcctgtaatcccagcactttggggagctgaggtgagaggactgcttgagcccaggagttcaagaccagcctgggccccataggaagactcccatctctaaaaataaaaataattagccaggtgtggtggcatgtgcctgtggtctcagctacttgggagttggaggcagaaggatcacttgagcctgggaggtaaggctgcagtgagccatgatgtgccactgcactccagccagggtgacagagtgagatcctgyaccggggggggggggggacaaaaacaaaaacagaaaaacaaatcaacatgaaggaatgggaagaggatgaggacaaggagaagccagagaagcagatggagcatcaaacgtcaaggaagctcaagggagggtttctaacacgagtgttgtagtcaaaactacaacagctgctggaattgacgagcttgtcggtgaccttggttagaatggtcttacaagtgtgcttaggataggggtccccagcagtgggttggctggtaataagaggccatcaagtggaaacagtgagtgtaaataacc

SEQ ID NO: 58341 - DNA, 601 bp, Human
agcaaccaaccaatgtcattataatccttgttttcccaaaaatatttgaaaatatcacatatagcgtcactaaattctttgcctcttataagcagtgaattagaataaaaaggcatttattttgcatatctataaacagtttgtgtcatggacttccagtgctctctctactattagaagtagagctcttggcatttttagattctaatcagattaaagaatcaattccaaaaaccccaattaaggaaactcatctttaatattctgtttcccagaaccattcctggtaccaaaatctgtrttagtattggtctgtctctctggagagccctgaccaatagagtaataaattcaattctggatatagagtagtccacccttatccctgggagctacattccaagacccccagtggatgcctaaaaccgcaaacagtaccaatctctatatatactattttttcgtatacatacatacatgtgataacatttaatttatagatcgggcatagtaagagattaacagctaataataaaatacaacaattatagcaataaactacaatgaaagttatgtgaatgtggtctctctctcaaaatat

SEQ ID NO: 58342 - DNA, 601 bp, Human
tgctagggcatgcaccactggagctgggaatgctggccttgggggtagggactaggtctggccagctctctcaaacagtgctgacaatggtgacttgcaaacatggtatccaacagtgaaactctgaagcagtcctatcaaagtcagacattagacaagtgtgaccaactgccattgctatttttacatttaacccctctgctaatagtatgagacgggccagctacggtagcaagattcttgaatggaaaaaaaaaaaatccatccttatcacattgatttgaaacacacataaacaaayatcctaaatccttatatataagctcagaggggccttgctgcagaggttcccgttcttaattcagagtagcaggcccaggacttacacactctacttactggctcccaaagaggctgcctcgctagctatgcattctagggtgtcttctctgctacacacctccctacccatctcatctagacagtggatcacaggttggtacagaaataacacctcagttaggcataatatgaaaaaagatggctttgttttccccactctttgctatcaatgcagttccattacatattggctatactg

SEQ ID NO: 58343 - DNA, 601 bp, Human
gtttctgaaccagactaggacataattaagtaaatggtttagaaatataagtatggcagcaatatggcaaaaggactgggaaatgaggaagcctgaaggcaaggtgagcagttaagaagctctttgtttatactggtgttaacaatatcctcggcacaatgatttccttatcatctatgacaagatgatagcatctattaacaaatcaccccaatatggaatactcccattgagacagaatcccactgtaaaattaatttagttgttagaattgaacacgtagacctgctagggcatgcamcactggagctgggaatgctggccttgggggtagggactaggtctggccagctctctcaaacagtgctgacaatggtgacttgcaaacatggtatccaacagtgaaactctgaagcagtcctatcaaagtcagacattagacaagtgtgaccaactgccattgctatttttacatttaacccctctgctaatagtatgagacgggccagctacggtagcaagattcttgaatggaaaaaaaaaaaatccatccttatcacattgatttgaaacacacataaacaaatatcctaaatcctta

SEQ ID NO: 58344 - DNA, 601 bp, Human
tcgagcaacagtggtatctctctcttttttttttttttttgagagagtctcgctctgttgcccaggctggagctggagtgcagtggcgcgatcctggctcactgcaacctccgcctccagggttcaagtaattctcctccggagtagctgggattacaggcatgcaccagcacgcctggctaattgttttgcatttttagtagagacggggtttcaccatattggccaggctggtcttgaattcattcctgaccctgtgatccacctgcctcagcctcccgaagtactgggattacaggcrttaagagccaccgcggctggcccagtatctctatttttaaaaatattcactaccctatattaatttaacagatagacaaaaaaaaaatcccttaattccctcactcacctactataatgactggggttttcatacacacacacacctctaacacattcacacttgtgtgccaatcatatatatagtttttaaaaacaaaaataggaccatgcaattttgcaacacgttcttttaactccatattgtgaacatcctgacatgtcaacaaatgtatttcaacattattcttaatggctgcat

SEQ ID NO: 58345 - DNA, 601 bp, Human
cagaatgctgtttactggggaggtaatttatctctagtaattcagttaacgcaagggtaatgttagaatgtttttagtttttatgagatacaagttcaccattaaggaaagcagtaaaaaaaaaaaaaattcattgataatctttattattcacataaaattaagatttttatgaagggttttacaatatttacaacacaacctaaagagtttctttaagctctactattatgattatgatggcaatttctggagaaaaatattaataaagtctgagtccctaacacaaatacaccacatraagaaattcaaattttcaccctattcccttttcaggtatagtaagctagatcttactataactttgagaaaaaacactcagggctttgacaagaatcccctaaaatgaaagatggaaaaaaatctataaaaaggcataaacgacttagagattaagtttctcaagactatcatgtatgatgttacttcatccaaaattattttccatctcactacctgagtctttttcgtcttgtctcactgtgttgcctcaaattttaccaattaagtgatttactggatttctctagcattttttttt

SEQ ID NO: 58346 - DNA, 601 bp, Human
aggtccccagatcttcacggtcaggctctggccaagagggcccatgtgcagagactttaaataggactctaagagaagcctcaggtatgatcaaaggctcagccagatttagcaattacagtctgaagcagctcacagcatagggaaaagccaaaaatccattagtctctgcagaatgaattattatgccccaaagtaaagatgtgttgattagcagtttcttaaaaataaaacaactaggaaacatcaccaagaaatcataacttgagtgtgactgaggtaaatgaaagccagcccttamcccatacactgtggagtaatacagggctcacttgaacagtggtctgctggggacaaaaggaaaaacgggtcaagaaaatattcttcgctaggcaggaggcaaacccccagggcaatgcagagggctgcactgtgagcaccgatgggtctatcaaggctgtcagtcttgaggatgtgtcccaagaatggccacattccttggttctgattctgtcctcatcaagcagccttctgatgcaattatctttcaatgcaaatttttctgcaagggaaagaacgcactgagcagctggcggctgac

SEQ ID NO: 58347 - DNA, 601 bp, Human
gcatgtggctgtgtcctaatcaaattatttctaagaaaaaggagcaggccggatctgacctgagggccagtttgccacccatcacactaggtccccagatcttcacggtcaggctctggccaagagggcccatgtgcagagactttaaataggactctaagagaagcctcaggtatgatcaaaggctcagccagatttagcaattacagtctgaagcagctcacagcatagggaaaagccaaaaatccattagtctctgcagaatgaattattatgccccaaagtaaagatgtgttgattrgcagtttcttaaaaataaaacaactaggaaacatcaccaagaaatcataacttgagtgtgactgaggtaaatgaaagccagcccttaacccatacactgtggagtaatacagggctcacttgaacagtggtctgctggggacaaaaggaaaaacgggtcaagaaaatattcttcgctaggcaggaggcaaacccccagggcaatgcagagggctgcactgtgagcaccgatgggtctatcaaggctgtcagtcttgaggatgtgtcccaagaatggccacattccttggttctgattctg

SEQ ID NO: 58348 - DNA, 601 bp, Human
gcagaaataggcagatgagatcagaactggcacctctgggtgaattctccgaacccaccagaccctgagcctactgttagcttggtgcatgatctcaccgaaggctccagcttgccctgggaaacaggtcctgtttctgtttccatcttagagatgaggaaacaggctcagcaaaggcaagcagccttctcaaggtctcacagcaggtcccggggaagccgggctccggttcttcagagccccgcaccgggtgggctccaggaagtgcctctgagtttccatttcctccctcgtaaaaaarctgagataacaatcctttccctgcggaccatccggaaggctcccaggccccactgattccctgtgaaacctcttagcccctggagaaggagctgtcggcccctttcttgaccacccccaccccaatccttcgcctctgctgtccgctggctggccggctggcatgtgctcgctctccctctctctctctctcccctccccctccctgttttcctccttccctcactttctttccccctcttcatctctcttcgtttctcaccctttctctctccatccctctccaagctctttctctctt

SEQ ID NO: 58349 - DNA, 601 bp, Human
aaggtctcacagcaggtcccggggaagccgggctccggttcttcagagccccgcaccgggtgggctccaggaagtgcctctgagtttccatttcctccctcgtaaaaaaactgagataacaatcctttccctgcggaccatccggaaggctcccaggccccactgattccctgtgaaacctcttagcccctggagaaggagctgtcggcccctttcttgaccacccccaccccaatccttcgcctctgctgtccgctggctggccggctggcatgtgctcgctctccctctctctctctcycccctccccctccctgttttcctccttccctcactttctttccccctcttcatctctcttcgtttctcaccctttctctctccatccctctccaagctctttctctcttctcctctccccatctctctctctcctctccgtctttctctgtatacctgtctagctccactgcctcccccgcttggcctcctcggggaatgcgggtgcaccacctgggcccccagctgggccggctcccctcccccagctttcttccctgcccatccgtgtgtccatgtccgccaggcagccccacgtagt

SEQ ID NO: 58350 - DNA, 601 bp, Human
ttggcctcctcggggaatgcgggtgcaccacctgggcccccagctgggccggctcccctcccccagctttcttccctgcccatccgtgtgtccatgtccgccaggcagccccacgtagtggagggggaggggagcagagggacggcagcctggctgtctcctctcattagggaagggggactgggcagaggagaagttggggggtgggtatatagagaggctggagctacaaggatgggtacagaggccaatagagggaagcggtcagacacagatttaggaatggggtcagagacacgtstaggaatggaatcagaggatagaaggggagtgaaatgccggcacagggtcgggggagtgaaataccgacacagggatgaggctgaaagacactggaatgggacggaggagggtgggggaagggagctagacatagataccagatgaaggcagggacaggaaaaggaaaggggtttggtgacaggcagggagccccaaagactccagctgtgggacagcagaggtgccgtgacccacggaggtcagggtacagggggcctcaaggccagcgacatgtgggggccacagggagtgatgaaca

SEQ ID NO: 58351 - DNA, 601 bp, Human
ttcttccctgcccatccgtgtgtccatgtccgccaggcagccccacgtagtggagggggaggggagcagagggacggcagcctggctgtctcctctcattagggaagggggactgggcagaggagaagttggggggtgggtatatagagaggctggagctacaaggatgggtacagaggccaatagagggaagcggtcagacacagatttaggaatggggtcagagacacgtgtaggaatggaatcagaggatagaaggggagtgaaatgccggcacagggtcgggggagtgaaataccgwcacagggatgaggctgaaagacactggaatgggacggaggagggtgggggaagggagctagacatagataccagatgaaggcagggacaggaaaaggaaaggggtttggtgacaggcagggagccccaaagactccagctgtgggacagcagaggtgccgtgacccacggaggtcagggtacagggggcctcaaggccagcgacatgtgggggccacagggagtgatgaacacagaagggacagggagctgggcacatgggccagctcccccgcccctgcctgggacgctgttacatttt

SEQ ID NO: 58352 - DNA, 601 bp, Human
aaagacactggaatgggacggaggagggtgggggaagggagctagacatagataccagatgaaggcagggacaggaaaaggaaaggggtttggtgacaggcagggagccccaaagactccagctgtgggacagcagaggtgccgtgacccacggaggtcagggtacagggggcctcaaggccagcgacatgtgggggccacagggagtgatgaacacagaagggacagggagctgggcacatgggccagctcccccgcccctgcctgggacgctgttacatttttaatgtcccagcagtgytgacaaatggagcaggaaggggaggagaagaggggacccagcaagatgggccaggctgtgagaaggtgtgtcagaaatatggggagacagggcactggagacccaggaggcagggagactccacagtcagagacagaaacagagacgtagaccagaaggcttgtgagaagagaaccccaggaatcaaggcagagagccaggttccagacacagggagacccagacggagaaagagaccggagatgtcagacatacagaggaaagaggaagagagtgactaacggggacagggtatcttct

SEQ ID NO: 58353 - DNA, 601 bp, Human
aggcttgtgagaagagaaccccaggaatcaaggcagagagccaggttccagacacagggagacccagacggagaaagagaccggagatgtcagacatacagaggaaagaggaagagagtgactaacggggacagggtatcttctcaggctaatgaaaatgttctataattgctcgggtgatggatggctaactctgaatatacaaaagccactgaactgtacactttaaatgggtagattgtatggtatgggaataatgtctcaataaagctgttacaaagagacagagaatataagaggsacagagcagagaccagagactctgggggacacagataagagtgacagaggccaggcacattggctcataccagtaattccagcactttgggaggctgacgcaggagaatcgtttgaaccgagttcaaggctgcagtgagccctgattgcactactgcactccagcctgggccacagagcaagaccctgtctcaaaagagaaaagagtaacagagaccccaagagagaccctgggaattggagacacagagggacagggaccctaagaactagacacagagagagatagaagaggccccgg

SEQ ID NO: 58354 - DNA, 601 bp, Human
cgtccccacagccccgaccctgatcccggcgcctccccccgagacccctgccccactgagggctctttcttttttcttttttttctttttttgagacaagagtctcactctgttgcccaagctggcaatagtgtctcactctctcactctgtcttccaagctggtacagtggtgtgatcttggctcactgcaacctccgcctcccaggttcaagcaattcttgtgcctcagcctcccaagtagtggggattacaggcgggtgccaccatgcccagctaatttttgtatttttagtagagaygggctctcaccgtgttgcccaggctggtctcctgagctcaggtgagccactgcacccagcctgtgagggttttttctttctctttttgttttttttgtttttttttgagacatggtagccaccacctgtaatcccagctactcaggaggctgaggcaggagcccgagacagagcaagactccgtctcaaaaaaaaaaaaaaacagaaaagacttgggcttgtttcctgagggctctgtgcagaggagggcgtgttctgcactttctagcaggatccttctagctgtgcataggaacaaac

SEQ ID NO: 58355 - DNA, 601 bp, Human
ggcctcccaaagtgctgggtttacaggcgtgagccaccacagctggcccttttttttttttgagatggagtctcactctgtcccccaggctggagtgcagtgctgcaatctcagctcactacaacctccgcctgctaggttcaagtgattctcctgcctcagcctcctgaatagctgggattacgggggcccgccaccacgcccggctaatttttgtatttttagtagagacggggtttcaccatgttggccaggctggtctcaaactcctgacctcgtgatccgccctcctcggcctccsaaagtgttggaattacaggcgtgagccattgcgcccagggattttagaacctcattcattcgttattcagcaagtactgagcatctactaggtaccaatctctcttgcagatactgagggtacaggttgtgagcaaaacagacagaagatccctgccctcgtggcgctggcagtcagtttccaggaggatgtgatatatctagtgtgtgagatggtgagaagcactatgcagacagagaacgtaacagggcaaaagggcggaagagcagtcaaccagggaggggagaggaggtggcagct

SEQ ID NO: 58356 - DNA, 601 bp, Human
tcctcggcctcccaaagtgttggaattacaggcgtgagccattgcgcccagggattttagaacctcattcattcgttattcagcaagtactgagcatctactaggtaccaatctctcttgcagatactgagggtacaggttgtgagcaaaacagacagaagatccctgccctcgtggcgctggcagtcagtttccaggaggatgtgatatatctagtgtgtgagatggtgagaagcactatgcagacagagaacgtaacagggcaaaagggcggaagagcagtcaaccagggaggggagasgaggtggcagctgaggtggagtatctcggggtaaaagaaccccccgaggagtgtgccccacaagaagctaaaagtggtgggtttgtttgagaccgagtcctcactctgtcacccaggctggagtgcagtggcgcaatctcagctcactgcaacctccacctcctgagttcaagcgactctccctaaagtagctggaattacaggcatgcagctaatttttgtatatttagtagagacagggtttcactgtgtcggccaggctggtctcgaactcctggcctcaagtgatccatccacctt

SEQ ID NO: 58357 - DNA, 601 bp, Human
gtactgagcatctactaggtaccaatctctcttgcagatactgagggtacaggttgtgagcaaaacagacagaagatccctgccctcgtggcgctggcagtcagtttccaggaggatgtgatatatctagtgtgtgagatggtgagaagcactatgcagacagagaacgtaacagggcaaaagggcggaagagcagtcaaccagggaggggagaggaggtggcagctgaggtggagtatctcggggtaaaagaaccccccgaggagtgtgccccacaagaagctaaaagtggtgggtttgyttgagaccgagtcctcactctgtcacccaggctggagtgcagtggcgcaatctcagctcactgcaacctccacctcctgagttcaagcgactctccctaaagtagctggaattacaggcatgcagctaatttttgtatatttagtagagacagggtttcactgtgtcggccaggctggtctcgaactcctggcctcaagtgatccatccaccttggtctcccaaagttctgggattacaggcttgagccaccgccccatcctaaagtcggtttttttgttttaatcctccaaatccagta

SEQ ID NO: 58358 - DNA, 601 bp, Human
taaagtcggtttttttgttttaatcctccaaatccagtagtgctcagatgccatcctaaatggaggattggaggggagcctcccttagaaggaagatctgggcccctggaagccacaggactgctccttaagtcaagaactctgaatctggccaggtgcagtggcttatgcctataatcccaacactttgggaggccgaggcgggtggatcacttgaggtcaggagtccgagactagcctggctgacatggcgaaaccccatctctactaaaattacaaaaattagctgggtatggtggtrcatgcctgtaatcccagctacttgggaggctgagacaggagaatcacttgagctggggaggcggaggctgtagtgagcccagattgcgccactgcactccagcccgggcaacagagtgagactccacctcaaaaaaaatttttttaaaaagaactctgagttgccgggcgcggtggctcacgcctgtaatcccagcactttgggagtcccaggcgggcggatcacgaggtcaggagatcgagaccatcctggttaacatggtgaaaccccatctctactaaaaaaattagccgggcgtcg

SEQ ID NO: 58359 - DNA, 601 bp, Human
tggtgcatgcctgtaatcccagctacttgggaggctgagacaggagaatcacttgagctggggaggcggaggctgtagtgagcccagattgcgccactgcactccagcccgggcaacagagtgagactccacctcaaaaaaaatttttttaaaaagaactctgagttgccgggcgcggtggctcacgcctgtaatcccagcactttgggagtcccaggcgggcggatcacgaggtcaggagatcgagaccatcctggttaacatggtgaaaccccatctctactaaaaaaattagccgggygtcgtggcgggcacctgtagtcccagctactcgggaggctgaggcaggagaatggggtgaacccgggaggcggaggttgcagtgagccgagatcgcgctgctgcactccagcctgggcgacagagcaagactccgtctcaaaaaaaaaaaaagaactctgagtcagcctggcgcagtggctcacacctgtaatctcagcactttgggaggccgaggcgggcagatcacgaggtcaggagatcgagaccatcctggctaacacgatgaaaccccgtctctactaaaaatacaaaaaattag

SEQ ID NO: 58360 - DNA, 601 bp, Human
ggtgaaaccccatctctactaaaaaaattagccgggcgtcgtggcgggcacctgtagtcccagctactcgggaggctgaggcaggagaatggggtgaacccgggaggcggaggttgcagtgagccgagatcgcgctgctgcactccagcctgggcgacagagcaagactccgtctcaaaaaaaaaaaaagaactctgagtcagcctggcgcagtggctcacacctgtaatctcagcactttgggaggccgaggcgggcagatcacgaggtcaggagatcgagaccatcctggctaacacgrtgaaaccccgtctctactaaaaatacaaaaaattagcagagcgtggtggcgggcgcctgtagtcccagctactcgggaggctgaggcaggagaatggcatgaacctgggaggcggaggttgcagtgagccgagatagtggcactgcactccagcctgggcgaaagagtgagaatctgtctcaaaaaaaaaagaaaaaaactctgaatcccagagacccagggacttggaggaggtgaagggtgtggggctccagggacctggggctcagcttttcaggtctcctcctccaggaagctctt

SEQ ID NO: 58361 - DNA, 601 bp, Human
ggttcctcccataccacccctactccgtcttccaggcattcttggtgataattatttgtgcaatatttgtaccccctgcaatctggatgtcaaccctggaaaacaagcacctgatttgtcctgttacttctgcagcatccacacttagcaacattcattcacttggcagtgtttactgagcacctactacatgctaggccctgttgtaggtgctggggatacagtaggggaaaaacacagacaaacctcagggctggagagggcagaccctctagcacccaggacctgtttgttgagtaastatttgttttttggatttgacctataagatgtgaaagaacagccagattcttccaggttctgccttttcctgatccctccctctctccctactaccaaatcccttccattttaaaattttaaatcctggtggggcacagtggctcacgcctataatcccagcagtttgggaggctaaggtaggcagatcacctgaggtcgggagttcgaggccagcctggccaagatggtgaaaccctgtctctactcaaaatacaaaaattagctgagtgtggtgacatatgcctgtaatcccagctac

SEQ ID NO: 58362 - DNA, 601 bp, Human
aatcctggtggggcacagtggctcacgcctataatcccagcagtttgggaggctaaggtaggcagatcacctgaggtcgggagttcgaggccagcctggccaagatggtgaaaccctgtctctactcaaaatacaaaaattagctgagtgtggtgacatatgcctgtaatcccagctactcgggaggttgaggcagaattgcttgaacccagaggcagaggttgcagggagccaagatggcgccactacactctggcctgggtgatacagcgagaatgtgtttcaaaaaaataaaatcctragacctattagcctcctccccaacactcagtctcagtcttaacctcttgttcttttcattgccaactttttgtgtcattttgctgtctggtcatctatctctgctcagcccaccaccttcccctcaggcctccttggatgaagttaagtcattctctatttgaagaacccgcaacggctcccacttgccacaaagaggaaactaacttcctcggccccagcctactttgctgtctctgcagttcacacaggcccaaatggctttccttgaccctcattgagtggccttccccccttgcct

SEQ ID NO: 58363 - DNA, 601 bp, Human
aaattagctgagtgtggtgacatatgcctgtaatcccagctactcgggaggttgaggcagaattgcttgaacccagaggcagaggttgcagggagccaagatggcgccactacactctggcctgggtgatacagcgagaatgtgtttcaaaaaaataaaatcctgagacctattagcctcctccccaacactcagtctcagtcttaacctcttgttcttttcattgccaactttttgtgtcattttgctgtctggtcatctatctctgctcagcccaccaccttcccctcaggcctccttrgatgaagttaagtcattctctatttgaagaacccgcaacggctcccacttgccacaaagaggaaactaacttcctcggccccagcctactttgctgtctctgcagttcacacaggcccaaatggctttccttgaccctcattgagtggccttccccccttgcctagctaggaaggggccagagcgcttaaccaccctgatcccaaccttagtgcctttgggggccaggcgggtgataagtcccagcacctggggaatctggaggagccggaagggagtgtgccttgtgggaggggggtga

SEQ ID NO: 58364 - DNA, 601 bp, Human
ggagggtggctgaaacatccccattttacagatggaggaagttgggcttggagacaaggctgccagctggaaagggtgtcagcgttaaataacaagattcagaaaataggattaagtatagagtttattcaagcctaaagcttgaggatggccaccccggagtgtggattcaagttgccccaaataaaccctttgactagctgtgattacaagtggactttttttttttttttttttgagacagggtctcaccctgtcactcagtctggagtgcagtgtgtgatcatggctcactgcagcrtcagtttctcgggctcctggccttgagtgattctcctgccacagcctccctagtagctgggactacaggccctagccatcttgcccagctattttttttttttgagacggagtcttgctctattgcccaggctggagtgtagtggcacaatctctgctcactgcaacctccacctcccgggttcaagcgatcctcctgcctcagcccccctagcagctaggattacaggcacctgccaccatgcccgggtaatgtttatttttttagtagagatgggatttcgccatgctggccaggctg

SEQ ID NO: 58365 - DNA, 601 bp, Human
aaataaaccctttgactagctgtgattacaagtggactttttttttttttttttttgagacagggtctcaccctgtcactcagtctggagtgcagtgtgtgatcatggctcactgcagcatcagtttctcgggctcctggccttgagtgattctcctgccacagcctccctagtagctgggactacaggccctagccatcttgcccagctattttttttttttgagacggagtcttgctctattgcccaggctggagtgtagtggcacaatctctgctcactgcaacctccacctcccggrttcaagcgatcctcctgcctcagcccccctagcagctaggattacaggcacctgccaccatgcccgggtaatgtttatttttttagtagagatgggatttcgccatgctggccaggctggtctcgaactcctgacctcaggtgatccacctgctttggcctcccaaagtgctgggattacaggcgtgagccatcgtgccgggtttttgtttttttttttttttttttaagagatgaagtctcactatattgtccaggctggtctcaaactcctggcctcaagtgatcctccacccacttc

SEQ ID NO: 58366 - DNA, 601 bp, Human
cctttgactagctgtgattacaagtggactttttttttttttttttttgagacagggtctcaccctgtcactcagtctggagtgcagtgtgtgatcatggctcactgcagcatcagtttctcgggctcctggccttgagtgattctcctgccacagcctccctagtagctgggactacaggccctagccatcttgcccagctattttttttttttgagacggagtcttgctctattgcccaggctggagtgtagtggcacaatctctgctcactgcaacctccacctcccgggttcaagcratcctcctgcctcagcccccctagcagctaggattacaggcacctgccaccatgcccgggtaatgtttatttttttagtagagatgggatttcgccatgctggccaggctggtctcgaactcctgacctcaggtgatccacctgctttggcctcccaaagtgctgggattacaggcgtgagccatcgtgccgggtttttgtttttttttttttttttttaagagatgaagtctcactatattgtccaggctggtctcaaactcctggcctcaagtgatcctccacccacttcggcctccc

SEQ ID NO: 58367 - DNA, 601 bp, Human
tattttttttttttgagacggagtcttgctctattgcccaggctggagtgtagtggcacaatctctgctcactgcaacctccacctcccgggttcaagcgatcctcctgcctcagcccccctagcagctaggattacaggcacctgccaccatgcccgggtaatgtttatttttttagtagagatgggatttcgccatgctggccaggctggtctcgaactcctgacctcaggtgatccacctgctttggcctcccaaagtgctgggattacaggcgtgagccatcgtgccgggtttttgtttttttttttttttttttaagagatgaagtctcactatattgtccaggctggtctcaaactcctggcctcaagtgatcctccacccacttcggcctcccatagtgctgggattacaggcatgagccaacgcacccagtctgcaagtggatttttaaggaacaaagaagagagagttcctaaattgttaccaagaatttacattgaaacagcataaggtatctgcaggtctggctcagaaaaaaagataacagaaggtattgattggctatgcactgtttattgtatcacaaattccagga

SEQ ID NO: 58368 - DNA, 601 bp, Human
tttttttttgagacggagtcttgctctattgcccaggctggagtgtagtggcacaatctctgctcactgcaacctccacctcccgggttcaagcgatcctcctgcctcagcccccctagcagctaggattacaggcacctgccaccatgcccgggtaatgtttatttttttagtagagatgggatttcgccatgctggccaggctggtctcgaactcctgacctcaggtgatccacctgctttggcctcccaaagtgctgggattacaggcgtgagccatcgtgccgggtttttgtttttktttttttttttttaagagatgaagtctcactatattgtccaggctggtctcaaactcctggcctcaagtgatcctccacccacttcggcctcccatagtgctgggattacaggcatgagccaacgcacccagtctgcaagtggatttttaaggaacaaagaagagagagttcctaaattgttaccaagaatttacattgaaacagcataaggtatctgcaggtctggctcagaaaaaaagataacagaaggtattgattggctatgcactgtttattgtatcacaaattccaggaacaag

SEQ ID NO: 58369 - DNA, 601 bp, Human
gaccgaagtcccctattcactgtacagtctccctgggcctgatacatttcgcatagctcagactgatctgagctatttttcttttctcaagttgggtgggggtggcccctctggactggaaaagcctcatttttcccccaagtgacacacctgagtttgtttgacttgtttcccccaagtgacacacctgagtttgtgggacttgtgtggagatgatgtatttatgtcacacttcagtcttcgctgatggcttttttttttatatttatttacattttttcttttaaggtaggcagggccycattctatcgcccatgttggagtgcagtggcgaggtctctgggttcaagtgattccccttcctcagcctcccaagtagctgggaatacaggggcccgccaccacgcccagctaatttttgtatttttggtagagacggggtttcaccatattggccaggctggtctcgaactcctgacctcagggtgatccacccgcctcggcctcccaaagtgctgggattacaggcatgagccgcagcacccagccttttttctttctttcttttctttttgtttcccctcccgagaccgagtctctc

SEQ ID NO: 58370 - DNA, 601 bp, Human
ttgtgggacttgtgtggagatgatgtatttatgtcacacttcagtcttcgctgatggcttttttttttatatttatttacattttttcttttaaggtaggcagggccccattctatcgcccatgttggagtgcagtggcgaggtctctgggttcaagtgattccccttcctcagcctcccaagtagctgggaatacaggggcccgccaccacgcccagctaatttttgtatttttggtagagacggggtttcaccatattggccaggctggtctcgaactcctgacctcagggtgatccayccgcctcggcctcccaaagtgctgggattacaggcatgagccgcagcacccagccttttttctttctttcttttctttttgtttcccctcccgagaccgagtctctctctgtcacccaggctggagtgcagtggtatgatctcagcttactgcaacctccacctcccgggttcaagcaattctcccaccttagcctcctgagtagctgggattacaggtgcctgccaccacacccagataatttttctatttttagtagagatggggttttgccatgttggccagtctggtctcaaactc

SEQ ID NO: 58371 - DNA, 601 bp, Human
tggcgaggtctctgggttcaagtgattccccttcctcagcctcccaagtagctgggaatacaggggcccgccaccacgcccagctaatttttgtatttttggtagagacggggtttcaccatattggccaggctggtctcgaactcctgacctcagggtgatccacccgcctcggcctcccaaagtgctgggattacaggcatgagccgcagcacccagccttttttctttctttcttttctttttgtttcccctcccgagaccgagtctctctctgtcacccaggctggagtgcagtggyatgatctcagcttactgcaacctccacctcccgggttcaagcaattctcccaccttagcctcctgagtagctgggattacaggtgcctgccaccacacccagataatttttctatttttagtagagatggggttttgccatgttggccagtctggtctcaaactcctggccccaagtgagcctcctgcctcggcctcccaaagtgctgggattacaggtgtgagccaccacacctggccttattttatttttaatttctgttcttgtattgctataatttactgatgatttcttacccaa

SEQ ID NO: 58372 - DNA, 601 bp, Human
cagggcctgtgcaccgcctccatggcccatctccatcagacagagctgggcagtggtgttggccctcgaaatgaggcttgtgccctggcctttcctggcctgggggctgagtgccaaggccacctgtaattaaactgagcttcctatgtttacttagcaagcactgacctctcatttcctggggccctatgctgagtgttccacagctattctttaatctttaaacagcccttgggacgcaggcactattattaacctcacatcacagctggggaaactgaggcacagagaggttaagtgrcctgcacaaggtcgcagagccaggattcaaacccatgaactatgggccactcagtcgccatgctgtactgccgtgcacagcagaggaagatttgttcttgttcttgtttatattaaaagtgagaaaacatgggccacacgcagtggctcacgcctgtaatcccagcactttgggaggccaaggcgggtggatcacctgaggtcaggagtttgaaaccagcctgaccaacatggtgaactctggtctctactaaaaattcaaaaatcagccggaccgtagtggctcgcacctgtaatccca

SEQ ID NO: 58373 - DNA, 601 bp, Human
aaagtgagaaaacatgggccacacgcagtggctcacgcctgtaatcccagcactttgggaggccaaggcgggtggatcacctgaggtcaggagtttgaaaccagcctgaccaacatggtgaactctggtctctactaaaaattcaaaaatcagccggaccgtagtggctcgcacctgtaatcccagctactcaggaggctgaggcaggagaatcgcttgaacccaggaggcagaggttgcagtgagttgagaccgtgccactgcactccaacctgggtgacagagcaagactccgtctccaaaaaaaaaaaaaaaggtgagaaaccacttaggctggctgagaactgcaaacatgcgtccacataaaaacttgaacttgcatgatcccagcagctttatttatcagagccaaaaagttgaaacaacctcaatgcctatcagcggctgaatggataaacaaaatgtggtccatccatgtagtggaatattattgagccttaaagaagagtgaagcgtcgacacgtgttacagatggatgaacctggaaaacaagatgccaagtgaaagaagccagacacaaaggctacatagtctattacat

SEQ ID NO: 58374 - DNA, 601 bp, Human
gcacctgtaatcccagctactcaggaggctgaggcaggagaatcgcttgaacccaggaggcagaggttgcagtgagttgagaccgtgccactgcactccaacctgggtgacagagcaagactccgtctccaaaaaaaaaaaaaaaggtgagaaaccacttaggctggctgagaactgcaaacatgcgtccacataaaaacttgaacttgcatgatcccagcagctttatttatcagagccaaaaagttgaaacaacctcaatgcctatcagcggctgaatggataaacaaaatgtggtccrtccatgtagtggaatattattgagccttaaagaagagtgaagcgtcgacacgtgttacagatggatgaacctggaaaacaagatgccaagtgaaagaagccagacacaaaggctacatagtctattacatgaaatgtccagaacaggcacatcaacagagacagaaagttgcatcgtggctgggggaatgggaagtgactgcttaatggataagggggttacttagggaattataaaaatgcccaggctgggcgcagtggctcatgcccgtaatccgaacactttgggaggccgaggcag

SEQ ID NO: 58375 - DNA, 601 bp, Human
cttgaacccaggaggcagaggttgcagtgagttgagaccgtgccactgcactccaacctgggtgacagagcaagactccgtctccaaaaaaaaaaaaaaaggtgagaaaccacttaggctggctgagaactgcaaacatgcgtccacataaaaacttgaacttgcatgatcccagcagctttatttatcagagccaaaaagttgaaacaacctcaatgcctatcagcggctgaatggataaacaaaatgtggtccatccatgtagtggaatattattgagccttaaagaagagtgaagcgycgacacgtgttacagatggatgaacctggaaaacaagatgccaagtgaaagaagccagacacaaaggctacatagtctattacatgaaatgtccagaacaggcacatcaacagagacagaaagttgcatcgtggctgggggaatgggaagtgactgcttaatggataagggggttacttagggaattataaaaatgcccaggctgggcgcagtggctcatgcccgtaatccgaacactttgggaggccgaggcaggtggatcgcttgagctcaggagcctaagcaacatgatgaatcccc

SEQ ID NO: 58376 - DNA, 601 bp, Human
aaaaaaaggtgagaaaccacttaggctggctgagaactgcaaacatgcgtccacataaaaacttgaacttgcatgatcccagcagctttatttatcagagccaaaaagttgaaacaacctcaatgcctatcagcggctgaatggataaacaaaatgtggtccatccatgtagtggaatattattgagccttaaagaagagtgaagcgtcgacacgtgttacagatggatgaacctggaaaacaagatgccaagtgaaagaagccagacacaaaggctacatagtctattacatgaaatgtycagaacaggcacatcaacagagacagaaagttgcatcgtggctgggggaatgggaagtgactgcttaatggataagggggttacttagggaattataaaaatgcccaggctgggcgcagtggctcatgcccgtaatccgaacactttgggaggccgaggcaggtggatcgcttgagctcaggagcctaagcaacatgatgaatccccatctctacaaaaaatacaaaattagctgggtttggtggctcgcacctgtagtctcagctacttggggggctgaggtgggaggatcacttcggc

SEQ ID NO: 58377 - DNA, 601 bp, Human
agacagagtctcactttatcacccaagctggagtgcagaggcgcgatctcggctcactgcaacctccgcctcctgggttcaagtgaacacgtccggctaatttttatatttttagtagagacagggtatttcaccgtgttggccaggctggtctcaaactcctgacctcaagtggcccacccacctcggtctcccaaagtgctggaattacaggtgtgagccactgcacccagccttaattgtatactttaaatgggtgaattgtgtagcgtaagaatttatatctcgataaagctgtttaaaaaaaaaaaaactacgtaaaaaatgagcaaaggacccgaagagacatttttctaaagaagacatacaggcagccaacaaacatgaaaaaatgctcaacatcattaatcatcagagaaatgcaaatttaaaccacaatgaggtgccatctcacctcagtcagaatgtctgttactaaaaagtctaaaaaaacagatgctggcaaggatttggagtaaagggaccgcttacccactgttgatgggaatgtaaattagtacagcctctatggcaaacagcatggagatttctcaaagaacta

SEQ ID NO: 58378 - DNA, 601 bp, Human
catcagagaaatgcaaatttaaaccacaatgaggtgccatctcacctcagtcagaatgtctgttactaaaaagtctaaaaaaacagatgctggcaaggatttggagtaaagggaccgcttacccactgttgatgggaatgtaaattagtacagcctctatggcaaacagcatggagatttctcaaagaactaaaaatagaactaccatttggtccagtattccactgagtatcctcccaaaggaaaagacatcattatatcaaaaagacacctgcgcttgtatgtttattgcagcactatycacaacagcaaagatatggaatcaacttaagtgtccatcgatgaatggaggattggataaagaaaatgtggtctatatctacaaagatttcatgacgaaattgccaaaagcagtgcagcaaaagcaaacattgacaaatgggatctaattaaactaaagagcttctgcacagcaaaagaaactatcctcagggtgaacagacaacctacagagtgggagaacatttttgcaatctatccatctgacaaaggtctaacatccagaacctacaaggaatttaaacaaatttacaagaaaaga

SEQ ID NO: 58379 - DNA, 601 bp, Human
aaaatagaactaccatttggtccagtattccactgagtatcctcccaaaggaaaagacatcattatatcaaaaagacacctgcgcttgtatgtttattgcagcactattcacaacagcaaagatatggaatcaacttaagtgtccatcgatgaatggaggattggataaagaaaatgtggtctatatctacaaagatttcatgacgaaattgccaaaagcagtgcagcaaaagcaaacattgacaaatgggatctaattaaactaaagagcttctgcacagcaaaagaaactatcctcagrgtgaacagacaacctacagagtgggagaacatttttgcaatctatccatctgacaaaggtctaacatccagaacctacaaggaatttaaacaaatttacaagaaaagaaaaacctaaaaaagtgggcaaaggacacgaacagacacttctcaaaataagacagtcatgcagccaacaaacatgaaaaaaatgctcaacatcactgatcgttgagaaatgcaaatcaaaacaatgagataccatctcacaccagtcagaatggccattatcagaaagtcaagaaacaacagatgcaggcaa

SEQ ID NO: 58380 - DNA, 601 bp, Human
ttaaactaaagagcttctgcacagcaaaagaaactatcctcagggtgaacagacaacctacagagtgggagaacatttttgcaatctatccatctgacaaaggtctaacatccagaacctacaaggaatttaaacaaatttacaagaaaagaaaaacctaaaaaagtgggcaaaggacacgaacagacacttctcaaaataagacagtcatgcagccaacaaacatgaaaaaaatgctcaacatcactgatcgttgagaaatgcaaatcaaaacaatgagataccatctcacaccagtcaraatggccattatcagaaagtcaagaaacaacagatgcaggcaaggttgtggagaaataggaatgcttttacactgttggtgggaatgtaaattagttgaactattatgaagacagtatggcgattcctcaaagatctagaaccagaaataccatttgacccagcaatcccattaccggtatatacccaaaagaatataaatcattctattacaaagatacatgtatgcgtatgttcattgcaggactattcacaataccaaagacatggactcaatccaaatgcccatcatggatagact

SEQ ID NO: 58381 - DNA, 601 bp, Human
actattcacaataccaaagacatggactcaatccaaatgcccatcatggatagactggataaagaaaatgtacaggccgggcactgtggctgacgcctgtaatcctagcactttgagaggccgaggcggcggatcacgaggtcaggagatcgagaccatcctgggtaacacggtgaaaccccgtctctactaaaaatacaaaaaaattcgagtcccagctactcgggaggctgaggcaggagaatggtgtgaacccaggaggcggagcttgcagtgagccgagatggcaccactgcactcmggcctgggcaaaagagtgagactccgtctcaaaaaaaaaaaagaaaagaaaaaagaaacctgcacatgtatcctggaacaataaaaaaaaaaagaaagaaagaaaatgtggtatatgtctaccatggaatactacacagccataaaaaaggatgggatcatgtcttttgcaccaacacagatggaactggaggccattatcctgagtaaaatagaaagtcaaataccacatgttctcacttataagtggaatctaaacagcagatacacaaagattggaataatggacagtggagactac

SEQ ID NO: 58382 - DNA, 601 bp, Human
gcctgtaatcctagcactttgagaggccgaggcggcggatcacgaggtcaggagatcgagaccatcctgggtaacacggtgaaaccccgtctctactaaaaatacaaaaaaattcgagtcccagctactcgggaggctgaggcaggagaatggtgtgaacccaggaggcggagcttgcagtgagccgagatggcaccactgcactccggcctgggcaaaagagtgagactccgtctcaaaaaaaaaaaagaaaagaaaaaagaaacctgcacatgtatcctggaacaataaaaaaaaaaagaaagaaagaaaatgtggtatatgtctaccatggaatactacacagccataaaaaaggatgggatcatgtcttttgcaccaacacagatggaactggaggccattatcctgagtaaaatagaaagtcaaataccacatgttctcacttataagtggaatctaaacagcagatacacaaagattggaataatggacagtggagactacaaaaggtgggagggagggaaacgggtgagggttgaaaaattaactgttggaggctgggcacagtggcgcacacctataatcccagcactttggg

SEQ ID NO: 58383 - DNA, 601 bp, Human
cccgtctctactaaaaatacaaaaaaattcgagtcccagctactcgggaggctgaggcaggagaatggtgtgaacccaggaggcggagcttgcagtgagccgagatggcaccactgcactccggcctgggcaaaagagtgagactccgtctcaaaaaaaaaaaagaaaagaaaaaagaaacctgcacatgtatcctggaacaataaaaaaaaaaagaaagaaagaaaatgtggtatatgtctaccatggaatactacacagccataaaaaaggatgggatcatgtcttttgcaccaacacrgatggaactggaggccattatcctgagtaaaatagaaagtcaaataccacatgttctcacttataagtggaatctaaacagcagatacacaaagattggaataatggacagtggagactacaaaaggtgggagggagggaaacgggtgagggttgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatatta

SEQ ID NO: 58384 - DNA, 601 bp, Human
tccgtctcaaaaaaaaaaaagaaaagaaaaaagaaacctgcacatgtatcctggaacaataaaaaaaaaaagaaagaaagaaaatgtggtatatgtctaccatggaatactacacagccataaaaaaggatgggatcatgtcttttgcaccaacacagatggaactggaggccattatcctgagtaaaatagaaagtcaaataccacatgttctcacttataagtggaatctaaacagcagatacacaaagattggaataatggacagtggagactacaaaaggtgggagggagggaaacrggtgagggttgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatattaaaaaattggccgggcgcggtggctcacgcctgtaatcccagcactttgggagcccgaggcagcagatcacgaggtcaggagattgagaccatcctggctaacatggtgaaaccccgtctctactaaaaatacaaaaaaaaaaaa

SEQ ID NO: 58385 - DNA, 601 bp, Human
ttataagtggaatctaaacagcagatacacaaagattggaataatggacagtggagactacaaaaggtgggagggagggaaacgggtgagggttgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatattaaaaaattggccgggcgcggtggctcacgcctgtaatcccagcactttgggagcccgaggcrgcagatcacgaggtcaggagattgagaccatcctggctaacatggtgaaaccccgtctctactaaaaatacaaaaaaaaaaaaaaaattagctgggcatggtagtgtgcgcctgtaatcccagctactcgggaggctgaggcaggagaattgcttgaaattgagaggtggaggttgcagtgagccgagatcacaccactgcactccggcctgggcaacagtgcgagactctgtctcaaaaaaaagaaaaattgactgttggaagccaggtgcattggtgcatgcctataatcccagcact

SEQ ID NO: 58386 - DNA, 601 bp, Human
gagggagggaaacgggtgagggttgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatattaaaaaattggccgggcgcggtggctcacgcctgtaatcccagcactttgggagcccgaggcagcagatcacgaggtcaggagattgagaccatcctggctaacatggtgaaaccccgtctctactaaaaatmcaaaaaaaaaaaaaaaattagctgggcatggtagtgtgcgcctgtaatcccagctactcgggaggctgaggcaggagaattgcttgaaattgagaggtggaggttgcagtgagccgagatcacaccactgcactccggcctgggcaacagtgcgagactctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaa

SEQ ID NO: 58387 - DNA, 601 bp, Human
gggagggaaacgggtgagggttgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatattaaaaaattggccgggcgcggtggctcacgcctgtaatcccagcactttgggagcccgaggcagcagatcacgaggtcaggagattgagaccatcctggctaacatggtgaaaccccgtctctactaaaaatacaaaaaaaaaaaaaaaattagctgggcatggtagtgtgcgcctgtaatcccagctactcgggaggctgaggcaggagaattgcttgaaattgagaggtggaggttgcagtgagccgagatcacaccactgcactccggcctgggcaacagtgcgagactctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaacc

SEQ ID NO: 58388 - DNA, 601 bp, Human
tgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatattaaaaaattggccgggcgcggtggctcacgcctgtaatcccagcactttgggagcccgaggcagcagatcacgaggtcaggagattgagaccatcctggctaacatggtgaaaccccgtctctactaaaaatacaaaaaaaaaaaaaaaattagcygggcatggtagtgtgcgcctgtaatcccagctactcgggaggctgaggcaggagaattgcttgaaattgagaggtggaggttgcagtgagccgagatcacaccactgcactccggcctgggcaacagtgcgagactctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaaccctatctctacaaaaacaaaaa

SEQ ID NO: 58389 - DNA, 601 bp, Human
acgggtggatcacgaggtcaggcgttcgaggccagcctggccaacatagtgaaaacccatctctattaaaaatattaaaaaattggccgggcgcggtggctcacgcctgtaatcccagcactttgggagcccgaggcagcagatcacgaggtcaggagattgagaccatcctggctaacatggtgaaaccccgtctctactaaaaatacaaaaaaaaaaaaaaaattagctgggcatggtagtgtgcgcctgtaatcccagctactcgggaggctgaggcaggagaattgcttgaaattgrgaggtggaggttgcagtgagccgagatcacaccactgcactccggcctgggcaacagtgcgagactctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaaccctatctctacaaaaacaaaaattagccgggcactggtggcacatgcctgcagtcccagccactcaagttgcagtgagccaagattgtgcca

SEQ ID NO: 58390 - DNA, 601 bp, Human
ttaaaaatattaaaaaattggccgggcgcggtggctcacgcctgtaatcccagcactttgggagcccgaggcagcagatcacgaggtcaggagattgagaccatcctggctaacatggtgaaaccccgtctctactaaaaatacaaaaaaaaaaaaaaaattagctgggcatggtagtgtgcgcctgtaatcccagctactcgggaggctgaggcaggagaattgcttgaaattgagaggtggaggttgcagtgagccgagatcacaccactgcactccggcctgggcaacagtgcgagastctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaaccctatctctacaaaaacaaaaattagccgggcactggtggcacatgcctgcagtcccagccactcaagttgcagtgagccaagattgtgccactgcacttcagcctgggagacagagtgagaccctgtctcaaaaaagaaaaagaaaaattaactgt

SEQ ID NO: 58391 - DNA, 601 bp, Human
cagctactcgggaggctgaggcaggagaattgcttgaaattgagaggtggaggttgcagtgagccgagatcacaccactgcactccggcctgggcaacagtgcgagactctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaaccctatctctacaaaaacaaaaattagccgggcactggtggcacatgcctrcagtcccagccactcaagttgcagtgagccaagattgtgccactgcacttcagcctgggagacagagtgagaccctgtctcaaaaaagaaaaagaaaaattaactgttgggtacgctgtttgctattcaggtgatagatatgctaaaagcccagacttcacctctatgcaatatatgtatgtaagaaactggcacttgcacctgctaaaaatataataattttaaaatttttattttaataaaaaaatagaaacttagggccaaggggggagctgatcatttgaggtcaggagttcgaga

SEQ ID NO: 58392 - DNA, 601 bp, Human
ttgcagtgagccgagatcacaccactgcactccggcctgggcaacagtgcgagactctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaaccctatctctacaaaaacaaaaattagccgggcactggtggcacatgcctgcagtcccagccactcaagttgcagtgagccaagattgtgccactgcacttcarcctgggagacagagtgagaccctgtctcaaaaaagaaaaagaaaaattaactgttgggtacgctgtttgctattcaggtgatagatatgctaaaagcccagacttcacctctatgcaatatatgtatgtaagaaactggcacttgcacctgctaaaaatataataattttaaaatttttattttaataaaaaaatagaaacttagggccaaggggggagctgatcatttgaggtcaggagttcgagaccagcctggccaacgtggtgaaagcccatctctactaaaaatacaaaaattag

SEQ ID NO: 58393 - DNA, 601 bp, Human
cactttgggaggctgaggcgggctgctcactttgagttcaggagtttgagaccagcctgggcaacatggcaaaaccctatctctacaaaaacaaaaattagccgggcactggtggcacatgcctgcagtcccagccactcaagttgcagtgagccaagattgtgccactgcacttcagcctgggagacagagtgagaccctgtctcaaaaaagaaaaagaaaaattaactgttgggtacgctgtttgctattcaggtgatagatatgctaaaagcccagacttcacctctatgcaatataygtatgtaagaaactggcacttgcacctgctaaaaatataataattttaaaatttttattttaataaaaaaatagaaacttagggccaaggggggagctgatcatttgaggtcaggagttcgagaccagcctggccaacgtggtgaaagcccatctctactaaaaatacaaaaattagccaggcatggtggcgggcgcctgtaatcccagctactcaggaggctgaggcacaagaatcccttgaaccagggatggaggttgcagtgaccaagattgctccactgcaccccagcctgggcaa

SEQ ID NO: 58394 - DNA, 601 bp, Human
ccagcctgggcaacatggcaaaaccctatctctacaaaaacaaaaattagccgggcactggtggcacatgcctgcagtcccagccactcaagttgcagtgagccaagattgtgccactgcacttcagcctgggagacagagtgagaccctgtctcaaaaaagaaaaagaaaaattaactgttgggtacgctgtttgctattcaggtgatagatatgctaaaagcccagacttcacctctatgcaatatatgtatgtaagaaactggcacttgcacctgctaaaaatataataattttaaartttttattttaataaaaaaatagaaacttagggccaaggggggagctgatcatttgaggtcaggagttcgagaccagcctggccaacgtggtgaaagcccatctctactaaaaatacaaaaattagccaggcatggtggcgggcgcctgtaatcccagctactcaggaggctgaggcacaagaatcccttgaaccagggatggaggttgcagtgaccaagattgctccactgcaccccagcctgggcaacagagcgagactcagtctcaaaaaaaaaaaaaagaaacttgagaaaaaatg

SEQ ID NO: 58395 - DNA, 601 bp, Human
cgggcgcctgtaatcccagctactcaggaggctgaggcacaagaatcccttgaaccagggatggaggttgcagtgaccaagattgctccactgcaccccagcctgggcaacagagcgagactcagtctcaaaaaaaaaaaaaagaaacttgagaaaaaatgctatgtaggaggtctgtaggtttcataggaaggtgagagaaagtatattactgaggggggatgaagacaatactcagcctttaaatgttttaaaatgtattttatgaaagtttttttttattgatttattttcagaggatttcccccccccccaaaaaaaaatcttatgaaaattttggggtgggctgggtacagtggctcacgcctataatcccagcactttgagaggctgaggtgggaggatcacttgagtccaggagttcaagaccagcctgggcaacatagcgagacattgtctctaccaaaacaaacaaaaaatacaaattagccaggtgtggtggtgcatgcctgtagtcccagcttgaacctgggaggtcaaggctgcagtgagctgggtggcccactgcactctagcctgggtgaaagtgaggccctgtctg

SEQ ID NO: 58396 - DNA, 601 bp, Human
gcgcctgtaatcccagctactcaggaggctgaggcacaagaatcccttgaaccagggatggaggttgcagtgaccaagattgctccactgcaccccagcctgggcaacagagcgagactcagtctcaaaaaaaaaaaaaagaaacttgagaaaaaatgctatgtaggaggtctgtaggtttcataggaaggtgagagaaagtatattactgaggggggatgaagacaatactcagcctttaaatgttttaaaatgtattttatgaaagtttttttttattgatttattttcagaggatttcccccccccccaaaaaaaaatcttatgaaaattttggggtgggctgggtacagtggctcacgcctataatcccagcactttgagaggctgaggtgggaggatcacttgagtccaggagttcaagaccagcctgggcaacatagcgagacattgtctctaccaaaacaaacaaaaaatacaaattagccaggtgtggtggtgcatgcctgtagtcccagcttgaacctgggaggtcaaggctgcagtgagctgggtggcccactgcactctagcctgggtgaaagtgaggccctgtctgaga

SEQ ID NO: 58397 - DNA, 601 bp, Human
cctgtagtcccagcttgaacctgggaggtcaaggctgcagtgagctgggtggcccactgcactctagcctgggtgaaagtgaggccctgtctgagaaaaaaaaatgtagttgaaagaaaagaaaacttttatttttttattttcttttttaattttaaaggcagggtctcactctgttgcccaggctgttcttgaactcctaggctcaagcattcctcccaccttggcctcccaaagtgctgagattgaagtcttgagccactaccctggccatcatgtcaacttttaaacatacaaatayaggtaagaatggcctggtggccgggcgcggtggctcacgcctgtaatcccagcactttgggaggctgaggcaagcggatcacgaggtcaggagattgagaccatcctggctaacacagtgaaaccccatctctactaaaaatacaaaaaagaaaaaaattagccaggcatggtggcaggcgcctgtagtcccagctactcaggaggctgaggcaggagaatggcgtgaacccgggaggcggagcttgcagtgagccgagatcgcgccactgcactccagcctggtcaacagagcaagact

SEQ ID NO: 58398 - DNA, 601 bp, Human
gcttgcagtgagccgagatcgcgccactgcactccagcctggtcaacagagcaagactccgtatcaaaaaaaaaaagaagaatggcctggagcctccctcaccttctccacctagacccacttgacaatgggtgacatattttggtttttgctgaaccatttaggagtaacttgagatcatgacattgcgacttcatatcttctgggaaaaatagtgtgtgcacagccacaatttaattatcacacctcggaacatgaacagcaattccaaaatcatatgtaatatgaactcatagtacaygttatagttgtataatagaatagtcattttagtcttccctaaaatgtcttttccaggtggcttttttggaatcaggatgctgcgaagctgcctacgttgcatgtggagcctgcatttcccgtggggcccccttcgtggtggccctgcctggaggtgtctgggtccctcccccacccgactacttcactctctgtcctctctgcccaggagcccaggatgtgcgagttcaagtgctacccgaggtgcgaggccagctcgggggcaccgtggagctgccgtgccacctgctgccacctgttc

SEQ ID NO: 58399 - DNA, 601 bp, Human
tctccacctagacccacttgacaatgggtgacatattttggtttttgctgaaccatttaggagtaacttgagatcatgacattgcgacttcatatcttctgggaaaaatagtgtgtgcacagccacaatttaattatcacacctcggaacatgaacagcaattccaaaatcatatgtaatatgaactcatagtacacgttatagttgtataatagaatagtcattttagtcttccctaaaatgtcttttccaggtggcttttttggaatcaggatgctgcgaagctgcctacgttgcatgyggagcctgcatttcccgtggggcccccttcgtggtggccctgcctggaggtgtctgggtccctcccccacccgactacttcactctctgtcctctctgcccaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagc

SEQ ID NO: 58400 - DNA, 601 bp, Human; identical to SEQ ID NO: 26108

SEQ ID NO: 58401 - DNA, 601 bp, Human; identical to SEQ ID NO: 26109

SEQ ID NO: 58402 - DNA, 601 bp, Human; identical to SEQ ID NO: 26110

SEQ ID NO: 58403 - DNA, 601 bp, Human; identical to SEQ ID NO: 26111

SEQ ID NO: 58404 - DNA, 601 bp, Human; identical to SEQ ID NO: 26112

SEQ ID NO: 58405 - DNA, 601 bp, Human; identical to SEQ ID NO: 26113

SEQ ID NO: 58406 - DNA, 601 bp, Human; identical to SEQ ID NO: 26114

SEQ ID NO: 58407 - DNA, 601 bp, Human; identical to SEQ ID NO: 26115

SEQ ID NO: 58408 - DNA, 601 bp, Human; identical to SEQ ID NO: 26116

SEQ ID NO: 58409 - DNA, 601 bp, Human; identical to SEQ ID NO: 26117

SEQ ID NO: 58410 - DNA, 601 bp, Human; identical to SEQ ID NO: 26118

SEQ ID NO: 58411 - DNA, 601 bp, Human; identical to SEQ ID NO: 26119

SEQ ID NO: 58412 - DNA, 601 bp, Human; identical to SEQ ID NO: 26120

SEQ ID NO: 58413 - DNA, 601 bp, Human; identical to SEQ ID NO: 26121

SEQ ID NO: 58414 - DNA, 601 bp, Human; identical to SEQ ID NO: 26122

SEQ ID NO: 58415 - DNA, 601 bp, Human; identical to SEQ ID NO: 26123

SEQ ID NO: 58416 - DNA, 601 bp, Human; identical to SEQ ID NO: 26124

SEQ ID NO: 58417 - DNA, 601 bp, Human; identical to SEQ ID NO: 26125

SEQ ID NO: 58418 - DNA, 601 bp, Human; identical to SEQ ID NO: 26126

SEQ ID NO: 58419 - DNA, 601 bp, Human; identical to SEQ ID NO: 26127

SEQ ID NO: 58420 - DNA, 601 bp, Human; identical to SEQ ID NO: 26128

SEQ ID NO: 58421 - DNA, 601 bp, Human; identical to SEQ ID NO: 26129

SEQ ID NO: 58422 - DNA, 601 bp, Human; identical to SEQ ID NO: 26130

SEQ ID NO: 58423 - DNA, 601 bp, Human; identical to SEQ ID NO: 26131

SEQ ID NO: 58424 - DNA, 601 bp, Human; identical to SEQ ID NO: 26132

SEQ ID NO: 58425 - DNA, 601 bp, Human; identical to SEQ ID NO: 26133

SEQ ID NO: 58426 - DNA, 601 bp, Human; identical to SEQ ID NO: 34667

SEQ ID NO: 58427 - DNA, 601 bp, Human; identical to SEQ ID NO: 34668

SEQ ID NO: 58428 - DNA, 601 bp, Human; identical to SEQ ID NO: 34669

SEQ ID NO: 58429 - DNA, 601 bp, Human; identical to SEQ ID NO: 34670

SEQ ID NO: 58430 - DNA, 601 bp, Human; identical to SEQ ID NO: 34671

SEQ ID NO: 58431 - DNA, 601 bp, Human; identical to SEQ ID NO: 34672

SEQ ID NO: 58432 - DNA, 601 bp, Human; identical to SEQ ID NO: 34673

SEQ ID NO: 58433 - DNA, 601 bp, Human; identical to SEQ ID NO: 34674

SEQ ID NO: 58434 - DNA, 601 bp, Human; identical to SEQ ID NO: 34675

SEQ ID NO: 58435 - DNA, 601 bp, Human; identical to SEQ ID NO: 34676

SEQ ID NO: 58436 - DNA, 601 bp, Human; identical to SEQ ID NO: 34677

SEQ ID NO: 58437 - DNA, 601 bp, Human; identical to SEQ ID NO: 34678

SEQ ID NO: 58438 - DNA, 601 bp, Human; identical to SEQ ID NO: 34679

SEQ ID NO: 58439 - DNA, 601 bp, Human; identical to SEQ ID NO: 34680

SEQ ID NO: 58440 - DNA, 601 bp, Human; identical to SEQ ID NO: 34681

SEQ ID NO: 58441 - DNA, 601 bp, Human
gctgagagcctgccccgcgcccacagaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttggtaagtgtcctcgggcatcccccgaagggaggcaggcagggagggkcgcagggcaggggctcctgacgtgaacgtctttttcacagcaaagccagaggccactgaggtctcccccaacaaagggacactgtctgtgatggaggactctgcccaggaggtacctctcgggtggaccttggccccagggtcctggaggaggaggggacagggccctggactcctgggtctgagggaggaggggctggggacccctgggtaataaaggaggaggggtaaggccaggcgaggtggctcatgcctgtaatcccagcattttgggaggcagaggcaggcggatcacctgagg

SEQ ID NO: 58442 - DNA, 601 bp, Human
ggcagcgtaagggaccttcctctccaccctgagccccctctcactcatccaagtatcacaccctcctttccacttcctgggagactggacgtcgttcacctctgcccttgaccccaccccttgaccccaccagccggggcctgatcggagcctccatagcccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcrccggtgagtgactgaggtggtggcagaggagccgggtgtggggcagacagagcccactgcctgacccacgcctctctccatcctgtccctgcagtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaacccc

SEQ ID NO: 58443 - DNA, 601 bp, Human
gattacaggcatgagccactgcacctggcccccctgtcagagcttgagcactcacttggtgccaggtgccactctaagcactgcacagccattgacttgtgttttcacaacgtgggcgcccatttttcagatgaggagactgaggttcaggaggtgaaccgacctccttggggatctcacattattctcgtgcatgtttattgcgtggtttgctgagtacctcgcactgtcccaagcctttatgtatattaatgcattgattcccacaacagccccattttacagatgagaaaactgaggccccccccccttcaagggtggtgggattggggcatggccggcagcctccagagcccccatgtagccccttcagtgctccactggggaggctcacctgggttgtccactcctgtctggatgacatcgtctacagtgaagccagatggagtctccttgtcccgcagcttcttgtagagttcaagggtcagtaccttggccatgtggttgttatgtttgctgaggtcggggtactcctcctcaggcttgtaattcagcttgaacttgttgtgggtgttaccgaatggcatggtggcggtgtagg

SEQ ID NO: 58444 - DNA, 601 bp, Human
actggtgggaactgggagggaaggctgggagaggtcaaggtggctgggaggggtcaaggtgggagagaagaaagagtgctgggggcggggtcaaaggagaaaggggagcttcagagggtacatggtgctaaaagcatcagcacctcggaaacattagcacccaaagtcatgacatcttagcctgaaatgttaggatctcaggctaccaccgtaccacagagggtcaggagggtaagagacttgaaagaccctcttgtttcccagtggaaaaacaggggccaggagagaggggcttctcccyggcatcacacagtgagctggatgtgaggggcactagagcctcccctccactcccagctctcttcgccttgcaatgtcctttgagaaacaaccataacattaataacatcccctgtcagattctttttttttttttttgagacagggtctcactctgtggctggagtacagtggcgcgatctcggcttactgcaacctgcacctcccaggctcaagcgatcctcccaccgcagcctcctgagtagcttggaccacaagccctcatcaccacacttggctaatttttttgtattttttgtag

SEQ ID NO: 58445 - DNA, 601 bp, Human
cctctgccttccaggttcaagcgattctcctgcctcagcctcccacgtagctgggattacaggcatgtgccaccacacccagctaattctgtatttttagtagagacggggtttcaccatgttggtcaggctggtctcaaactctcaatctaaggtgatctgcccgccttggcctcccaaagtgctgggattacaggcgtgagccaccgccgtgcccagcccttttttttttttttaaagacagagttttgccatgttggccaggctggtcttgaactcctgacctcaagtgatacgctcrcctcagcctcccaatgtccctctctctttccatctctctgcttctccacacctctgtgtctctctctgtctctgtatttctctgtctccccccatttctcctgtgatctctctcctcctcacccctcggccctcccctcctgcgcagacaccgaccttgaggttttcatggttgaggtcagtcttgtgcttgtcagtgggtttgtagcccccgtggcgatccgagatgatggggtcaaagagttccttgaaaacttcgtaggactcctcatcaccagccacgcagcccacggtcatgatg

SEQ ID NO: 58446 - DNA, 601 bp, Human
taggattataggtgaacactagcatgcctagctaatttttgtatttttagtagagactgggtttcaccgtgttggtcaggctggtctcgaactcctgaccttatgatccgcccacctcagcctcccaaagtgttgggattacaagggtgagccactgtgcccggctatgcctcttccttttctacatgcttttgtgcctttcttctccctctccctctcctttgtctgtctgtctccttggttgtctgtgtctccttggctgtctctgtgtctctctgtccctctctctttcctttttttwttttctgagatagaatcttgctctgtcacccaggctggagtgcagtggcatgatctcagctcactgcagcctccatctcctgggttcaagagattttcctgcctccacctcctgagtagctgggattacaggcacgcgccaccatgcccagctaatttatttaatttatttatttatttattttttgagacgagtttcgcccttgttgcccaggctggagtgcaatggcacgatctctgctcaccacaacctctgccttccaggttcaagcgattctcctgcctcagcctcccacgtagc

SEQ ID NO: 58447 - DNA, 601 bp, Human
ctgcaactgcgtgtgtctctctctccctgtctctcctgccttctctgatgctcccttctgtctccctctgtgtctctgcctctccccccacccttttttttttaggcagagtctcgctctgtcacccaggctgaatagctaggattataggtgaacactagcatgcctagctaatttttgtatttttagtagagactgggtttcaccgtgttggtcaggctggtctcgaactcctgaccttatgatccgcccacctcagcctcccaaagtgttgggattacaagggtgagccactgtgccsggctatgcctcttccttttctacatgcttttgtgcctttcttctccctctccctctcctttgtctgtctgtctccttggttgtctgtgtctccttggctgtctctgtgtctctctgtccctctctctttccttttttttttttctgagatagaatcttgctctgtcacccaggctggagtgcagtggcatgatctcagctcactgcagcctccatctcctgggttcaagagattttcctgcctccacctcctgagtagctgggattacaggcacgcgccaccatgcccagctaatttatt

SEQ ID NO: 58448 - DNA, 601 bp, Human
ccttgtctgtgtctgactgcaactgcgtgtgtctctctctccctgtctctcctgccttctctgatgctcccttctgtctccctctgtgtctctgcctctccccccacccttttttttttaggcagagtctcgctctgtcacccaggctgaatagctaggattataggtgaacactagcatgcctagctaatttttgtatttttagtagagactgggtttcaccgtgttggtcaggctggtctcgaactcctgaccttatgatccgcccacctcagcctcccaaagtgttgggattacaagsgtgagccactgtgcccggctatgcctcttccttttctacatgcttttgtgcctttcttctccctctccctctcctttgtctgtctgtctccttggttgtctgtgtctccttggctgtctctgtgtctctctgtccctctctctttccttttttttttttctgagatagaatcttgctctgtcacccaggctggagtgcagtggcatgatctcagctcactgcagcctccatctcctgggttcaagagattttcctgcctccacctcctgagtagctgggattacaggcacgcgccaccat

SEQ ID NO: 58449 - DNA, 601 bp, Human
tcagcctccataagtgctgggattacaggtatagccactgcacccagcctttctgcccatttctgtttctcttcctgtctccctttctcccactctccttgtctgtgtctgactgcaactgcgtgtgtctctctctccctgtctctcctgccttctctgatgctcccttctgtctccctctgtgtctctgcctctccccccacccttttttttttaggcagagtctcgctctgtcacccaggctgaatagctaggattataggtgaacactagcatgcctagctaatttttgtatttttartagagactgggtttcaccgtgttggtcaggctggtctcgaactcctgaccttatgatccgcccacctcagcctcccaaagtgttgggattacaagggtgagccactgtgcccggctatgcctcttccttttctacatgcttttgtgcctttcttctccctctccctctcctttgtctgtctgtctccttggttgtctgtgtctccttggctgtctctgtgtctctctgtccctctctctttccttttttttttttctgagatagaatcttgctctgtcacccaggctggagtgcagtggc

SEQ ID NO: 58450 - DNA, 601 bp, Human
actctcctggcctcacgtgatcctcacacctcagcctccataagtgctgggattacaggtatagccactgcacccagcctttctgcccatttctgtttctcttcctgtctccctttctcccactctccttgtctgtgtctgactgcaactgcgtgtgtctctctctccctgtctctcctgccttctctgatgctcccttctgtctccctctgtgtctctgcctctccccccacccttttttttttaggcagagtctcgctctgtcacccaggctgaatagctaggattataggtgaacacyagcatgcctagctaatttttgtatttttagtagagactgggtttcaccgtgttggtcaggctggtctcgaactcctgaccttatgatccgcccacctcagcctcccaaagtgttgggattacaagggtgagccactgtgcccggctatgcctcttccttttctacatgcttttgtgcctttcttctccctctccctctcctttgtctgtctgtctccttggttgtctgtgtctccttggctgtctctgtgtctctctgtccctctctctttccttttttttttttctgagatagaatctt

SEQ ID NO: 58451 - DNA, 601 bp, Human
gcggacgcggctgctgagcacgtagttggggtccaggtcgtctccaccctggagagcgggtgggagatcaggaccaggcagatcctccgccctctccagcaagcccaggtctcccccagatgctcccctcagtctccctgttgcttcctttgccttctgcatcctcactgattgggtgtgtggagcctctccccgccacccatacctgggctctgtctctcccttctctgtctctctcccctctcctatctctgtttttctttatacctctctctccccatcttcgtatatttcttttccytttttttttttttttttttctttgagacagggtctctctctgtcgcccaggctggagtgcagtggtgccatcatagctcactgcaacctcaaactcctgggctcaagcaattcccctgcctcagcctcccaagtagctgggactaacaggtaggtatatgccaccatgttcggctaacttaaaataaattttttataaatagagacagggactgggcgcggtggctcacacctgtaatcccaacactttgggaagccgaggtgagccaatcacctgaggtcaggagttcgaaaccagctt

SEQ ID NO: 58452 - DNA, 601 bp, Human
cccgcactgctgtgggagccactgtgcccggcctcaactcctcctatctgaggtggctcccctcggtcattctccaccacacccatgtcttggcttcatggcacttttgaattatcttgttcatctgtgggtttctgtatttcctcttgtctccccaccagctgaacactctgtgagaacagtgagggacccctatctccccacacagggcaagaacccctggaaatgtgtgctggatgaacggatggcaggacgctgggggcagccaggtgtctgcgtaggtcttctcaggggccgtcgrgtctggacagcatccctgaatctccaacacagcaggtaatgctgacagcccgcgccattccccaagcccccacgatttaccaagctcttcccctactttggaaagcgggggcccaaagagacccgaggacctgcccatggaggaacagagccagggctgggtgaccccagcagtggacggggtaggggcgctcaccttccacagagagcttctccaccgcccggcgctcgccacgggagcagtgtgggggcaacgtgtagcccttgatgctgcggccagtgcggacgcggctgctgagca

SEQ ID NO: 58453 - DNA, 601 bp, Human
tcccgcactgctgtgggagccactgtgcccggcctcaactcctcctatctgaggtggctcccctcggtcattctccaccacacccatgtcttggcttcatggcacttttgaattatcttgttcatctgtgggtttctgtatttcctcttgtctccccaccagctgaacactctgtgagaacagtgagggacccctatctccccacacagggcaagaacccctggaaatgtgtgctggatgaacggatggcaggacgctgggggcagccaggtgtctgcgtaggtcttctcaggggccgtcragtctggacagcatccctgaatctccaacacagcaggtaatgctgacagcccgcgccattccccaagcccccacgatttaccaagctcttcccctactttggaaagcgggggcccaaagagacccgaggacctgcccatggaggaacagagccagggctgggtgaccccagcagtggacggggtaggggcgctcaccttccacagagagcttctccaccgcccggcgctcgccacgggagcagtgtgggggcaacgtgtagcccttgatgctgcggccagtgcggacgcggctgctgagc

SEQ ID NO: 58454 - DNA, 601 bp, Human
gtatttttagtagagatggggttttaccatgttggccaggctggtctcaaactcctgacctcaaatgatccacctgcctcagcttcccaaaatgctgggattacggtgtgagccactgtgcctggcctctttttatttgtttttgaggcaggttctcactctgtcaccctggctggagtgcagtggcacaatcacgattcactgcagcctcaacctcccgggctcaagtgatcctcccacctcagtctcctgagtagctgggatgacaggtgtgtgccaccactcctggctcatttttgtmttttttgtagagacagggtcttgctgtattgcccagtctggtcttgaactcctgggctcaagcgaccctccctcctaggcctcccgcactgctgtgggagccactgtgcccggcctcaactcctcctatctgaggtggctcccctcggtcattctccaccacacccatgtcttggcttcatggcacttttgaattatcttgttcatctgtgggtttctgtatttcctcttgtctccccaccagctgaacactctgtgagaacagtgagggacccctatctccccacacagggcaagaacc

SEQ ID NO: 58455 - DNA, 601 bp, Human
aaaaattgtgtgtttatttgtatattcatgtataaaatatgtgtataatgaatttgtgtttgtgcatatgtacaataaatctataatatttatatatcttatacatattcatataatatacagacatacctcgttttattgcattttgcagatactgtgttttttacaaattggaggtttgtggcaactctttgtccagcaggtctattggagccatttttcctacagcatgtgccacttcgtgtctctgtgtcacatgtgggtaattctcacagtactgcagactttctcattattactrtatctgtcatggcgatccgtgatcagtgatctctgatgttactgttttaattttggggggtgccaccgaccttgcccatataaaagggtgaacttaatggataaatgtgtgtgctcggactgccccactgaccagccattccctcatctctccccatctccttgagcctccgtattccctgagacacatgattttgaaatcaggccaattcagttcataaccttacaatggcctcgaggtgttcaagtgaaaggaagagtcaacatttttcactttaaataaaaagcttcataggccagg

SEQ ID NO: 58456 - DNA, 601 bp, Human
taaaaaaaaaaaaattgtaggctgggcgcagtggctcatgcctataatcccagcactttgggaggccaaggcaggcagatcacttgaggtcaggattttgagaccagcctggccaacatggtgaaaccccgtctccactaaaaatacaaaaattagtcggccatggtggcacacgcctgtaatcccagctactcaagaggctgaggcacgagaatcacttgaacccaagaggtggaggttgcagtgagctgagattttgccactgcactccagcctgggtgacagagtgagattctgtctaaaaaaaaaaaaaagaaaaaaaattgtgtgtttatttgtatattcatgtataaaatatgtgtataatgaatttgtgtttgtgcatatgtacaataaatctataatatttatatatcttatacatattcatataatatacagacatacctcgttttattgcattttgcagatactgtgttttttacaaattggaggtttgtggcaactctttgtccagcaggtctattggagccatttttcctacagcatgtgccacttcgtgtctctgtgtcacatgtgggtaattctcacagtactgcag

SEQ ID NO: 58457 - DNA, 601 bp, Human
tttgagaggccattagtaaaaattattataaagtagaatggtagccaggtgcactggcacgagcctgtagtccagatactggggaggctgaggcaggaggatcacttaagcccaggagttcgagtccagtctgggtaacatagcaagacccccatcttttttttttttttttatgagacggagttttgctcttgttgcccaggctggagcgcaatggcgcgatcttggctcactgccacctccgtctcccgggttcaagcgaatctcttgcctcagcctctcaagtacctgggattacagrcatgcgccaccatgcccggctaattttgtatttttagtagagacggggtttctccacttgggcgcctggcccaagaccccaatctttaaaaaaaaaaaaattgtaggctgggcgcagtggctcatgcctataatcccagcactttgggaggccaaggcaggcagatcacttgaggtcaggattttgagaccagcctggccaacatggtgaaaccccgtctccactaaaaatacaaaaattagtcggccatggtggcacacgcctgtaatcccagctactcaagaggctgaggcacgagaa

SEQ ID NO: 58458 - DNA, 601 bp, Human
gttgcaggactggaggaggctgggggaagaggaagccagggggcggggaggggcctcaccagatgccacgggcgtcgggccagtcgcgggccatgcctgaggccagcagcagcggggacacgggcttgtcgaacaggaagtggtcatcgatgagctgctgctgctccttctccgtcatgctcttcagagggtagtacttccctttgaactcgcccgtcaggctgttgagagctatggggacacacgagggagtggtcagcagcctgtcccacctcaaccagggtgtggaggcccagggttycccctgctgctgctcctaacgggcctgggccttggccccctggatgtcctaaaggcacctgaaccctgtgtctaaacccacacttgtgacggctccccaaaatctgttcctgccatctgtccaggcccccaggaatggccaccccatgtgctcaatctggaaaacagacccacctcttcccctgagggaccctcacatccaatccacctgcaggccacagtgtgctggtgcctgctcctaatggctggcaacacagatggctgaagtctcaggactttgagaggccattagtaaaaatta

SEQ ID NO: 58459 - DNA, 601 bp, Human
catcttcccaagtagctgggactacaggcgcctgccactacgcccagctaaatttttgtcatttttagtagacaccgtgttggccaggctggtctcaaactcctgacctcaagtgatccccccgccttggcctcgcaaagtgcagggattacaggcatgagccaccgtgccccgccaagtcttaagtttttaactaccacttctccggtccagatatcccaaaatctgacacacagaccacaggatgggcaggggcggagggcaagatcattttccgtggcatttagaagatcataattaygtatatggccttggttttggtggaggagtgaggagggccgttgcaggactggaggaggctgggggaagaggaagccagggggcggggaggggcctcaccagatgccacgggcgtcgggccagtcgcgggccatgcctgaggccagcagcagcggggacacgggcttgtcgaacaggaagtggtcatcgatgagctgctgctgctccttctccgtcatgctcttcagagggtagtacttccctttgaactcgcccgtcaggctgttgagagctatggggacacacgagggagtggtcagca

SEQ ID NO: 58460 - DNA, 601 bp, Human
cggctcactgcaacctccgccacctgggttcaagcgattctcctgcatcatcttcccaagtagctgggactacaggcgcctgccactacgcccagctaaatttttgtcatttttagtagacaccgtgttggccaggctggtctcaaactcctgacctcaagtgatccccccgccttggcctcgcaaagtgcagggattacaggcatgagccaccgtgccccgccaagtcttaagtttttaactaccacttctccggtccagatatcccaaaatctgacacacagaccacaggatgggcagkggcggagggcaagatcattttccgtggcatttagaagatcataattacgtatatggccttggttttggtggaggagtgaggagggccgttgcaggactggaggaggctgggggaagaggaagccagggggcggggaggggcctcaccagatgccacgggcgtcgggccagtcgcgggccatgcctgaggccagcagcagcggggacacgggcttgtcgaacaggaagtggtcatcgatgagctgctgctgctccttctccgtcatgctcttcagagggtagtacttccctttgaactcgc

SEQ ID NO: 58461 - DNA, 601 bp, Human
accaagcccagctaattttttgtatttttagtagagacggggtttcaccatgttagccaggatggtctcgatctcctgacctcgtgatccgcccgccttggcctcccaaagtgctgggattacaggcgtgagccaccgcgcctggcccaggcactgcttttaatactttacataaattaactcatttaatcctcacaagaacaccagaaactacaaattattgtgatccctatcctatagctaggaaactggggtagagaaaaataaaataagttgcccaaggtcacaaagctagtaaagytagtaaatggtagagctgggatttgaacctagggagtacggttcaagtctgagttcttatttttgagacaggtagctggagtgcagtacctcggtcatgattcacagtaacctcaatcctctgggcccagctgatcctcagcctctcgagtagctgggaccacaggtatacgccatcacgcctggctttttttttttttttttttttttttttttttgagacggagtctcctgtcgcccaggctggagtgcagtggcacgatctcagctcactgcaagctccgcctcttgggttcaggcc

SEQ ID NO: 58462 - DNA, 601 bp, Human
caccaagcccagctaattttttgtatttttagtagagacggggtttcaccatgttagccaggatggtctcgatctcctgacctcgtgatccgcccgccttggcctcccaaagtgctgggattacaggcgtgagccaccgcgcctggcccaggcactgcttttaatactttacataaattaactcatttaatcctcacaagaacaccagaaactacaaattattgtgatccctatcctatagctaggaaactggggtagagaaaaataaaataagttgcccaaggtcacaaagctagtaaakttagtaaatggtagagctgggatttgaacctagggagtacggttcaagtctgagttcttatttttgagacaggtagctggagtgcagtacctcggtcatgattcacagtaacctcaatcctctgggcccagctgatcctcagcctctcgagtagctgggaccacaggtatacgccatcacgcctggctttttttttttttttttttttttttttttttgagacggagtctcctgtcgcccaggctggagtgcagtggcacgatctcagctcactgcaagctccgcctcttgggttcaggc

SEQ ID NO: 58463 - DNA, 601 bp, Human
caggttggatgggcaggtgagcacgtagcccaggtgctggttccacatgaaggggtggccagctttcttaaagatctcctcaatctgaggttcagagagaggaccaggggtcagcgccggcaggcacccccaaatgcacccgcaacatggacagggtccggagggacagggcgtgggaacgtggtggaggtgggattctgaggggaacagggaggtaggagattccgagggtgctggctagacaatggggaccaaggcaggattttgaggggcggggactaagaacgctttgaaggcgggttttttttttttttttttccagagtctctctgtgtcacccaggctggagtgcaatggcgtgatctcgtctcactgcaacctctgcctcccaggttcaagcgattctcctgcctcagcctcccgagtagctgggactacaggcgcgcgccactacgcctggataatttatttatttattaattttttagtatagagacggggtttcaccatgttggccaggctggtcttgaactcctgaccctcctcagcctcccaaagtgctgggattacaggcgtgagccaccgctcccggcctgaaggc

SEQ ID NO: 58464 - DNA, 601 bp, Human
taattctatgttatgtgtcccagttaaatccccaagaatgaaatatcttcaaagaaaaatgaaggcaaaagataggggccaggagcagggacttgaagctggacatataaattgttctgagatgtcaaattaattctttactcatgaaagttacccagttatccacccaagactccaagagtccttttatgtagacaacacgattgtgtttgcccttctgctccagtcttgaccttcagcagtctctaaagaggaaaagtgtttgttacagactctttttgttctcttctgttgtttcacrctccctagtggttgttcatggtcattcttgttttcagttccctgtatatcagttgtagtgagaaggagaaggaggtgactattgtattgtgaaataaggttcaccggattcttatatttgagttgcataaactttcttaaaataactgattcttatatgcagaatcagaagcaaaaatttttgtcctgttgttcctagtggacaatgattcaagaaaatgagtcatgactcagcgatatgaattctcttttagccggggttatttttaactgctgatgggaattccatctatcaaaattc

SEQ ID NO: 58465 - DNA, 601 bp, Human
cggggttatttttaactgctgatgggaattccatctatcaaaattccacatttaattgtgggtatgatctcagcttgtgtttggaagccttaagcaatgccactcagaatactttctttgtacatacttgacaagtaagagagacttactgagtcagtgattaaaattcagatgaaggcctttgtcctctctggtaccctccttgcccctactcaaaccgtgtcattaagctgaattggaaatactgttaactcaagcacatgaagagggaaccattgaggagatcctgttaataatacgwctctatagaactccacatttctgtcattctcaggtttgcaatattttttgagtaaatgagttgctgaaaaacaccttgaaaaagtagtttaggtttgtgcagccctattctttgaagaagaaaagatacctggttctgcttgctctttctaatgtcagatcttggaaaataagcaacttgagctgctggaataaagcaggtgtcgttcaggatcaagtgttgcctaggatagctagcctgttagacaagttgctaactgatgtcctgaatccaattccaaagattacggagtacctttga

SEQ ID NO: 58466 - DNA, 601 bp, Human
aaaggacaagggaagatgtgataagtctattaacagggaaggataatcatctcctgtgtaccaagagctcatttcgaagagtgtgtccagtatgattatagaatatttcttatcagtattttctcaaagtatgggaaactaatccctcaaacaaagggaaatagattatttcaatgctttcaacatgtggtagaggaattgcatcacacagtatttggcctgctttatttatgaatctctattgtacagctgaaatttaaggagtttttttattaattgaaatattttatctttcatatartttgccacatcagccaggttcagtggctcatacttgtaatctcaacactttgggaggctgaatcaggaggattgcttgaggccaggcctggcaacatagtgagacctcccctctacagaaaatttaaaaatcagccaggcatcgtggcatgcacctctagtcccagctactcagaaggctgaggtaagaggattgcttgagcccaggaatcaagactgcagtgagctatggtcacatcactgtactcccgcctgggtgacagagcaaaaccttgtatctttaaaaaaaaaaaagaaagaa

SEQ ID NO: 58467 - DNA, 601 bp, Human
gatatatatgtactcgtacttaacacattaacttttacatatagttactaaagagttgatgatacaaatttaataagaattttccatactttggctttaatataattttgctttaaaaatatgtatttggacttttaaaggatgtgtaattccttgttatattggacgaaaaataacagctttttcatcattgtgaaatgtgaaaatatccaatacaacaaatggaagacgcctaataaatgttaatatccttctttgtctttacaaaactacaaacatgacatactcttgaacatgcccrtcttatcttctcagattaagctctgccacctgtgctgttcttcctgttctgaaccattaaaacacatgtgtttagttttatttctggattcttctagagcaatcttcttcactagttctttcatatcacttgttttactcaaacttgatgttttaatgttagcatattatttatttgttgctgtgtaaaaagttaccacaaacttggcaagtgaaaacagcattcatttaccctgtcccccagccttctctctctctttctctgttgagacagggtctcactttgtcacccaggctggag

SEQ ID NO: 58468 - DNA, 601 bp, Human
cagatatactaaatcatcacgctcaagttcaaaattccgtagatccctaggacaggggcagaaggccaccaggttctttgctaatgcataacaaaagtgacctttgctccagtacccaataagttcctcatctccatctgagacctcttcagcctggacttcactgtttatatcactatcagtattttggtcacaaccatttaaccagtctctagggagttccaaattttccctcatcttcctgtcttcttctcaaccctccacactcttccagcttctaccagttaccaaattccaaagyttcttacatattttaaggtatctttatagcagtgcccaactcttcagtactaattttttggctatgatgtaatccagtataacacaactgtaatcatgatagtgactatacgtcaccttggccatgtaatgtaacctaatcagtggagtggctatcccatcatattacagattccaggcccctgagggtagagaattatacaagggtgtggtggctcatgcctgtagtcccagctgctcaggaggctgaggtgggtggatcactggagcccaggaggtcaaggctacagggtgagccaag

SEQ ID NO: 58469 - DNA, 601 bp, Human
atatctacaaaaacccatcgacaaatatatgtaatggtgaaaagctttcccttttagatgaggaccaaggctgggatgtccattattatccttgctattccacattgtattggaggtctcaatcaatacagtaatcaatacagtaaggtctcaatcaatacaagaaaatatgtaaggattagaaaattaaaacttcacaagtgatgtgatcatttagaaaatccagtaaaaactttacaggcattgagtttagcaagttgctagataacaagatccataaacaaaacctaattgcatttcyatagatcaacaataaactgaaagcaaattttttgagatactgtttacaataacaaaatgtaataacctaggagtaaatcttttaaaagatgtgtaaaacatctaaaaagtaaactataaagctttattaggagaaatttaagaataatctaaagtagatatatactacgtttctggagttggaaaactggtttgtatggtgttaacttttaccctaaattcctttatagattcaatgtaattccagttttaaaaatcttgtgaagcctgggcaacatgataagccccatctctacaaaaa

SEQ ID NO: 58470 - DNA, 601 bp, Human
tgttcaatctgtctctcttttccattgtaatttctcgcttttgtgtcatgcttagaaagcctttttcaacttcagtttatgtctttatccggaatttatttttggttatgtgaaatgagattttttttcagccatatagctagttgtttcagtgcttttttttttttcgaatggtcagttctttgcacagtgatgtaaaagctaccctttatcatcagctaaatgtctatatgtctttttctactctactgatctatttctatatcaatgtcacagtattttaatgattatagattttaawgtttttctcttactgatatagggaattctaattagtttttcctttcaaaaggtatttggccttttattcatgtacttacttttccaaatgaatggtagtatcaagtccctctgtactctcagccaaaaacaaaaaacaaaaaacatgtgttgacatttcagttggaattacaatgaatgtatagattatttgggagataatttactttcatacacatttttaaattttagtcatttttaactttatataaagagcatgttttatatattcttttgaactttttccatgtaaatattatat

SEQ ID NO: 58471 - DNA, 601 bp, Human
ctggtgggaaaaagtttggcattgctgaagttgaacatttatataccctaagcccagagattctattcctatgtatataccaaagaggaattcctacaaaggataaaagaagacatttgcaaggatgttcacagcagcactgacaccaatagcaaaactcttaacaaaggaaatacaatatacttcaataagagactgaacctgaataccaaccccaaccgcaactcttaatctaaatttgttgttatattcaaacaatgtaaaaattatacagtagtcaaataaactacagcaaaaatawggagagatatgagtaatataatatttaaatggaaaaagttcaaaagaatatataaaacatgctctttatgtaaagttaaaaatgactaaaatttaaaaatgtgtatgaaagtaaattgtctcccaaataatctatacattcgttgtaattccaactgaaatgtcaacacgttttttgttttttgtttttggctgggagtacagagggacttgatactaccattcatttggaaaagtaaatacattaataaaaggccaaatacaggattttgtcagttgccttttcagcatgtactgatat

SEQ ID NO: 58472 - DNA, 601 bp, Human
taccttttaatctcttaatacagtgtcataatgatgttgtattaaaatatttattcatttctcccaagtcacaaaagtaaagccaggaaacttaaatatagcaggtcattgaaaatacaaatttgttctttgcagtattcttaaagccttagaattttttgtgttttgtcatccagcataccgaccttgtgctcatctttttactctgcttatctactttcattttacaaaacatcattttggaatttcccaagatacttaaatttttattatttattaactatgtgcagaaaaacttggrgtctctcttcatgccagctaattacactactgctgtaaaatgaagatgcaattagggaaagcaaggcagcaacttactaccatttattctatgctgtagtcagatgatgatggtgaactctgattttgttataaatgactgtagatctttgataaacctttgatgttactgttgttgaattaatttctcctgtcttacagcggcctctgttgaccccaaaccttaagatctttttagcgtatgagaccttaataaatgatagaagaagaaaaaaaattgtgtttgcaattttgtgatttt

SEQ ID NO: 58473 - DNA, 601 bp, Human
ttgtattaaaatatttattcatttctcccaagtcacaaaagtaaagccaggaaacttaaatatagcaggtcattgaaaatacaaatttgttctttgcagtattcttaaagccttagaattttttgtgttttgtcatccagcataccgaccttgtgctcatctttttactctgcttatctactttcattttacaaaacatcattttggaatttcccaagatacttaaatttttattatttattaactatgtgcagaaaaacttggggtctctcttcatgccagctaattacactactgctgwaaaatgaagatgcaattagggaaagcaaggcagcaacttactaccatttattctatgctgtagtcagatgatgatggtgaactctgattttgttataaatgactgtagatctttgataaacctttgatgttactgttgttgaattaatttctcctgtcttacagcggcctctgttgaccccaaaccttaagatctttttagcgtatgagaccttaataaatgatagaagaagaaaaaaaattgtgtttgcaattttgtgatttttttaacatatggactcacagattatataagcttcag

SEQ ID NO: 58474 - DNA, 601 bp, Human
atgccagctaattacactactgctgtaaaatgaagatgcaattagggaaagcaaggcagcaacttactaccatttattctatgctgtagtcagatgatgatggtgaactctgattttgttataaatgactgtagatctttgataaacctttgatgttactgttgttgaattaatttctcctgtcttacagcggcctctgttgaccccaaaccttaagatctttttagcgtatgagaccttaataaatgatagaagaagaaaaaaaattgtgtttgcaattttgtgatttttttaacatatkgactcacagattatataagcttcaggtcccacaacacatgagtctgcctctgggtgtaaggggtgaagagtgggggttttatttaccccagttcttgcccacaattgtgctatcactgctagaaagctgatctctatgatggggagccaatcgttgtttactttactttcagtaattaaagttaatttaatctacttgattaaaattttatctcatatcctatttaactccacccccaaccccaccatggagtaggagatagccagccagttctttcactcctccacccctgctctaccc

SEQ ID NO: 58475 - DNA, 601 bp, Human
gaaacctccatactgttttccacacgggctgcacaaatctgcatttccaccaacagtgtacaagggttcccttttcctcccactcttactaacacttgttatctcttgtttttttgataatagccatcctaaaaggggtgaggtgatatcttattgtggttttgattttcattttcctgatgattagtgatgttgagcatcttttcatatacctgttggccatttttatgtcttttgagaaatgtttattcaggttctttgcccattttttaattaggttattcaattttttggcattgcrtcgttatatatttttgatattaaccccttatcagatacatggtttgcagatattttctcctaatgcgtaggcctccttttcattttgttgattgtttcctttgctgtgcaaaaaaaggctattaacttttatccggtaccacacgtccaaagttagatttaaattaacatagttttcattgtaaaattagcaatggtaaatttgtcgaagcattaaacagcctcattaaatgttcataggagcaaataaccatgtcaaataccctgttcagatatggaaaaattttgctcatttaacaaa

SEQ ID NO: 58476 - DNA, 601 bp, Human
aattgcaggagatgttaccctaatgattttcagtttacttacagagcagtgctaatcataggtatattgggtttatatatccatctatgcatctactcaataaatattaggtagctactatttgcttgatattttgttaggtgctaaaagtgataggctccaagaattgtatatactatgagtaaaatgtaaaatataactttatattaaagaaaaaatatttcaagaatagttatgcattagctactttctgggtctttttgagaaggagttatctgttcattaacaacagctgtcactktatttactttttttttcttagaagaatagctttagtatttaaagaatctgattatctttaattctagataatcattaacgtctttaaacagaacctgcctttagctttgaatggaatatttctgttgagcacatgttttataatactgttgactaccttgcttttttttttattactttacatcttgatagcctttttcactgaaatcaaagcaacttctatgtatatattaaatattcatatgatgggaatacttctgatgctaacatccttgttacattgtggctttgcatgtctaag

SEQ ID NO: 58477 - DNA, 601 bp, Human
ctgtcgctcaggctggagtgcagtgacatgatctaggctcactgcaacctctgcctcccggcatcaagtgattctcctgcctcagcctcccaagtagctgggattacaggcacgcaccactatgcccaggtaattttttgtgtttttagcagagatgggttttcaccatgttggccaggctggtctcgatctcctgacctcaggtgatccacccacctcagcctcccacagtgctgggattataggcatgagccaccatgccaacctagttgccttttagaaaactagttattcttgcttycagtcctttatcacaatagtgtattgaatgtccgtaagttcaatagtaatcctccaaatatttgagacatattttaatattatatagattattactttgaattatacttgcaatcagtacccatgatttctcagtcaccattgcttgaagacactttgtttttcaaataaatgcctttttatgatattgaaatataatttgtatagtagattattcatggagtagcatgcctaattttatccttaaaatgtcaaccaacatcaatgttaaatttcctgattttaatttttgttcttggtt

SEQ ID NO: 58478 - DNA, 601 bp, Human
cttagtgaagtgcctagtaaacagtaaatgtcagcccagtaagtagcacatgcatatgtgtatatgcatatatacagacatgcacatacacacaggaaatgcatatgccctcaaataggaactctgtaagtcaccaagcattctccagacactttctatatttttaagtaaataatgaataaagttaattagtaagtacttactacacataagacgacatggtaaactgccaaaatgtatgggattttgttttttatgtagaaaattatagtcaaacattctttctttcttttttttttttctccttagaaacagggtctcactccgtcacctagactgcagcacagtggcacagtcatagctcactgcagcctcaaactcctgggctcaagcgatccccctgcctcagcctcccaagtagctgagactacaggcacatgtcaccacatccggctaatttttgcatttttcgtagaagtggggtctcactatgttgcccatggtgttatcaaactcctgggttcctcagcctcccaaaatggtgggattataggcatgaaccaccatgcctaaccttcaagcattatttctgacagcccta

SEQ ID NO: 58479 - DNA, 601 bp, Human
gtaaacagttataaatctactatatgctaggcattaaaattttttaaaaacttagtagaacagaaattttgttttctaaaggtatgagatattgttgagaaaaacattatgtaaacaagtaattttaataacataatagtaataacaatgaaagtacggacgtgagagccattagttctactttaagatgtcagggaagacctggagaggtgacatttgagctgagtctcaagggaacagttcaatattgtcagatgtatatggtagagtgataccacacaagaggtaccaaagtcattcrgcaaaaatctttgagcttctactgtgtgtcagataatgttttaggcagttgaacaaaacaaaacagttgtctagttgttctatacaaatgaacaaaacaaatgacttttttctgccactttcagtggaacatgtaaaggcgtggaagtgaggtaaataatacagaatggctgagtcgagaggagtctgggggtccctgacaagaaaaaagcagaagccgtgtcacaccaggaagtttgagtgtaatcctgtaggctactgatgtccaatcccagagctccagggatactggtgtgtcatg

SEQ ID NO: 58480 - DNA, 601 bp, Human
gtcctaaaatattcagcctggcatctcctgccagtgttgaacctgttaaaacttctagagctaccatctaaaacttcagttaatatttgatgagctccatctaagtgccaagcactgctctagccactaggattacaaagattaatataaaacaaggtccatgtcctcagggaacttacagtcataatgaaatagagtctagattaaaaataaataagactgaagtaagcatggagaaaagggtatagattcaggatatgttaaggaggtagtaactcttaatcaatgagaatctctcacygaaagcagactactagaatagaagcaaagaccagattcttaggaaaagagctagtgttttgctaatacaggggaaaaaaagctctatcttttattaagaatattgttttatcctagtaacaagcctaatcaatctccagagaacaaggatattaataatttatggttctgtgaacatacctcttctgcttgatttttctctgcctggtaataaggtataaacctgtgaaataatcttaagtcaaaccatgaaaatatgtaatgtaaacgatgtaaaaaattcatctggatctgacacctt

SEQ ID NO: 58481 - DNA, 601 bp, Human
ctagtaacaagcctaatcaatctccagagaacaaggatattaataatttatggttctgtgaacatacctcttctgcttgatttttctctgcctggtaataaggtataaacctgtgaaataatcttaagtcaaaccatgaaaatatgtaatgtaaacgatgtaaaaaattcatctggatctgacaccttcatgatgatgttgcagaacagtcattctctatgttgatctctgtaccttcagcccaacaagcttacttctcttctttcagatttcagccttctttcccacacacacacacacacacacacacacacaaatacacacacacacacacacacacttcctttctttcctcgcaaagaaagacagctattgactagaagcccagaattgcccccaagttccgaccaccagctcgaattcttatgaagtggacttgtaatatccttaatgttgctgttggcagtcagttacagattccattattgtcgatcagtgcagtcgccatgcgaggtggggggaggaatggaggaggaggagaagaaaggagggatgagagcttcctattcacagatttatcaacctgccttttcttgcagga

SEQ ID NO: 58482 - DNA, 601 bp, Human
gcctaatcaatctccagagaacaaggatattaataatttatggttctgtgaacatacctcttctgcttgatttttctctgcctggtaataaggtataaacctgtgaaataatcttaagtcaaaccatgaaaatatgtaatgtaaacgatgtaaaaaattcatctggatctgacaccttcatgatgatgttgcagaacagtcattctctatgttgatctctgtaccttcagcccaacaagcttacttctcttctttcagatttcagccttctttcccacacacacacacacacacacacacacacaaatacacacacacacacacacacacttcctttctttcctcgcaaagaaagacagctattgactagaagcccagaattgcccccaagttccgaccaccagctcgaattcttatgaagtggacttgtaatatccttaatgttgctgttggcagtcagttacagattccattattgtcgatcagtgcagtcgccatgcgaggtggggggaggaatggaggaggaggagaagaaaggagggatgagagcttcctattcacagatttatcaacctgccttttcttgcaggaaatcttcgta

SEQ ID NO: 58483 - DNA, 601 bp, Human
aatcaatctccagagaacaaggatattaataatttatggttctgtgaacatacctcttctgcttgatttttctctgcctggtaataaggtataaacctgtgaaataatcttaagtcaaaccatgaaaatatgtaatgtaaacgatgtaaaaaattcatctggatctgacaccttcatgatgatgttgcagaacagtcattctctatgttgatctctgtaccttcagcccaacaagcttacttctcttctttcagatttcagccttctttcccacacacacacacacacacacacacacaccaatacacacacacacacacacacacttcctttctttcctcgcaaagaaagacagctattgactagaagcccagaattgcccccaagttccgaccaccagctcgaattcttatgaagtggacttgtaatatccttaatgttgctgttggcagtcagttacagattccattattgtcgatcagtgcagtcgccatgcgaggtggggggaggaatggaggaggaggagaagaaaggagggatgagagcttcctattcacagatttatcaacctgccttttcttgcaggaaatcttcgtaaagg

SEQ ID NO: 58484 - DNA, 601 bp, Human
atcaatctccagagaacaaggatattaataatttatggttctgtgaacatacctcttctgcttgatttttctctgcctggtaataaggtataaacctgtgaaataatcttaagtcaaaccatgaaaatatgtaatgtaaacgatgtaaaaaattcatctggatctgacaccttcatgatgatgttgcagaacagtcattctctatgttgatctctgtaccttcagcccaacaagcttacttctcttctttcagatttcagccttctttcccacacacacacacacacacacacacacacacatacacacacacacacacacacacttcctttctttcctcgcaaagaaagacagctattgactagaagcccagaattgcccccaagttccgaccaccagctcgaattcttatgaagtggacttgtaatatccttaatgttgctgttggcagtcagttacagattccattattgtcgatcagtgcagtcgccatgcgaggtggggggaggaatggaggaggaggagaagaaaggagggatgagagcttcctattcacagatttatcaacctgccttttcttgcaggaaatcttcgtaaaggg

SEQ ID NO: 58485 - DNA, 601 bp, Human
caatctccagagaacaaggatattaataatttatggttctgtgaacatacctcttctgcttgatttttctctgcctggtaataaggtataaacctgtgaaataatcttaagtcaaaccatgaaaatatgtaatgtaaacgatgtaaaaaattcatctggatctgacaccttcatgatgatgttgcagaacagtcattctctatgttgatctctgtaccttcagcccaacaagcttacttctcttctttcagatttcagccttctttcccacacacacacacacacacacacacacacaaayacacacacacacacacacacacttcctttctttcctcgcaaagaaagacagctattgactagaagcccagaattgcccccaagttccgaccaccagctcgaattcttatgaagtggacttgtaatatccttaatgttgctgttggcagtcagttacagattccattattgtcgatcagtgcagtcgccatgcgaggtggggggaggaatggaggaggaggagaagaaaggagggatgagagcttcctattcacagatttatcaacctgccttttcttgcaggaaatcttcgtaaaggggg

SEQ ID NO: 58486 - DNA, 601 bp, Human
ctggttatctaagctgcttccagtgtaggaacctgtttctttttctttgagtgtctttattctttattttcgtatgatttttcctgtcattaaacacacttcattattcagtgttatcctggctttttctttcagactaaagcataacaccaagagacagaaggacaaatctcccttctcttctcttataccaccctcttttaaccctatttctttccccctccccctggttgtattagattgatgtcacagagacagaattcagagtggagggaggatcacattttctctttcatcattrctgcctagccagcaatttaagtgttggacccccaagaatttagtctctgtatcctttttttctcacttcatcattcagtaattgtgctctgtatggaaaagttttctggctggagaatgagtctcctttcccccggtgatgtggcggagtggttggatagtagcaccgaagaagagaagagccttctgtcatttctgggtacggtagggcttgcttgttcttttaaccctttattgtctgaacttttcttacttttgggaataggaccccaaattctctaaatccacttttgtattttta

SEQ ID NO: 58487 - DNA, 601 bp, Human
tgcaagaaaagtactttgtgctggttaggatctactacttacttctgtacagtaaccacctaactgatgttcaggccttcccaataacgtagctcactgctagtttgatgaaacttcatacaactgtgcactgttattaatctgttaaaaaaccttccatggtttcttcatcacctaccagataaatttaaaacaccttactgtgaaacttaatttggcctttcacacctgacattctattattcattttagaggagaaaatccccaagcctcccttccaaccaaattgatttacttcctrtcttggaacaaatattgccctttcctaccttgtttcttctgtcagcagtgttcaaactcagctttctaaattcagctttttaaaactctgcccttgtttcaaaactttcttataaataaatgcaatgttctagacactgctagatgctgtggctggatacagagaagtataagaaaaagctgcttgtgagaggcatagtgtttggctagggagaaaacatgaactacgcacaagttaaatgagaaaaattaaatggtaattcagacgacagtggagaaaatgaaaataaggcagttccta

SEQ ID NO: 58488 - DNA, 601 bp, Human
aaactcgaaatctagacagtaaactctcctgggggcatttaccaattttagaatattagagttaagttttaatggctataatataggagatgggccaagggtctaacaaagtaaagaattagaactgaaaggcctatgtcattcttccccataggactgggcctctgaatgagttacaccttcagtgagagttgaagttagaaaaatctctcattgacaaatatagacaaatcttaattatcttaacctggactggtaggtgaggtgggagggggaaaaacatcctgagaattcataatcmcagtcgtgataaggtaaaactgaaatagtggacaacattaatatgtcagagataggaagtgggtaattggaattgaagtattttaagattgttgaattattcgagaaaaggatagaaatcgtgattaactttaggctttaagtatacgtgttaaaatgttaaggacaactactagaagagtaaaaatagagtatttttattgaaatatttgaaaatattaaaaaatattttcaaaagcaatacagaagaaaatggaattttttaaacctgattaacctgattttaaaaaaaagaaaatca

SEQ ID NO: 58489 - DNA, 601 bp, Human
ccctaaataatgataaaatataaaaatcactaggaagacataacaatcttacatgtacccaataacaaaacctcaaattttatttggcaaaaatggacagaaatggataattctacagtcctatctataaaaattagtaaggatatagagaatattcaaaaatgcagtaagcttgatttaatggacatatatagaatcctgactccaacaattagtcttctcaagcacatacagaatctttataaaaactggcaatagaccaggtcataaaacaaatctcaacaaatttcaaagttatacrgattgcattctctaataacagttgaactaagttagaaattagtaacaaaaatttactgtaaaaacctttatttttgcagtcttttaaagttacttgcaaataacttgttagtcaaaaaggaaaacataatggaaattataaaatactaagcaatactgaaaatagtgtatatcaaaacttgtggaatatcactaaaatagttcttaaatgaaatgtgtagtcttttacattgaaaagggcaaaagctacaaatcaatgagctaagcatttaactcaacaagttagataataacaaaccca

SEQ ID NO: 58490 - DNA, 601 bp, Human
aaatgattaaattttcatctttatattacaggtttacatatttgtatgttttctttttttaatgtcctctattaatatttgtttgggaaataaaacccaaacagaggctctggcataatcaagactaaatcttttttttaatgttcactgactaccaaaatgatggtatgaataaatctaccattatacccccaattgtacatgaagcatattaacaatgagaatatattactaaatcagttacagaaaaagttatatatgaagcatattaataatgagtatatattattaaatcagttayagaaaaggtttaaataaaggtgttaggccctatctgtagattagaagagatagttgatgacaaaataaaactcaccaaactgaagttgataccttataaataccaaactgaagttaatacattataaataattggactgacatgttcaaaatagtcattttatgctgaacaatgctttgttgtttagtaattgttctttgcaaaacctaaaatattaatgctttttatctctgttcatctcatacaacttatctaagtacttatctccccacataggtatactgaagattagtggcattg

SEQ ID NO: 58491 - DNA, 601 bp, Human
ttttcggagtcttttggaacctaaccctcagttaatatgatagacatttcactttactctctttccaaacataataacattccagatttattctgtatcacattcattattcaaaatcctgaaaagaaaattgacctggtggagttggctcaagcctgtaaccctagcactttgggaggccaaggcgagtggatcatttgagcccaggagttagagactagcctgggtaagatggtgaaataccctttctagaaacaggcatggtggcacacacttatagtcccagctactcaggaggctgaggtgggaggatcacttgaaccccggaggtggagtttgtagtgagcccagatcataccactgcactccagcctgggcgactgtcttaaaaaaaagaaagaaaaagaaaagcattaagaaataccagtaagtgtatatctatggactttcaatacgatttgtaccttttggtgacgcatgtctgaccaggtggtttttcattttagagttaaaaaaaaaaagtccttacaagagaagattaatgagtttatatgttttggtgcaaaattagctttttggaagaaaggggttctttaaaata

SEQ ID NO: 58492 - DNA, 601 bp, Human
cagaaaaggtgaaatggcttacacagaatcgtacatatcattggtagagctgctaagaaaaacatccagatgttctctttgttcaatacatcattctatatggagctgtattggaggttatctctcatcattttaagtcatcacatcatctgaggtcatatccaatggcaaaggaaatgaagagatacatttaaaacttaaccaggctttttataactctttttgcctttcaatctgaagatgaaaaatattatgtttagagatgagaaagtgaggcagtttcaggcctttatctgaaacratactgtatctctcttgtctcatcagtctcagagaatgagcatattttaaaatgactgtaattaaatattgtaactatgaaaagaacattaattttacagcaggtgaaaataatgcaatagtatgtagcatgagtgggggtagaggatacagctgtctaattttggtctactggaactagtgtagattttccttcaaactgagcagaaatgtagctcttagagcatagtagcagctttcctttctgcttacagatttaaagttaaaggcacaagtttaatatgctgttcgttctgtgact

SEQ ID NO: 58493 - DNA, 601 bp, Human
gtaaacttcttttcattaggtgatttagctttaccttatttcttccccttctttcccctttttagtggaaattgttcaaacttcaggaatgatttaatatcttctttctggacccgataatacatcatataagctacatcagcattgtattttttcccataatacagaaagagaattttttttttaattttattattattatactttaagttttagggtacatgtgcaccatgtgcaggtttgttacatatgtatacatgtgccatgttggtgtgctgcacccattaattcatcatttagyattaggtatatctcctaatgttatccttcccccctccccctaccccacaacagtccccggagtgtgatgttccccttcctgtgtccatgtgttctcattgttcagttcccacctatgagtgagaacatgcagtgtttggttttttgtccttgcgatagtttgctgagaatgatggtttccagtttcatccgtgtccctacaaaggacatgaactcatcattttttatggctgcatagtatcccatggtgtatatgtgccacattttcttaatccagtctatcattgttggaaaaaagaga

SEQ ID NO: 58494 - DNA, 601 bp, Human
aagggacttacagttactggtcataattttaaaatacagtagtagtatggaactctcttgtactgcaagcatacaagatgctatgttgtcagcctctcagtctttaggaatgttccaatttggcttgtgccttaccagtcaagatgtcacagagaagatatgtttagtcatggaaaagaaaatcagtgtccagcatgcaaagatagtaaaagggtaagcacttccagttggattttcataggaggaattgatttgtgtgcattactggatctgtgtaaaatggtgtccttttggcactagstggatatacatttcagtaaatgttttttcttgctgcagattagtgtaagacagtgaaattttcagtaactgagggaaggcagtggttgggcatctgttaatagcctgaaagtaactaatgaggatgtgcagtcagaacgattgattgaatagctgcagtcctgtgtatttctttcttgcttgctctctgcaagctgtggagagggagggggaagagcaagacacagagagggagcgagagaaaaaacgctctctcttaagtggaagtagcacggatcccaggggccaggaggccagaaat

SEQ ID NO: 58495 - DNA, 601 bp, Human
aagttcaaattcctctcaactgtagagttcaaatccttgcagacatctttttatcaagttgctagcaaaaacctatcacaattctgtaaagaatctggtggcaggttttttttttaggaacgggatgtggttttttttatttttcagagctggaacataagcagagagtgacgagactcagaaagttgcagactaaattcacagagaattagacaattgtgaattctaatcctaagacttggtctgcactttgcttaagctatcttttggatgaccatggaagtgcttaagaaaaaccttraaagaaactaactccttaaattgaccaggcagtattgagaatcagcattaaatacaaaagaggctgggcctagtggttcacacctgtaatcctagcatttttgggaggctgaggtgggaggattaattagaccttaaggatattattgtgttccaggatggtctatagtgcagaaattgacattgataataatgatcctgaatcatcaagaaaaagtgagattatatttatttcactatttttttaaaaagtggaactatgtttgtgacatgcatccattgagaacatttaaaatgttga

SEQ ID NO: 58496 - DNA, 601 bp, Human
ggccacatgttgtatgattccatttatatgagatgttcagaataggcaaatctatacagaccaaaaaagagattagtgtttctcatgagttgggtgagggagaaatgggaagtgactgctaatgggcatggggtttctttttacataatgaaaatgttcaggaattagactgtggtgatggttgcacagctttggggatatataaaaatcactgagttgcatcttttattttttacttacttttttttttttagatagggtctcgctgtgtcacccatgctggactgcaatggcacaatcktggctcactgcagcctcaacaacccaggctcaaacgaacctcccacctcagctgtgaagctggaaccacaagcgcatggcactgtacctggctaattttttttttttttttaacttttggagagatgggatcttgcttatgttgcccaggcttgtctcaaactcctgggctcaagcagtcatcctgctttggtcttctaaagtgctgggattacaggcatgagtcaccatgcccagcagagttgcacactttaaaagggtgaatttatggtatatgaattgtatctcagtaaaacttttt

SEQ ID NO: 58497 - DNA, 601 bp, Human
tggttgcacagctttggggatatataaaaatcactgagttgcatcttttattttttacttacttttttttttttagatagggtctcgctgtgtcacccatgctggactgcaatggcacaatcgtggctcactgcagcctcaacaacccaggctcaaacgaacctcccacctcagctgtgaagctggaaccacaagcgcatggcactgtacctggctaattttttttttttttttaacttttggagagatgggatcttgcttatgttgcccaggcttgtctcaaactcctgggctcaagcartcatcctgctttggtcttctaaagtgctgggattacaggcatgagtcaccatgcccagcagagttgcacactttaaaagggtgaatttatggtatatgaattgtatctcagtaaaactttttaaaaagtaaaacaccaggcttaggagacttaggataaaaaatttgaaaatattaatactttaatattgattataaattgaaataatgttttagatatattttagatatgtaatatattacatattggctgcttattttctacagttttttttagttaatcgtttctgatactttgcat

SEQ ID NO: 58498 - DNA, 601 bp, Human
cgtctcccctgacaatgaaaaaaaatagtatttcacattatattatctaatgctttttcaggccttccatgataacctctgagagactgtccaataggctaatagacctcactttgaggtcttcattttgacccatcatttctcattattatattccttaaagccatcatcctcaatattcatactttgtgaacttgaatgagattagcacagtctctgttagtcataagaaaatcaacatactatatagagtatgtatgacattcaatttacaataaaatttaaaaaaaatcagtatacrcctcattaacaggaactgaagtgttctacagaagtgaattttccagatactaaacttttcttccttaaccaccagatttagtttggttttaataattttgagggggttttccctcctatgtgttatttccgtactttcttgagtgaattcaacttttcttaataattcacattaatcattatcagcattctgcaaatacgtattaagtagcccactgtatgctaagcattacagaaatatgaagatgagctcaatgtgtttgttttctgtttgccttcaggagttaagattcatagggaa

SEQ ID NO: 58499 - DNA, 601 bp, Human
agtgggagagactaagtcctattagagtaatcaggaatggtttcctcaagaattggtacttgaaataaatgatataaggacaactgagtaaccatgtggaaaaagataatattagatgtgtatctcataccttacacaagagtaaactccaaatggattagggatctaaaatgtgaaaaaaaagcatacctagtcggaaacatggatgaattctctaaccttaatgcagggaaaaactttctatgatggttactgaaaagccagaggcaattttttaaaaatagattgataaatttgattrtacaaaagaaagttttttaataattgcgtgacaaaaaaataaaaaaattaaagttaaaagacaaccaatgaatcaattgagagaaaatatttacaacatgtaggaaactattaaggtcgggcacggtggctcacgcctctaaccccatcattttgggaggctgaagcaggcagatcaccaggtcaggagttcgagaccagcctgtccaacatgccgaaaccccatctctactaaaaatacaaaaaattagccgggcatggtggtgggcgcctgtaatcccagctactcgggaggctgagg

SEQ ID NO: 58500 - DNA, 601 bp, Human
actccaaatggattagggatctaaaatgtgaaaaaaaagcatacctagtcggaaacatggatgaattctctaaccttaatgcagggaaaaactttctatgatggttactgaaaagccagaggcaattttttaaaaatagattgataaatttgattgtacaaaagaaagttttttaataattgcgtgacaaaaaaataaaaaaattaaagttaaaagacaaccaatgaatcaattgagagaaaatatttacaacatgtaggaaactattaaggtcgggcacggtggctcacgcctctaaccycatcattttgggaggctgaagcaggcagatcaccaggtcaggagttcgagaccagcctgtccaacatgccgaaaccccatctctactaaaaatacaaaaaattagccgggcatggtggtgggcgcctgtaatcccagctactcgggaggctgaggcaggagaattgcttgaacccgggaggcagaggttgcagtgagccgagatcacgccattgcactccagctgaggctacagtgcgagaccccgtctcaaaaaaaaaaaaaaaaaaattaagggacaagtgactaagacccaatagga

SEQ ID NO: 58501 - DNA, 601 bp, Human
aaatacaaaaaattagccgggcatggtggtgggcgcctgtaatcccagctactcgggaggctgaggcaggagaattgcttgaacccgggaggcagaggttgcagtgagccgagatcacgccattgcactccagctgaggctacagtgcgagaccccgtctcaaaaaaaaaaaaaaaaaaattaagggacaagtgactaagacccaataggaaaactgaagaaaagaaagacgtgaagaggtaataggtaaaaatgtttctgaacatatgaaaacaatgttcaaattcacttataatcagasaaatgcaattttttgtttatgtgtttgttttttgagacagagtctcgctctgtcgccaggctagagcgtagtggtgccatctctgctcactgcaacttctgcctcctggattcaagccattctcctgcctcagcctctggagtagctgggactacaagcccgtaccaccacgcccagataatttttgtatttttagtagagacagggtttcaccatgttggccaggctggtctcaatctcttgacctcgtgatccgcccacctcggcctcccaaagtactgggattacaggcgtgagcaa

SEQ ID NO: 58502 - DNA, 601 bp, Human
cactttgattttagccagatgagacctgtgttggacttctgatcgatagaactgtaagataataaatttgtactgtttaaaccacatttgttttaatttgttataatggcagttgaaaactaatacagtggaaaactggtgaatttagaattagggctgtgtttaggtgagtatagtacctatgttaatttcttagttttcataatcatactatggttatataagataataacattaggggaagctgggcaaaggaaaactctgtactatttttccaaattttttgtacatctaaaattayttcatatctagaggaaaaataactaaggattccttccctcctcagtgtcctttccccactctacctcattaacatccccttaaaaagttgccatgtcgtcttgttatttgtgaatttccaaccaagcttttaactcagtggtttccaaaccatatgtccacataaagacttgttcataaatgtttatggcaactttattcttaatatcccaaaactggaaataactcgaacgtccatgagttgacaaatggttaaacaattgttggtgtacccatacagtggaataaaaaggagcaaact

SEQ ID NO: 58503 - DNA, 601 bp, Human
aatttttaaaaattttacctcctagagtcctaccaggttctcacagtgaatatctgagaaaattcccctcatttttccagcagggagaagggaaaggaggcattttgaaatgcatcagagctttctttctctttctttttctttctttctttctttctttttctttctttctctttctttctttcttttctctttctttccttccttccttccttccgtctgtccatccgtctgtctgtcttttcttcagagtcttgctctgtctcccaggctggagggcagtggcacgatctccggctamtttttgtatgttttgtagagatggggttttgccatgttggccaggctggtctcaaactcctgacctcaggtgatccgcctgcctcagcctcccaaagtgctgggattacaggcatgagccaccacacctggcccgttctgtttttcttaacaaggtctgctctcagaagaaactaatcagagcctaactgatcagaaggaagggaaatacccaattccagcactctctagccatccccttccacctaagtggggtgggtggggtgaggggcactgagcagcacttatgaagttcacagtc

SEQ ID NO: 58504 - DNA, 601 bp, Human
gactatcaatgtatgacattctagaaaaggtaaaactatggaatcagtgaaaagatcactgtttgccaggggttggagtgtgggaggtactgagggatgaataggcagagcacagaggattttgagtagtaaatatactctgcataatactataattgtggatacatatcaccatgcatttgtccaaacccatagaatgcacaacaccaataacaaaccctaaagtaaactatggaatatgggtgatgatgatgtcaatgtagattcgtcagttgtgacaaatattccagtttggtagggsatgttggtgggagtggctatgcatgtgtagagggaaggggaggaacattggaaatctttatatcttctactcagttttgctgtgaatctagaactaagttaagaagtattgtctctgcttctatcttctatcttctgaaagacattgtagagaattggtatcatttcttcctttaatgtttcatggaattcaccagaggaacccatctgggcctggtgcttctgttttgtaaggttattaattattgactcaatttctttaatagatatagccctattcatattgtctatttcttcctgt

SEQ ID NO: 58505 - DNA, 601 bp, Human
gaattgatctgtttcacctagattatcaaatccctttttaccattttaaggtccatagaacctgttgtgatgacccctcttttatttctaatataagtcatttgggtcatctctatttttttcttagtctggctacagacttacaaattttattgatcttcataaggaaccagcttttgattttattgcttttatctattgatttattgttttcaatttaatcgattctgcactaatttttatttcttgtgtttgctttggatttaatttgctcttttttttctagttttctaagatagamacttagtattgggtttagatctttcttcttttctagtatatgcattcaatgctataaattttcctctaagcactgtttttactgcataccacaaaatttagatgctatgttttcatttttatttcattcagttcaaagtgttttttaatttctcttgagatttcttctttgatccatgtgttgttcagaagtatgttgtttaatccccacatattttgggattttctagtcatctttctattactgatttctagtttaattccattatgatctaaaagaagacattgtatgatctctatt

SEQ ID NO: 58506 - DNA, 601 bp, Human
tttaattggggtatttagactattgacgttcgaagtgattattgacatagttgggtttctaaccatatttgttaactgttttctatttgttgcctttgttctgtgtccttatttttgtcttccactgtttataacctttcgtgattgtaattgaatgacttatatgattccattttctctcctttcttagcatatcagttatacttattttttaaaaaatttagtggtttccctagaatttgcagttttttaaatgtataactaatgtaagtccactttcacataacactatacaacttcrtagatagtatgagtaccttataataaaataatcttaattcttccaccttgtcatttgtatcattattattcatttcccttatatataagtatacataagcatatatatcatatagacataagcatatatacataagcatacataattaaatacattgttgttattacttcaatattaaatcaattaagaagaaaaataaaaggtggttttattttcacttattccttttatactctttgttttcttaagaaggtccaatttgtgacctatattgttttcttttctctctaaggaacttct

SEQ ID NO: 58507 - DNA, 601 bp, Human
gtctactaataagcctgtgcataaatttatatttagtatctaaagtctgtattaaatggcaagttccttgagggcagagtttgtgtttatctttgatttccttacaactcctagtagagttctctacaacaaataagcataagttttattaaatacaatgtatcatattatgtcatatgaggtatgatatgatatgtgccacaaggctggacgcagtggctcatgcctgtaatcccagcactttgggaggccgaggtgggcggatcacctgaggtcggaagttcaagaccagcctgaccarcatggaaaaacaccatctctaccaaaaatacaaaattagccaggtgtgtaattccaactgtaatcccagctactcgggaggttgaggcaggagaagagcttgaacctgggaggcggaggttgcggtgagccgagattgcaccattgcactccagcctgggcaacaagagtgaaactccgtctaaaaaaaaaaaaaaaaaaaaaagtgccacaaaaaggtagaattaaattactagatttaattagtagacagtctactaatactgtctcagtcaaatgcttaactgtattttcattagaa

SEQ ID NO: 58508 - DNA, 601 bp, Human
aagtctgtattaaatggcaagttccttgagggcagagtttgtgtttatctttgatttccttacaactcctagtagagttctctacaacaaataagcataagttttattaaatacaatgtatcatattatgtcatatgaggtatgatatgatatgtgccacaaggctggacgcagtggctcatgcctgtaatcccagcactttgggaggccgaggtgggcggatcacctgaggtcggaagttcaagaccagcctgaccaacatggaaaaacaccatctctaccaaaaatacaaaattagccrggtgtgtaattccaactgtaatcccagctactcgggaggttgaggcaggagaagagcttgaacctgggaggcggaggttgcggtgagccgagattgcaccattgcactccagcctgggcaacaagagtgaaactccgtctaaaaaaaaaaaaaaaaaaaaaagtgccacaaaaaggtagaattaaattactagatttaattagtagacagtctactaatactgtctcagtcaaatgcttaactgtattttcattagaaatatatgtatgatttttggtcgactcctcggcctggatctca

SEQ ID NO: 58509 - DNA, 601 bp, Human
atgatatgatatgtgccacaaggctggacgcagtggctcatgcctgtaatcccagcactttgggaggccgaggtgggcggatcacctgaggtcggaagttcaagaccagcctgaccaacatggaaaaacaccatctctaccaaaaatacaaaattagccaggtgtgtaattccaactgtaatcccagctactcgggaggttgaggcaggagaagagcttgaacctgggaggcggaggttgcggtgagccgagattgcaccattgcactccagcctgggcaacaagagtgaaactccgtctaaaaaaaaaaaaaaaaaaaaaagtgccacaaaaaggtagaattaaattactagatttaattagtagacagtctactaatactgtctcagtcaaatgcttaactgtattttcattagaaatatatgtatgatttttggtcgactcctcggcctggatctcaacctaggcctagcaatcctattacaattctataaacttaagcctggtttgctagctacatttattagcaaatgtggtgactcattctgattgagtcatagaaaatagtacataaagcctttgcctttatgtactaatgact

SEQ ID NO: 58510 - DNA, 601 bp, Human
tcaaatgcttaactgtattttcattagaaatatatgtatgatttttggtcgactcctcggcctggatctcaacctaggcctagcaatcctattacaattctataaacttaagcctggtttgctagctacatttattagcaaatgtggtgactcattctgattgagtcatagaaaatagtacataaagcctttgcctttatgtactaatgactgtgactaatgacagtgactctccctaatgacaccaaaattgtacagttgacccttgaacaacatgggggttagagacaccaccctgctrtgcagttgaaaaatttcatataacttttgactcacccaaaacttaactactattagcctactgttgactggaagccttgccaataacatatacagtcaattaacacatcttttgtgtgatatatgtattatatgttgcattcttaaaattgtaaactagagaaaagaaagtgttattgagaaaatcataaggaaaagaaaatatactatttactattcattaggtggaagtgaatcataaagaccttcatcctcatcatcttcacattgagcctttttcccttgcctttagtcaatctct

SEQ ID NO: 58511 - DNA, 601 bp, Human
tttttgggttagggtttcattctattgccccggctggagtgctgtggtacagtcatcacttactgcagcctcgaactcctgagttcaagcaatcctcccacatcatcctcctgagtagctgggactacaggcatgtgctaccatggctggctaaattttttattttattttattttatttttgtagagatggggtctcgccattttgcccaggctggtcttaaattcctggcctcaagctatcctgtcacctcagccttttcaaaatgctgggactacaggcatgagctaccgtgtctgastgagaaattttaatatgcttctataagattcctttcacctgccaatgacagaattgtaaatttcttgaaagtagtgaccgtcattcatttttgcatttattcttttattcaacaaacttttgttaagtgctcactatttgccaggtgcagagtcgaggaggatgttcagggaactctagatagtttggtaaaactggcaggaggcaggcaggggccatagactgtaaagcactttgttccagtctggaagctttaatgatttcataaatgatctatacttcattttaaaatagtttatcc

SEQ ID NO: 58512 - DNA, 601 bp, Human
ctttttagtataaatattttgtactctccctgtgtcagtaaatgtcagtccacatcattctttttaacaactgaatctttgtatgctacagtgtttttataataatgtacctcacttctctattgatggatatttacattgtttcccttttttggtacaaaatagagatgtcatgaacatttttgaacatgtgcctttttgtactggtggctgggttggatttcagaagtagaactgcttggtatagagtatgtatgttatcaaattttccttcaaaaaaggacctttcccaccaacaaattgagattacttttatccttcagacaaccttttccattttatcaatatgttgaaagaatagaaatagtaaaatgtagtatttattatgtgacagatatatcctaggtactttatataaactaactcatttaatcattacaaccaccctaagagatagtcactgtcattactcctattttgaagatgagaaaactgagacgcagagaaattcgtaagttgcctgaggttatacagcttggaaaatgagagaactgaggttcaaacccaggaagattggctttagagtctgtatttgtaatct

SEQ ID NO: 58513 - DNA, 601 bp, Human
cattgtttcccttttttggtacaaaatagagatgtcatgaacatttttgaacatgtgcctttttgtactggtggctgggttggatttcagaagtagaactgcttggtatagagtatgtatgttatcaaattttccttcaaaaaaggacctttcccaccaacaaattgagattacttttatccttcagacaaccttttccattttatcaatatgttgaaagaatagaaatagtaaaatgtagtatttattatgtgacagatatatcctaggtactttatataaactaactcatttaatcatyacaaccaccctaagagatagtcactgtcattactcctattttgaagatgagaaaactgagacgcagagaaattcgtaagttgcctgaggttatacagcttggaaaatgagagaactgaggttcaaacccaggaagattggctttagagtctgtatttgtaatctttactgtgtattgcctctctaaaagatgggatggggggggatttctttgttttaatttgtattttgctaatgcttagtatactgaatatcctgtcgtatgttttcttcttctgtgacttacctatttcctttgccc

SEQ ID NO: 58514 - DNA, 601 bp, Human
aaatgcccatcagctgatcaatagatatacaaaaacatgatatacccgtacaatagaatattcatcagcaataaaaagagtactggtacatgttgcaatgtgtatgcatgttttcaaccttgaaaacactgaagtgggaggatcactttaggccaggacgtcaaggctgcagtcagccgtgatcgtgccactgcactccagcctgggaaacaggagagactctgtctcaataatagtaataataataagccagtcagtcacaaagtaccacatattggatgattccatgtataagaaatgraaatgccaagaataggtaaatcaatttatatcatcgtgacatatctgaatgctaaggtttaaaaaaaaattaaaattttctagaaagaaaaaataggttgcatacaaaggaatgttgggggtggggggatgacattggaattctcagtagaaacaatgaaaaccagacgttagtggagcaatgtcttgaaaattctgagcggaaattattttcaacccaatattccatacccagagcagatctcgaatgtcaaactgaggagtttggattttagcctataagaaacaaggagcctttaaa

SEQ ID NO: 58515 - DNA, 601 bp, Human
atagctcactgtaaccttgaactcctgggctcaagtaatcctcctgccttagcctcctaaagtgctgggattataggcatgagctgtggcaccaggcccagtttaagatattacaaaattctaatcaaaactacacacttgccccagccaaaccagttacaggcagtctgcctgcctttggagaagaaagtatgatagactacttacttctctcctcatctgctcttcccctgtagcctactcaccatgtttttaggcaccctccaggttttggggaaggtgaagcaacaaaaagatgagmaagaggataacaaagtctatcttagccttccataatgctcactgagcctaacagaaatttgaagctgacttttctctcatggggtgatttggggactttttcagagatttatcatccctgaggagctctcacctatggtttcattgactctgacagatgcatttctcttccaagtgctcacttgcgaatcctttctagaaaggagttcttgatgctttggtttcttcatcatgcagtcttatggtccgcaggaaacctccacaaatcttttgccctaacaacctctaggactacaggctt

SEQ ID NO: 58516 - DNA, 601 bp, Human
tcttactgtctcctctaacccaaatgccatttccttttcctataccctgtcttttgtcaagctcacttctagttcatcctcatgcaacagtacccaagtcaggagttacatgctccctcccttctttttggtattcttcccacatatcatcctagactaagtgcctaccccaccccccaactacctgagtccaactctgcatactttattctaggactaacttttttattgaatttatcttttcatatgtctgcttactgcagcagattgaaagctcctccaggatacaatctttgtatcytcattccctagcacaatgactgtcctattgaggaactcaatacacatttgttggcctgaaacagaagaggagagtcaaaactgacttccagataataaagaattacaatcttttaaaatatggtctatgtggatatgacaacttctcagaaattactggactccaagccattaattaatcaatacagtctagctatcgattagagtttcctattccagatttacagccatgggccaattaaggatcccttagttttatgaactaaaacccaattgaagtatctaattgcatcatgataac

SEQ ID NO: 58517 - DNA, 601 bp, Human
atttcacatctgagaatttgaagtatgaatgtatgcacatgtgcatgaagatatatgtagtaagatattctgaattttgttgctaatcacaaaaaaaggaaacttagatggtcatcaaggactgtaaattattacaggctcatgtaaaggaatactatgtggtcattacaaagagacaaagtatatctgtaggttccaatatggatagaagtccaaaatattctcttaaaaacagtattgtaccatcccatttatgtaaatgaatatgtatatatagacatatatgtttgtatttaaatawattatgtatattatgttaaatacatgcaaatatattgttatataaatatatgtaatatgctatatattacatactttatataattatatacatatatgggtaccttcgtataaaatatttctgggttcacaaaaactgttaatggcctcctttctataggaggttgtgggaggtaccctttttttattctttaccttctatccttctgaactcctggaattttttaccaagagtatttatcacttactgtttcaggagaaaaattaaaagatgattaatttttttaaaaaacctgtttca

SEQ ID NO: 58518 - DNA, 601 bp, Human
gttatttcaaggaattaaatgaagctacttatttaatgtgttttataaaaacaattgtctttacacaaggcatttctttttatccttattactaagtacttctgcttgaaatatatgtgtgtaactctgggtgtttacttcaatagatactataattattgagtcaaactgcatggccatccagtttgggattcaagaatattgtacttacgtttgactcctttaattctttcaagaggaaggcagtgaagtactggctcttgtagtgacaagtcatgattcctagcattcttcttataarcaactaggaaacaaaatcagccaggatgactgaacggtgttgacaaagatctctcttctagatgagagtttgggcttttttttccatgctgggaggtttcttcaaggcattttattctttattcatgcttatatagtaaagcatgtattgaaccaaaagcctgccagaaaagaattctatattgagatggaaatcaggacttttgaaagacaaggtcttgtgataaaaagttgagcttcgactctgtgtgtgtgtgtgtgtgtgtgtgtgtgtgtgtgtgtgtgtgtgtgtgtgtgtttt

SEQ ID NO: 58519 - DNA, 601 bp, Human; identical to SEQ ID NO: 31313

SEQ ID NO: 58520 - DNA, 601 bp, Human; identical to SEQ ID NO: 31314

SEQ ID NO: 58521 - DNA, 601 bp, Human; identical to SEQ ID NO: 31315

SEQ ID NO: 58522 - DNA, 601 bp, Human; identical to SEQ ID NO: 31316

SEQ ID NO: 58523 - DNA, 601 bp, Human; identical to SEQ ID NO: 31317

SEQ ID NO: 58524 - DNA, 601 bp, Human; identical to SEQ ID NO: 31318

SEQ ID NO: 58525 - DNA, 601 bp, Human; identical to SEQ ID NO: 31319

SEQ ID NO: 58526 - DNA, 601 bp, Human; identical to SEQ ID NO: 31320

SEQ ID NO: 58527 - DNA, 601 bp, Human; identical to SEQ ID NO: 31321

SEQ ID NO: 58528 - DNA, 601 bp, Human; identical to SEQ ID NO: 31322

SEQ ID NO: 58529 - DNA, 601 bp, Human; identical to SEQ ID NO: 31323

SEQ ID NO: 58530 - DNA, 601 bp, Human; identical to SEQ ID NO: 31324

SEQ ID NO: 58531 - DNA, 601 bp, Human; identical to SEQ ID NO: 31325

SEQ ID NO: 58532 - DNA, 601 bp, Human; identical to SEQ ID NO: 31326

SEQ ID NO: 58533 - DNA, 601 bp, Human; identical to SEQ ID NO: 31327

SEQ ID NO: 58534 - DNA, 601 bp, Human; identical to SEQ ID NO: 31328

SEQ ID NO: 58535 - DNA, 601 bp, Human; identical to SEQ ID NO: 34256

SEQ ID NO: 58536 - DNA, 601 bp, Human; identical to SEQ ID NO: 34257

SEQ ID NO: 58537 - DNA, 601 bp, Human; identical to SEQ ID NO: 34258

SEQ ID NO: 58538 - DNA, 601 bp, Human; identical to SEQ ID NO: 34259

SEQ ID NO: 58539 - DNA, 601 bp, Human; identical to SEQ ID NO: 34260

SEQ ID NO: 58540 - DNA, 601 bp, Human; identical to SEQ ID NO: 34261

SEQ ID NO: 58541 - DNA, 601 bp, Human; identical to SEQ ID NO: 34262

SEQ ID NO: 58542 - DNA, 601 bp, Human; identical to SEQ ID NO: 34263

SEQ ID NO: 58543 - DNA, 601 bp, Human; identical to SEQ ID NO: 34264

SEQ ID NO: 58544 - DNA, 601 bp, Human; identical to SEQ ID NO: 34265

SEQ ID NO: 58545 - DNA, 601 bp, Human; identical to SEQ ID NO: 34266

SEQ ID NO: 58546 - DNA, 601 bp, Human; identical to SEQ ID NO: 34267

SEQ ID NO: 58547 - DNA, 601 bp, Human; identical to SEQ ID NO: 34268

SEQ ID NO: 58548 - DNA, 601 bp, Human; identical to SEQ ID NO: 34269

SEQ ID NO: 58549 - DNA, 601 bp, Human; identical to SEQ ID NO: 34270

SEQ ID NO: 58550 - DNA, 601 bp, Human; identical to SEQ ID NO: 34271

SEQ ID NO: 58551 - DNA, 601 bp, Human; identical to SEQ ID NO: 34272

SEQ ID NO: 58552 - DNA, 601 bp, Human; identical to SEQ ID NO: 34273

SEQ ID NO: 58553 - DNA, 601 bp, Human; identical to SEQ ID NO: 34274

SEQ ID NO: 58554 - DNA, 601 bp, Human; identical to SEQ ID NO: 34275

SEQ ID NO: 58555 - DNA, 601 bp, Human; identical to SEQ ID NO: 34276

SEQ ID NO: 58556 - DNA, 601 bp, Human; identical to SEQ ID NO: 34277

SEQ ID NO: 58557 - DNA, 601 bp, Human; identical to SEQ ID NO: 34278

SEQ ID NO: 58558 - DNA, 601 bp, Human; identical to SEQ ID NO: 34279

SEQ ID NO: 58559 - DNA, 601 bp, Human
gtttgcatattttcagaaataaattgattgatctgtgaatcaggaatttgttcatgatgattcaaaaggtataaactggaattacctttcttttaaactaagcatagtatcaactattttttgcaagagtcttctcaaagcaggcaactggaattctgtacattgaatttgaagaaccagtctctctgttcctcaatttatgtgaggattaaagtttacatagggctaatgaaaccatattaatacctctgatttatagaaagaaaaatgttgaccagtcatgccacattatttcccaagrtgtatttattaagaacccatattttgaatagaacagtgagttaaaaaagaaaaaaggatttcacactttgaatagcagctttactgggagccatctgtaacatatgtgttctttttctgtaaaaagagcttttacaaagagaattacagattacaaagagaatcctttttatgacaggagaaacagtaaaccaattcagagctttcaaattattggttaccaagtaggatcttttgagaggtaaacttttcagttgggttgtgcattaactttcagttaaatatattcaacatttctgga

SEQ ID NO: 58560 - DNA, 601 bp, Human
aattatgcaaatttaagattatcttcagctttaattttcaacccatgttttgcagcgggctttgtgtttacagttggatatctgttagacttagggaaatgtagttgaagttcttttccagaacatatggataaaatttagcagtgcctaaagctatttttttctcctcagtaaagatattagatatcagaattcaatatttatttgtatttatttttataaacataccattaacctgtcttagtccagtgtatattgttgatcctagcagaaatattttctcattattacttgaaaatcktatttactttctgccctaaaattagattctctattgtccctatcttaaatgttttcactgctttttctgtaccataaagaacattgcttgaaagaaattaatgacaaatagaaaattttaagctttattcttgagaagccagatttaattcacaggtttgcatattttcagaaataaattgattgatctgtgaatcaggaatttgttcatgatgattcaaaaggtataaactggaattacctttcttttaaactaagcatagtatcaactattttttgcaagagtcttctcaaagcaggc

SEQ ID NO: 58561 - DNA, 601 bp, Human
tgcaaattcatgcgttaaaaatagtagccaattttagctcttaacataatttgtattcagctgcagttacctgtggcacaaaacattaatgtgcttggaaaaaatcccatgtaaaccagtataacctctctgttttgctaccactattctccttttcactagtcacatatgggctacttcacattatagaaacatgcattgtagtcaagtaggaaggaagggtaaagagcctatatttcagaaaagatgaaatttacagaattttaatttcttatgtgggagtgagatggaaggaaaagtraattatgactcccaggttcatacttagattattgcgtgtaatgcaggtagtatatttgtatacttacagtattcataggcaaggactttatctttcagtatgtatccacagtttgagcccacttaggaattcagatatgtagatatgaaactatgtgattcctagtaggcatggttcccagaattcccttagttctgcattattctttcaagaaatgtcttttctgcatctactacaggctaaggactgttttaggctcaagggataaagaaacaaccttagagtcaagtggggggtggg

SEQ ID NO: 58562 - DNA, 601 bp, Human
cttctgttttctttttttcattcttgtttattctgaaaactttcctttatgggccccgctttatcttcctggctgttaagtattgatgcagtcaagtacactgagctagtgtaattttcttagtgaaccctcttttgatgatttcatctactaccatggtgccatttgccatctctatgctgaagatttccaaatctttatgatttctggcccttttgtttctccagatttctgagcacatttatcaaattgtttatcggatgttcacattctaaagtcacagagtcacctgaagctaaamttttctctctcttccaaatttacttctctgtttttggagggtgtggtgggagagtggagggaggtaaatgaaaataccattcatgcagtttcccaagccccaaacttgggcaaaatctttaatttcttcttttccctcatttcttacatacaatcaatcattaaggtctgcacttctttttcctaagtgtcctctgaatttatccatttttctttgctctgtcaggttaccatcttgcttgttgtacttcagctgtttcctctgcttggaatactttatccacatctccctttccctagg

SEQ ID NO: 58563 - DNA, 601 bp, Human
ctttatgggccccgctttatcttcctggctgttaagtattgatgcagtcaagtacactgagctagtgtaattttcttagtgaaccctcttttgatgatttcatctactaccatggtgccatttgccatctctatgctgaagatttccaaatctttatgatttctggcccttttgtttctccagatttctgagcacatttatcaaattgtttatcggatgttcacattctaaagtcacagagtcacctgaagctaaacttttctctctcttccaaatttacttctctgtttttggagggtgyggtgggagagtggagggaggtaaatgaaaataccattcatgcagtttcccaagccccaaacttgggcaaaatctttaatttcttcttttccctcatttcttacatacaatcaatcattaaggtctgcacttctttttcctaagtgtcctctgaatttatccatttttctttgctctgtcaggttaccatcttgcttgttgtacttcagctgtttcctctgcttggaatactttatccacatctccctttccctaggctgccaattccaacttgtcttttaagtgcaattacatttgaccc

SEQ ID NO: 58564 - DNA, 601 bp, Human
ttgtagctccataatgacatttgaacaaggtcctgatggctctaggagtccaagcaagaacaaaagaatgaaagtgtaaggaatatggtgtattgggaacaaacagtctggtttgtttggtgcacagagtatgtatagggaagtggaaaaataaagccagaaaggcaggttgttggttgatccattcattcaacagatgacaccatttaggcactagggatacagcaacagacaaaaaggcaacaacaacaaaatccttgctattatagagattatattagtgtgtggtggaggggtggtrgggaaatagacaataaatcccttattatatgttatatgttagacagtgaagaggtgaggggatatgccatgtagatatctgaagggggtaaatgttacacatagagggaagagcaaatacaaaggaaagtagaaattcctgcaggtcagagatcaagggagcagaatgatctaggaagattagagtgagagatgaggtcagagacataaagggcattataggccattgtcagggctttggcttttactcttgtctaagatgggaagccattggaaggctttgattagtggtatgatgtga

SEQ ID NO: 58565 - DNA, 601 bp, Human
cataatgacatttgaacaaggtcctgatggctctaggagtccaagcaagaacaaaagaatgaaagtgtaaggaatatggtgtattgggaacaaacagtctggtttgtttggtgcacagagtatgtatagggaagtggaaaaataaagccagaaaggcaggttgttggttgatccattcattcaacagatgacaccatttaggcactagggatacagcaacagacaaaaaggcaacaacaacaaaatccttgctattatagagattatattagtgtgtggtggaggggtggtggggaaatakacaataaatcccttattatatgttatatgttagacagtgaagaggtgaggggatatgccatgtagatatctgaagggggtaaatgttacacatagagggaagagcaaatacaaaggaaagtagaaattcctgcaggtcagagatcaagggagcagaatgatctaggaagattagagtgagagatgaggtcagagacataaagggcattataggccattgtcagggctttggcttttactcttgtctaagatgggaagccattggaaggctttgattagtggtatgatgtgatctgactta

SEQ ID NO: 58566 - DNA, 601 bp, Human
tgatggctctaggagtccaagcaagaacaaaagaatgaaagtgtaaggaatatggtgtattgggaacaaacagtctggtttgtttggtgcacagagtatgtatagggaagtggaaaaataaagccagaaaggcaggttgttggttgatccattcattcaacagatgacaccatttaggcactagggatacagcaacagacaaaaaggcaacaacaacaaaatccttgctattatagagattatattagtgtgtggtggaggggtggtggggaaatagacaataaatcccttattatatgtyatatgttagacagtgaagaggtgaggggatatgccatgtagatatctgaagggggtaaatgttacacatagagggaagagcaaatacaaaggaaagtagaaattcctgcaggtcagagatcaagggagcagaatgatctaggaagattagagtgagagatgaggtcagagacataaagggcattataggccattgtcagggctttggcttttactcttgtctaagatgggaagccattggaaggctttgattagtggtatgatgtgatctgacttacatttagactgtaggtgagcaaga

SEQ ID NO: 58567 - DNA, 601 bp, Human
tattgggaacaaacagtctggtttgtttggtgcacagagtatgtatagggaagtggaaaaataaagccagaaaggcaggttgttggttgatccattcattcaacagatgacaccatttaggcactagggatacagcaacagacaaaaaggcaacaacaacaaaatccttgctattatagagattatattagtgtgtggtggaggggtggtggggaaatagacaataaatcccttattatatgttatatgttagacagtgaagaggtgaggggatatgccatgtagatatctgaagggggtraatgttacacatagagggaagagcaaatacaaaggaaagtagaaattcctgcaggtcagagatcaagggagcagaatgatctaggaagattagagtgagagatgaggtcagagacataaagggcattataggccattgtcagggctttggcttttactcttgtctaagatgggaagccattggaaggctttgattagtggtatgatgtgatctgacttacatttagactgtaggtgagcaagagttgaagcagggaaaccaattgggagtcaattgcagtgatctgtaaaagatgatgtt

SEQ ID NO: 58568 - DNA, 601 bp, Human
aggaaagaagttaaggatgacgccaaggcatctggcctcggcgaaaaaacaaggatggagttgccagtaactgaagtggagaagattgtaggaggaacaggtttgaggtgggatgttaggggggtggtttcaacaatttaattttggttttatgaagttgaaatgcttattagacatccaagtagagatgtaagtaggctgttgaataagtgaatctggagttcaggggagaggtgtaagctagagagataaatttggaagccatcagcagacagactgtatttaagatatttaaagcccyaagactggatgaaatcaccaagataaacaagaagtccaaggactgggctctagaacactatgatgctaacatgtctgaaaaatgaggaggaaccagtaaaagagaatgaaaatgatcagtgaggtgggaggaaaattaggggaatcgggtatcttgaagccaagagaagaaagtgttttaggaaagatcaccaactgtcccttttactggtgaatattgagtaagatgataacggagaattgactgttggatttggcaacgtggaggttgctgttgtctttgaaaagaaccaatttattg

SEQ ID NO: 58569 - DNA, 601 bp, Human
gttaaggatgacgccaaggcatctggcctcggcgaaaaaacaaggatggagttgccagtaactgaagtggagaagattgtaggaggaacaggtttgaggtgggatgttaggggggtggtttcaacaatttaattttggttttatgaagttgaaatgcttattagacatccaagtagagatgtaagtaggctgttgaataagtgaatctggagttcaggggagaggtgtaagctagagagataaatttggaagccatcagcagacagactgtatttaagatatttaaagccctaagactggrtgaaatcaccaagataaacaagaagtccaaggactgggctctagaacactatgatgctaacatgtctgaaaaatgaggaggaaccagtaaaagagaatgaaaatgatcagtgaggtgggaggaaaattaggggaatcgggtatcttgaagccaagagaagaaagtgttttaggaaagatcaccaactgtcccttttactggtgaatattgagtaagatgataacggagaattgactgttggatttggcaacgtggaggttgctgttgtctttgaaaagaaccaatttattggaatgatga

SEQ ID NO: 58570 - DNA, 601 bp, Human
aagttatcctttagagatatgtacagatttatttacaaaggaagtgaaatccaaattcaatgtgaaatgatgactgaaaacatatacttttacaaagttaataaccaagacattaattaccttagactctagaatgttatagaaagtttgacttattctatatgtccatacataaataagaaaagtactgtcaactcaataaacatgggcaaaagacacagcattttctacgaagaaatgtatatggtgttttgcaactgttggagaatatataaatccaccagttttctaaagattttakcattgccaaactttctttggaaaactgtctttggtattatcttttcaattggaacatacacaataactatgactcagcagttgcactcatcagtgtatatcaaggagaaaatcttgccatgtagaagaatgttcgtgttagtccatttttacattactataaaggaatactgaaggctgggtaatttataaagaaaagaggtttaattggcccacagttctgcaggctgtacaggaaacatggtgctggcttttacttctagtaagggtctcaggaagcttacaatcatgacagaaggca

SEQ ID NO: 58571 - DNA, 601 bp, Human
taatcaaattattgtaataataaaaacatataattacaaactgagatgcgtggtctgaagctcaggaaaacgcatctgtgagtgcaaaaaggcacctcacctggacttaggaagtgacttttaagctgagatctaaaggatgattagggctcactcaggtcatagtataggattcaggtcagtgaaaacagcttatacaaaggagctgtagcaggaggaggtacagcatgactaacactgaaaaatgtagtatgactcagtgttgtgactcaaaggtgagaccaaacaacagagatggcargggcctgatttattcaggacctaagagcaatgggaaacctttgaagattctaaattgagaggctactggagatcatatttgtgtttgaagagaatctttatttaatgtctgtctttctggctaaactgtaagctccacgagtagaggcaccaacttttgatctcaccgagtacaatacaagtaggtactcaataaatgttgtgtcaccatttaatagcttagtgcctggcagacagtaagtgcttagtaacgttatgattttcattgctctagactggcctttagtgtaagacagtggct

SEQ ID NO: 58572 - DNA, 601 bp, Human
tcgtttattttatataaattagaataccttgccatgtttcttcccaaagactaatgattgccattcaaaatatttcttctggccaggcttggtggctcatgcctgtaatcccagcattttgggaggccaaggcgggcagatcacttgaggtcaggagttcgagaccagcctggccaacatggtgaaacccccctctctactaaaaatacaaaaattagccgggcatggtggtgcatgcctgtagtcccagctactcgggaggttgaggcaggagaatttcttgaacccaggaggtggggtrcgcagtgagccgagagcatggccgctgcactccagcctgagtggcagagcaagactctgtctcaaacaaaagaaaaaaagtaactaattttaacgtctccaaaacttggtttggtaaaattgtgtataggggtgtaagttgtagtttttgggaaaaaaatttattttatcaaataaagctaattttttttcttagtttttaatgtgcccagctttggatgcctagaaacacagacacacagacacacacacacacacacacacacacacacacacactcttaatttttcatgatgggaat

SEQ ID NO: 58573 - DNA, 601 bp, Human
cctgtagtcccagctactcgggaggttgaggcaggagaatttcttgaacccaggaggtggggtgcgcagtgagccgagagcatggccgctgcactccagcctgagtggcagagcaagactctgtctcaaacaaaagaaaaaaagtaactaattttaacgtctccaaaacttggtttggtaaaattgtgtataggggtgtaagttgtagtttttgggaaaaaaatttattttatcaaataaagctaattttttttcttagtttttaatgtgcccagctttggatgcctagaaacacagacasacagacacacacacacacacacacacacacacacacacactcttaatttttcatgatgggaattgtttaacatttacaaaagtaacgcggtgaaaccccatgcatgtcttattcaccttcaacagtagtcaattcattgttttatctacgccagattattttgaagcaaatctcaacattatctttttaatctgtaaactcttcagtatctactctagaaaatacttttttaaactctaaataacataagcatagtatcatcacatcttttttttttttttttgaagcggagtctcgctc

SEQ ID NO: 58574 - DNA, 601 bp, Human
gctactcgggaggttgaggcaggagaatttcttgaacccaggaggtggggtgcgcagtgagccgagagcatggccgctgcactccagcctgagtggcagagcaagactctgtctcaaacaaaagaaaaaaagtaactaattttaacgtctccaaaacttggtttggtaaaattgtgtataggggtgtaagttgtagtttttgggaaaaaaatttattttatcaaataaagctaattttttttcttagtttttaatgtgcccagctttggatgcctagaaacacagacacacagacacacasacacacacacacacacacacacacacactcttaatttttcatgatgggaattgtttaacatttacaaaagtaacgcggtgaaaccccatgcatgtcttattcaccttcaacagtagtcaattcattgttttatctacgccagattattttgaagcaaatctcaacattatctttttaatctgtaaactcttcagtatctactctagaaaatacttttttaaactctaaataacataagcatagtatcatcacatcttttttttttttttttgaagcggagtctcgctctgttgcccatgc

SEQ ID NO: 58575 - DNA, 601 bp, Human
agttatttccttttcttagcactttcacatatgttctgttttagtttgttttactgtcaattccccaaaacattgtgcacatttaataatattaattgaaatttaaatatttctgcttagcgacaaagacaaacttgtcttttgacatgttgagctttgacaagcttttggttggtttattttgtctgatttgttgagaattccaacataattctagcttgcttaattatatttagcctaattatgaaattaaaactcttgtcaaatagatgtctcagattttttttttttttttttttttgagacagactcttgctctgttgcccaggctggagcgcagtggcatgatctcagctcactgcaacctctgcctcctggtacaagcaattctcgtgtcccactctcctgagtagctggaactacaggtgcatgtcaccatgcccggctaatttttgtatttttagtagagatggagtttcaccttattggtcaggctggtctcaaactcctgacctcaggtaatccacctgccttggctgggattacaggcatgagccactgtgcccagccccagatattcttaatgcagtttcttttgtgc

SEQ ID NO: 58576 - DNA, 601 bp, Human
ccagatattcttaatgcagtttcttttgtgcttgataggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggtatgtaactccagggttgttcagaaaggtactagctaccttttaaagcataacaactcattgaactaagaactttacttttcaaccttgtacgttctgtaccatgaaaaggaattarctgaaatctcctcagtagcttttttttttcatttaattaaattttcattaattttcattaaatacactttaaaaatgcagatacctctagagaagttagaaggttgtcatcaagataaatccattcaatctgcattttctcctaaggaaatgatgcataactgtttttttgttttttttttttttgaagagaggggaggagtcccagacttctttgaaaatctcatgaaagtatgggcactttccctgatgaatgcatataaaccaaggtacctgaaaatatgcatgcagttggaaaaaa

SEQ ID NO: 58577 - DNA, 601 bp, Human
taccttgtctttaatctaaaaacctagaaactactttctctatttctcttccttctctaaatcatgaaacttatttattactatagctcagctagatttttggttcaatagattattttttccatgttgaattaaatatttctaaattaaaaacttttggaacataatctctttatgaggtggggcccatctggtttctaattacagaatttaaagaggcttttgaaagcacagggcaaaaaagtagtagtctctattttattctttcaactatggaaataggtaaataatattttgatgytttcatgtttgggaaagttaatatgcttcagaataacctcatttgtgatgggaatcaacatttttatttagaaaggaaatttagtttcactcatatatgtgatgtgctttagctttttgttacagtgtaagcactctgagacggtctctttccagttaaatgctttccactgcttttttttaataacttaaaaaaaaatgatatatggaggatccaggacttgaaattttgctcatatttatatgactttatctacttttaaaaatatctagcaccaagtaaacattacttttattttta

SEQ ID NO: 58578 - DNA, 601 bp, Human
aatagtaaagatttactttgttacctcagacccaggtttgagtatggtaatatgctatcatgggaattgtaatgctgtagaaacgtaagagaaaaaaggaataatactataagcataggttatctggatcaaagatgattttagtcatatgagttaggaagtgatgagaatagaaatagtaagtactcaggataatgtgatacaggataaatactgtctacacagtactaattaagtactttaatgttttaaatatctctctctctatatatatgatatattatatatatatatgtatatwttttttgttttgagatagagtctcgctctgtcacctaggctagagtgcagtggcacaatctcagctcactgtaccacctcctgggctcagatgatcctcccacctcagccttctgagtagctgggactaagatgtgcaccaccatccctggctattttttgtatttttagtagaaacagcgtttcaccatgttgcccaggctggcctcaaactcgtagcctcaagcaatccgcccgcctcagcctcccaaagtactaggattacaggtgtgagctaccgtgaccagccttaatattcttt

SEQ ID NO: 58579 - DNA, 601 bp, Human
aggaataatactataagcataggttatctggatcaaagatgattttagtcatatgagttaggaagtgatgagaatagaaatagtaagtactcaggataatgtgatacaggataaatactgtctacacagtactaattaagtactttaatgttttaaatatctctctctctatatatatgatatattatatatatatatgtatatattttttgttttgagatagagtctcgctctgtcacctaggctagagtgcagtggcacaatctcagctcactgtaccacctcctgggctcagatgatyctcccacctcagccttctgagtagctgggactaagatgtgcaccaccatccctggctattttttgtatttttagtagaaacagcgtttcaccatgttgcccaggctggcctcaaactcgtagcctcaagcaatccgcccgcctcagcctcccaaagtactaggattacaggtgtgagctaccgtgaccagccttaatattctttaaaggtgtgccaggggtagaaattctattatatgtatacattatatatatgttttctttcttgtaatagttctttgggaaaaagatttaacctata

SEQ ID NO: 58580 - DNA, 601 bp, Human
ttgggaaaaagatttaacctatacaccatagtattttttcaagtttgtggtcatctactttgtttccctcaaaaatcaaccacagaaagtattatatgttttaattcgtatgtttcagttaaatgaatttgtgacaaataaaaataccctattcacttggcaggcttgaatagtagttggctagccccattactctctttggggaacaaacactgaatattggggagcagccatggacttcattaaagaccttggaaatgaatatgtactgaatgtagactacctatatatagaagtaggrtacatagagaaaaagtgattcttgcatttcaggtttgtgttgtcatcttttttcttagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataaggtgatttttctttttgt

SEQ ID NO: 58581 - DNA, 601 bp, Human
atttctgatgcctgtataatagcccatgtgaagtgaattgcttttgtctcagatgaaccttcataaacatcctagttactgctcactttggtagagttagttcagaaactgactcctgaaaatcaaaagctagaaagatggcttttaaaattgtcagttattacaaacaattatggccatttgactaaattaatgaattagaaatcaaatttagattgtttccttattgttttttaaaattaatttttaaaatataattcacatatcataaatttatccctttagattgtataattcactrgcttttagtgtattcacaaagttccataatcattacggccatctaattccagaactattttatcatccgtgaaagaaactatacacactaatagtcactccccatttccccttcctcctatcccctggcaaccactaatctactttctgtgtttgtgcctgttgtggacatttcatataaatggaatcatacagtatgtggtcttttgtatctggcatctatcatttagcataatgtttacaaagtactttcctactgtagcatgtattagtacttcattttttttgcttgaaaaatatt

SEQ ID NO: 58582 - DNA, 601 bp, Human
caccatcatcatttttatcttttcttttttttttttttgagatggagttacactcttgttgcccaggctggagtgcaatggcacgatctcggctcaccgcaacctccgcctcccaggttcaagtgattctcctgcctcagcctccctagtagctgggattataggcatgtgccaccacgcccggctaattttgtatttttagtagagacggtgtttctccatgttggtcaggccggtctcgaactcccgacctcaggtgatccgcccgcctcggcctcccaaagtgctgggattacaggcrtgagccacggcgcccagcatcatttttatcttttcaattcattttctataccacaaacaaaatgatctttacagaatgataactaggttatgctaccctgtctctttaaaatccttcaatgattttcatcaaccaccagttcaaatcatgagatttcctttttatggcctacaattcttagaaatatctgatttcatttggtactccatctcataactcattcttctttcatgatgttgagctcattccagttcctagagcacagcataactctttcttgtctcatggtctttgcacata

SEQ ID NO: 58583 - DNA, 601 bp, Human
tttttttttttttgagatggagttacactcttgttgcccaggctggagtgcaatggcacgatctcggctcaccgcaacctccgcctcccaggttcaagtgattctcctgcctcagcctccctagtagctgggattataggcatgtgccaccacgcccggctaattttgtatttttagtagagacggtgtttctccatgttggtcaggccggtctcgaactcccgacctcaggtgatccgcccgcctcggcctcccaaagtgctgggattacaggcatgagccacggcgcccagcatcattkttatcttttcaattcattttctataccacaaacaaaatgatctttacagaatgataactaggttatgctaccctgtctctttaaaatccttcaatgattttcatcaaccaccagttcaaatcatgagatttcctttttatggcctacaattcttagaaatatctgatttcatttggtactccatctcataactcattcttctttcatgatgttgagctcattccagttcctagagcacagcataactctttcttgtctcatggtctttgcacatattgtttcttttgctgggaatatctg

SEQ ID NO: 58584 - DNA, 601 bp, Human
ttgggatttgggttggatttaggtacccatggcaatcaaggagccaaaggcgtcagggaaaattgtcatgtccaagaacttagtgtgtgccaagaattaaacttgggtaaaccaaatctgattattcatttcagaggcccaagtgggataaaaccagaataaactaagggtcaggtgctggatggaacaagaatggaacggagtttagagttagggaagttgttttaaacgaagcatttaaattttactcttgaactaccatcaactatgtatggtagtgtttatatggatcccagacctrtttcatcgaaattacatgttgttgttattaaaacgcagatccctgggaaccactccagacctattaaatcagaatttctggagattggtcctgggaatcgtagaaaatgcagttttaacaagatttctctcactttgccctccacctccccaaggcaatatatgatggtgacttttgtttttaccttagtgattttttttgttgatatgctagaagaaaataagttgtcaaggatatgctttcttcacatgcagagatatcagtttgattccaatatcaatgccgattactccaatttga

SEQ ID NO: 58585 - DNA, 601 bp, Human; identical to SEQ ID NO: 20220

SEQ ID NO: 58586 - DNA, 601 bp, Human
aaagaagctgcatcaagaagggtcccaggtggttcagtcaggagtctgaacaccgtttggcaaaaatttaagcagaggaagaacattttaaaattattacttagtgagagtgcactgcaagggaaggaggttgaagctggagggctcagttagtgtagtgggaataactcagttgagaaatgatcaagattgaggtagtattatcaccattttatgtatgggaaatgaagtttctcagaaagaaagtatagcatttttaaggacaatcatataaaagagggcaaggtaatcacattacaartaaggtgttccagtaatgtttaacatgacaacatgcaaatagtaaacatttaataatattccatccctagaaagtgcaggtggaatcatgccagttaatgggttaggaaatgaaactcaaagtgggttttaccaggttaccagcgttagccacacctcttcctgcccttcatcccccaccccacccacgttgccggaacgtcccttgtgctgcagaacagagttagggtcaggacacgctaggcaccttctcccactcctaccagctgaacctccaggtgcgactgctcgaagtccacaa

SEQ ID NO: 58587 - DNA, 601 bp, Human
agaaaaagttcattacatatgggggataacaattcagatgacagtagatttcttaacagaaaccacagaggccaaaaagaagaagcataaacttttaaaatgttgaatgaaaggaattgtcaacctagaattctatgtccagtgtaaatatacttcagaaatgaaggtgaaataaatacattcttagatgaaggaaagctaagagaatttcttgccagtacacctgcactaaaagaatatctaaagatagttcttcagatctgaaaggatatgataagcttgtaacatcagaaatgaaaaragataaatgaaaagggtaaataaatgagtaaatacaatagactattattctcttgagttttcaaaattgcatttaacattcaaaagcaaaattataatattatctgatgtagttctcaatgtatatagagataacacttacaacaattatgaagtagagagggtaaaggaacctaaatggttgcaagatatctatatttcacttgaggtagtaaaatttttacactaatagactgcaatcagctacatctgcatatcgtaatccttagagcaatcacttgtaaaacataatacaaacaga

SEQ ID NO: 58588 - DNA, 601 bp, Human
agaactgaaaatacaatagaataaattttaaaattcagtaaaatagctcaatagcagaatggtaatgatagcagaatctgtgaatttgaagacagctcagaagaacatattcaaactaaacaacacagagaaactacattggaaacaacaaaaacagagtttcaagaactcgtggcacaacaagagacctaacatttgtgccatcagtatccaagagtccaagaaagagaggaaaaagaatgtgtagttgaaaaatatttgaagaaagagtggcagaagctccctcaaactggcaaaagasaaatctatattttcagaaacccaaacaggataaacccaaagaaagtagcaccaagatctatcataactaaacctctgaaaattaaacaaaaacaaaaacaaagaaaatttcttgaaggaaggcagtgagaaaaagttcattacatatgggggataacaattcagatgacagtagatttcttaacagaaaccacagaggccaaaaagaagaagcataaacttttaaaatgttgaatgaaaggaattgtcaacctagaattctatgtccagtgtaaatatacttcagaaatgaaggtgaaat

SEQ ID NO: 58589 - DNA, 601 bp, Human
caagagaacatcaattgagtgagttgacaccaacagtgagatgacacagatgttagaaatatagaataattaaatatttaaaagcagctgttataaagcttttccaataactatgaatagtctcaaaacaaacaaaaaattaggacattttaacaaagaaataaaagataaagaagaaccaagtgaaagttttagaactgaaaatacaatagaataaattttaaaattcagtaaaatagctcaatagcagaatggtaatgatagcagaatctgtgaatttgaagacagctcagaagaacayattcaaactaaacaacacagagaaactacattggaaacaacaaaaacagagtttcaagaactcgtggcacaacaagagacctaacatttgtgccatcagtatccaagagtccaagaaagagaggaaaaagaatgtgtagttgaaaaatatttgaagaaagagtggcagaagctccctcaaactggcaaaagagaaatctatattttcagaaacccaaacaggataaacccaaagaaagtagcaccaagatctatcataactaaacctctgaaaattaaacaaaaacaaaaacaaagaaaa

SEQ ID NO: 58590 - DNA, 601 bp, Human
atttgacccttcccaactctaaaaggtcctatagcactggagtacatggatagtaccttgtctttcagcctactttgcaataatgaggtagtacccttctctgctgagtctgtgagctgaattgcgacttctattcctaagctgaagtaaagaaactccctgcaggagtcagagggcaaattaggctttccagccttcttctacagtaataaggaggtgcacttccccttggaggagatataggcagatctctgactctcttccctccgtagtaaagcataagctactatgccagagggawccctgtcttctgttccatcttccttttccccagcttgcactgatgagaatgtgagatgggctcctgtgggagtgggtaataaaagtggagtagaccagaatagcactgcagaggctttataacctgcattgatatttgaactgccacccacaaaagtgagcattcagaatctaaataggctatatgctaaaataaaagatctgtatagtatccagggtaagtcttataacaaatatataaaatgtccaggatatagtccataattactcaccttaccaagaatcaagagaacatcaattg

SEQ ID NO: 58591 - DNA, 524 bp, Human
ctctgttagaaattgctgatgcacacactatattgtaaattcttatctctgtatactgtacttctgcatactgatgttaaagaattacttcatccccatgtgaccatctcacctcataatcaaacaaccctaaatccctcactaacctacccccatcctcactaaacttaataataaatgctggtatatccagcgcactggcggcatcgcaggtccagaaggtsgtgacccccctggacccagctttcactatcttgtgtgtatcttttatttctcgacctgccgatccacctgggaacaaagaaagagccctgttgcactgcaggctgctggccagatcccacaataggtatacaaatcaaatagtctcgggctcaaatccttatttgttattatttagctgaataacccgggcagttcactgttcgttctcagtcattttgctccatggtaaaatggaagcaccaccagatcatacctaacttgtgtgcccatcatgaagatgaaatgaaaactgacataaa

SEQ ID NO: 58592 - DNA, 601 bp, Human
aaaaaaaaaaaaccttaacagaataaaacaaaaggagataaaaataagatgccttttgaaaggcaaaaacagtcttaaaatcagaaatgaaaatagaaaaagaaaagaactgaaacagaatctataaaagtcaaacaaaagcaataggagacaggaaatgtaatgctaggaataaaaattccaaatgtagcataagcatttaaaaaagggtggaacaaaataaatgtttacagtaaagaggaagaagtaaaggattagtgggagaagagactgaactattgaaccatggctaccaagagayataaagtttacagagattccactgaatctaagttcttaaatttaataaccaacagaacaaagacatgaaaagaggaaaagaaaaacagaaaaagagtgtactaattcacactcctaccagcagtaggtcagagggtctgttcccctgagctgtgcctctgtgagtgtgtgtgacagcgagagagagagagagatcctaagaggcacaaaaatgcatgctgtttctatatttctctgaggtttaacatctgtccctcaatctggatgttgtatttttaaagtcgtatgtttatgtctttca

SEQ ID NO: 58593 - DNA, 601 bp, Human
cgagtctccgaggaatgaaagagctctgtgtgcagagggccgtggatgcattcttatggtggcaaaggggacaggaacccactggtgtgtgggaagaaggcactcatggtcataggcagccattgctaagcacctttcatattttatctcattaatctcacaaccaccttacagtagtaatagttcttatctttcaagacagaaaatgaattatagctgaaacaacacagcaaaggtgacaaagctattgagtggtgcagggaatttcccaggcattatgtaagatttgaggacaaagacrtgagcccaagatggctccagaacctgagtgacagagtttagtgggagtgacagagtgaaagtaagaatgagtgagagtgagagagttggggtgggagagagggagaatggggatgtgtatgttcatgaatgtgcacaagtgtgcaaatatctgcaaatgtaggttggaggacagtgtatggtcacgaatcaaaatccttcctaatgtatctgttcaacagagggtcccaggtagaccctgcccctgccttttttctgcctgggttgtgtctagctgcaggcagtggtaacaatccgaagg

SEQ ID NO: 58594 - DNA, 601 bp, Human; identical to SEQ ID NO: 20221

SEQ ID NO: 58595 - DNA, 601 bp, Human; identical to SEQ ID NO: 20222

SEQ ID NO: 58596 - DNA, 601 bp, Human; identical to SEQ ID NO: 20223

SEQ ID NO: 58597 - DNA, 601 bp, Human; identical to SEQ ID NO: 20224

SEQ ID NO: 58598 - DNA, 601 bp, Human; identical to SEQ ID NO: 20225

SEQ ID NO: 58599 - DNA, 601 bp, Human; identical to SEQ ID NO: 20226

SEQ ID NO: 58600 - DNA, 601 bp, Human; identical to SEQ ID NO: 20227

SEQ ID NO: 58601 - DNA, 601 bp, Human; identical to SEQ ID NO: 20228

SEQ ID NO: 58602 - DNA, 601 bp, Human; identical to SEQ ID NO: 20229

SEQ ID NO: 58603 - DNA, 601 bp, Human; identical to SEQ ID NO: 20230

SEQ ID NO: 58604 - DNA, 601 bp, Human
ccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagrcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccaggtaaggagggcctgggaggaggggccggctcccgggcgcgggggcaagttcggccggcgcgggagaggagctgccggggagaccccgggaccgtgttggcctc

SEQ ID NO: 58605 - DNA, 601 bp, Human
gggccatgaccaggtaaggagggcctgggaggaggggccggctcccgggcgcgggggcaagttcggccggcgcgggagaggagctgccggggagaccccgggaccgtgttggcctcgcaccctggtcgacctgccagggggagccgtgtgtgcctcgggcgtggcgcctgtcttgccgccgccgggacgcgagaaggcaggtgcgggctgggcgtaaataggccaactccgcggcgagggcgcccggcgcgggggtgtgggccgaggacgccgccgccagcctcccccgaccgggcagccyggtggctgctcgtccttccagctttctttccgttcccgagagcggtgaaggatggggagaaagaaacgtttccacgcaggttgccctgtgtcggtaattgcgaaattttaccgcgcattttctttcacttacactttttcaagaagtgtttagaacgccgcgtgtcttaaaccttggcgaagatgtctttgtagatttttgttgaaaaatcggaatcgagtcgtgtcatcttataaagaatttaaaactattgggactgagtgttcacgctgtcaacagataatggtcgattcgtcgtgc

SEQ ID NO: 58606 - DNA, 601 bp, Human
catgaccaggtaaggagggcctgggaggaggggccggctcccgggcgcgggggcaagttcggccggcgcgggagaggagctgccggggagaccccgggaccgtgttggcctcgcaccctggtcgacctgccagggggagccgtgtgtgcctcgggcgtggcgcctgtcttgccgccgccgggacgcgagaaggcaggtgcgggctgggcgtaaataggccaactccgcggcgagggcgcccggcgcgggggtgtgggccgaggacgccgccgccagcctcccccgaccgggcagcccggtsgctgctcgtccttccagctttctttccgttcccgagagcggtgaaggatggggagaaagaaacgtttccacgcaggttgccctgtgtcggtaattgcgaaattttaccgcgcattttctttcacttacactttttcaagaagtgtttagaacgccgcgtgtcttaaaccttggcgaagatgtctttgtagatttttgttgaaaaatcggaatcgagtcgtgtcatcttataaagaatttaaaactattgggactgagtgttcacgctgtcaacagataatggtcgattcgtcgtgctttc

SEQ ID NO: 58607 - DNA, 601 bp, Human
gctttccagtgcttcctgatttgggtctcagaaatggtttcagtgtgctgagttcagtatgaattcctagatcagtgtcagccatgtgaaatgcttattaaggatgaaatttgagtgagtcttgtgtagttcattttattactctgcattttaaatttgaaactcgttgctgaagttttgggctttaagtaattttatggtaatattctagtcagataatttttcctcccatgtcctgaaaaataggcctgatgtagaaaatattaactcctacactcctacaaatgttgccattttttttcacgtgcaagttttactttaaaacagggtgggaaagttgcaaatggcaaaccaaatcatctttttttcctactcaaagcactatttttaaaatccaaagttttttaaaaagtttggaaaacgagtattgtggtttctagtgcattaagaattggatttacacaaagtgcatcgaacagttttttgtatcacggtctcaactttgcttgtgttttatctttcacttacggttttaggtataacttaacaccatctctatgccttgaatgcaaattattctttaataagctttttaggtact

SEQ ID NO: 58608 - DNA, 601 bp, Human
tggtttctagtgcattaagaattggatttacacaaagtgcatcgaacagttttttgtatcacggtctcaactttgcttgtgttttatctttcacttacggttttaggtataacttaacaccatctctatgccttgaatgcaaattattctttaataagctttttaggtactttattttcatatatccatgttaataactagaaaaggcattggaagagaggactcatcgtccagcactactttgattttccattcatcctttcctaccttgtacttgagaattagaggtggtagtgctcaktcaatattttctgaatgaatcattataatgaaatattaagttgttttttttttgagactaagtcttgctctatggcccaggctggagtgcaatggcacgatctcggctcactgcaacctccgcctcccggattcaagggattctcctgtctcagcctcctgagtagctgggattacaggcgcccgccagcacgcccggctaatttttgtatttttagtagagatggggtttcaccatgttggtcaggctggtctcgaactcctgacctcgtgatccactcgcttcggcctcccaaagtgc

SEQ ID NO: 58609 - DNA, 601 bp, Human
acaccatctctatgccttgaatgcaaattattctttaataagctttttaggtactttattttcatatatccatgttaataactagaaaaggcattggaagagaggactcatcgtccagcactactttgattttccattcatcctttcctaccttgtacttgagaattagaggtggtagtgctcagtcaatattttctgaatgaatcattataatgaaatattaagttgttttttttttgagactaagtcttgctctatggcccaggctggagtgcaatggcacgatctcggctcactgcarcctccgcctcccggattcaagggattctcctgtctcagcctcctgagtagctgggattacaggcgcccgccagcacgcccggctaatttttgtatttttagtagagatggggtttcaccatgttggtcaggctggtctcgaactcctgacctcgtgatccactcgcttcggcctcccaaagtgctgggattacaggcgtgagctatcgcttccggcccttgaaataataagtttttactacttatactattttactgtaggtctactaaataggatattttgtaatgcgacccttaatcc

SEQ ID NO: 58610 - DNA, 601 bp, Human
gcccaggctggagtgcaatggcacgatctcggctcactgcaacctccgcctcccggattcaagggattctcctgtctcagcctcctgagtagctgggattacaggcgcccgccagcacgcccggctaatttttgtatttttagtagagatggggtttcaccatgttggtcaggctggtctcgaactcctgacctcgtgatccactcgcttcggcctcccaaagtgctgggattacaggcgtgagctatcgcttccggcccttgaaataataagtttttactacttatactattttactgtaggtctactaaataggatattttgtaatgcgacccttaatccatagcaggctgattttaaaaattcagtagcttctgttttttgttctttaagaacagtgtggtatgcttcttcatttaagcaataaatattgagtgcttattggcaggcattaggttttcaaatgttaatttctaatttgtaccattcccttggtaaatttgttttcaaaattgatgattttgttgccaaaactgataaccaaaaactaatgaaactttctctgtgattaacagatataattggtgattacaactttcct

SEQ ID NO: 58611 - DNA, 601 bp, Human
gtaataatagctagcaatcgtaaaataaatgaaaatattggaaggacctagtggtttttttgttgttgttgttaaagaagtaaaagaatagtaaacttaaagcatttgtgttttgagatggggtctccttgtgttgcccaggctggtcttgaattcctgggctcgagcagtcctcccaagtagctggaattacatgtcaatgcccccacacccacattctgaacattttatttttaagtgagggatagctacatattttttttttttttaccagcaggaagtcatatataattctcttcayagactttctttcctctgaattcttattaatagaatcttacttagtgcagcctctcccaaatattgtcatggttagtttattcccaggtttctgttcagttaaactatttgattaaaatgtcaaagtagatgaaacaaatcatagtctctcagttcctcaattttctactctgtaaaataggattaacatccttttaagggaattgttctgtggcttgttatgtgtaataatgtttttaaatgcttttaaaacttttattctgggcatatagcaatttttgagcctgtatttcttaaaatg

SEQ ID NO: 58612 - DNA, 601 bp, Human
atatgttctgagaaatgtgctgtttcattgtgtgaatttcacggtgtacttacacaactagatgctagagcgtactacacaactagcctatatggtatagaccagggtatctaatcttttggcttccttgggccacactggaagaagtgtcttgggccacaccacacagaatacactaatgatagctgatgagccaaaaaaaaaaaaatcaaaaaagtctcataatgttttaagaaagtttatgaatttgttacgggctacaggcaagctttgcatggcctattgctcctaggcaacaaasctgtatagcatataactactgaatactgtaggcaactgtagcacaatggtatttgtgtatctaagacgtatctaagcatagatatgtaaacataggtacagtaaaaataatcatagactactgtcatatgcggtccattgttaaataattgaaacgttggtaggtggtgcataactgtaagttacacgatacttgaactagatttttacctagttttgtccagatctacagatatcagggaaaatgtgtaatattgatatagtgaatagttttaccaaaaatgtcatccttattctgggt

SEQ ID NO: 58613 - DNA, 601 bp, Human
gtgattacaggcatgcaccaccacacccggctaattttgtatttttactggagacagggtttctccatgttggtcaggctggtcttgaactccgacctcaggtgatctgcccgcctcagcctcccaaagtcttgggattacaggcttaagccactgtgcccggcctacaactgacttcttttaaagacagtaatttcatagtcagttttatctttacagggaccttaaatttcattaatagggtacctctaataagctaataatgctaataagctgatctatgaaaatggaactgttattyatgatatactttatttaaatggaaaattggttatttggactataatgagaaactaatctgtatagacttacattttcctattttcattttaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaagtaagcaaaattggagtcttgtgtggaccatgatgga

SEQ ID NO: 58614 - DNA, 601 bp, Human
atggaaaactgaaatgctttaataagtgtacttttgggaacctgagtctttcagagctactgagggttttttttaatttttttgagatggagtcttgctcggttgcccaggctggagtgcagtggcgtgatctcggctcactgcaagctccgccttctgggttcatgccattctcctgcctcagcctcctgagtagctgggactgcaggtgcccaccaccacgcccggctaattttttgtatttttagtagagacggggtttcaccatgttagccaggatggtctcaatctcctgacctcrtgatccgcccgccttggcctcccaaagtgctgggattacaggcgtgagccaccgcgcctggcctactgaggttgtttttaacacaataattgagccactgttgtgtctagagcataccacaaaatatggaaataccataggaaataatcatgagacaggtttacctatcacatattgaaagttggcaattaaatgtaaacagactaggcttattttgtttttgctgtctatcatattttttggccgatcaaatatatttaaaaggtatgtatactgttgaggatgcacttatgaaagtag

SEQ ID NO: 58615 - DNA, 601 bp, Human
ggtggttttcctagccaactagcatgtctatgggattcatgcccatgttgtgataggatagctgcttgctcggtcacaacatacagatacatcttagactcagccccctggcctgcctcttccctcgaagcttcaccatcaaggcctatgaccaggttctctagctcaggagtggtttgctccctcttgtccccactctgttacttgatttgtccttggcacatggtctatttaaatggtattgactggcctatagcttagagcttgatgcttagctagtcagaatggggtgactgagtcrttttcttgtgctttaattgtatatatttggagctatgggttgaaggtggtattgtaaggatagactggatcttgccttggctcttggcacgtggcaagctgatgaacagtcttcctaggactggggtgtctgagagcttatccatccttgtgttccagcttcaaaactggtagctggttggggtcgtaagcaacatctttctaatattgatagcaccattttctttaaaggttgtcaccttgccattatcaactactaaaacacttagagcctctctaacctcatatggaaaatagagga

SEQ ID NO: 58616 - DNA, 601 bp, Human
tatcattactgattatagtctgatcattattataactagattacaaattgaccactaatatgattagagacaagcaatatctggagtaatttctcatctgtggagaaaaatattgtgggttaaaaggcgaaaaacacatagggattattattttttttttcttttgagacaagatcttattctgtcgcccaggctggagtccagtgatgtgatcatggctcgttgcagcctccatctctcagtctcaagcaatcctcccacttcagcctccaagtcgctgggaccacaggtgcaccatgtycagctaatttttgtatttagagacggggtctcaccatgtttcccaggcttgtcttgaacttttaggctcaagcaatctgccccctcggccccccaaagtgctgggattacaagcatgagccaccacactcagccaggaacaccttcctgataggagagcagggatttggatatatgcggggagcttcttgcctgctgtatatctcctgtatccctttgctggcaaccagctcttattccctttgcttacacccagtatagaagcatgcaacatgaaaatcagttccctttgaccaagcag

SEQ ID NO: 58617 - DNA, 601 bp, Human
agggccctcagaaactaagagacaaggaatgaattccactccagggccaccagaaagagtgtggctctgctggattttgtacttctagcctccagaaatgtgaaagaataaattgctgatgctttaagccactaagtttgtgataatttgttaaagtaacatcaggaaactaagagagatttaagcaacttgccctacgtcacaaagcagtgaacccagaattcaaacccatgttcttaatcaatatattatgttgcctttaagctgaattgaactttgtaataaaatgtcttaggttcakttattcaacaaatgtttattcagtgcctaccatggacgaggcctgtactggctgaagatacaaaaatgaaaaaggcagaaacattcttccctttggatactctacaatttagtggaagagaaaaactttagacaaggtttttcacatacacagaaatactgaaaatcatttaattccagcagtgataggtgctgcaaaggagatgaatgaaaaaataagacttatcctggaatataggatcagatccatcctaggtaggcccagctaatggctgaggtagaggtcagctcttcattccct

SEQ ID NO: 58618 - DNA, 601 bp, Human
tttcacatacacagaaatactgaaaatcatttaattccagcagtgataggtgctgcaaaggagatgaatgaaaaaataagacttatcctggaatataggatcagatccatcctaggtaggcccagctaatggctgaggtagaggtcagctcttcattccctctggcctgtttactgagggtttgagggcttacagctccactttagccctcctgagcttgcagaagttggtccacaaacagattatttggggataaagacccacaaaagaagaaaggcagtaaagaattcagcagacggcragctctgcaacccgttgcagacattattatgaggcagtggagtgtgtgaaaacttcttttagacaaacttcgaaaatgttgtgttcctgtaccaagcaagatttcctgtagggtcatgagaagctcactaatcatctctttagttccaagctatattacttcagggaagtttctgtcaaggcttcatgcttaagtatctctttgtctgggtttattctgtcaaatgcttatttgcttaaaaaaaaaaaatgccccaagccttagttgatctagcagcttaggaagttcaaatccccgcat

SEQ ID NO: 58619 - DNA, 601 bp, Human
acacaagggtaaaaatgtctacacgaagtcattcccagatcctaatatgataatgttgtgctttgtaaaatgtaaattgacttgaatatatgtctctttatttttacatcaagaaacagtaggtgatctgaaattatctctgcttaccaagcatctgtgttaaaagaactgtgagcataaggggtgaaatcttggtaaagtgtctatttagaggccatgctttctgttgatgttgacattgctgttttttgtttgtgggggttttgtttttgtttttactttataataacatttatttatrtaaaaaggaatgtttgggctggggctaggagaaatgttgaggtaatggaaaactctaataatgcgatcatctattgaagacacgagctcagggaaagcctttctactggtgacaggcatttttctgctaaggattcccaataggaatcaaatactgctgaagatagtagaatcagacttttgtgctggatcgcaggtaaaccctgggtagaccttgagatactgcccttgcaatggtgctgagtaacagaaggatgctagcatcctgcatcgagtcagaggagctcactgtagcccatcc

SEQ ID NO: 58620 - DNA, 601 bp, Human
tgacattgctgttttttgtttgtgggggttttgtttttgtttttactttataataacatttatttatataaaaaggaatgtttgggctggggctaggagaaatgttgaggtaatggaaaactctaataatgcgatcatctattgaagacacgagctcagggaaagcctttctactggtgacaggcatttttctgctaaggattcccaataggaatcaaatactgctgaagatagtagaatcagacttttgtgctggatcgcaggtaaaccctgggtagaccttgagatactgcccttgcartggtgctgagtaacagaaggatgctagcatcctgcatcgagtcagaggagctcactgtagcccatccctccagtccacccagactagctagacagtgccttcttagctctcagcagccctcatcctactgagagaggaatttggagaagacctggggaaaccttgaaagaccacctcagaatccagctaaacagcttgggtcctctttcccagggccagttgaggcaggagactaatagcaggaagagagatggctcccagctgttcagctcttttaaggtaaggtgggcctgatgtgtc

SEQ ID NO: 58621 - DNA, 601 bp, Human
cagtgagccgagattgcaccactgcactccagcctgggagacagagtgagactccatctcaaaaacaaaaaacaaaaaacaaaaaaaacaaaaacaaatgtgttccattgtagaggtattcagtaatttactgaacctattatcacctattgttgaaaagttagaattattctagctttgtgttataaatagtagggtgatgataaatgccttaaagggcccaggacagtacctggcctcatggaggtacctactacacagtgttctcttaaatctctctgcatatttacatccctagcawcagtgcaggagaatgtcctattctactactacttaccttcactcaaactaagtattgtcattttcttggttgttgtcaattttaaaagcaaaaaaatggtatgtcattgttattttaaattccatttctttgataactaaggttgaattttttatgtttagtagccagtttatctctaacatattaatttttctcattctactattaagatactgatcttttgtttgaaatctgcattttttctagtttaacttttaattttgtttgcatgtatattttaacatggaaaaattttatttt

SEQ ID NO: 58622 - DNA, 601 bp, Human
tactattaagatactgatcttttgtttgaaatctgcattttttctagtttaacttttaattttgtttgcatgtatattttaacatggaaaaattttatttttatgaaattgaatctatcaatctttggtgtcatgcttagaaaagccttccattctccaagatgatcaaaacagtcacttatattttctttaaggtgttataagtaatcacttccttttcagtctgaatcaaattgagcaatatttccacccctaggaagggcagcagattagtctggtgccagagacaacttttctccayaacctagactcagggaatctccaagttgaatgacctctagaagtcgtataatgtgagctcctggctgataacgtgattcccgtcttccagaagcctgataagtggtggttcctcgcttctgtactactggtgggagtataaactagtacaaccactatggaaaaaacagcatggagattccttaaaaaactaaaaatagaactaccatttgatccagcaatcccattacccagaggaaaagaagtcattatacaaaaaggatacttacacacacatatttatagcagcacaatttgctat

SEQ ID NO: 58623 - DNA, 601 bp, Human
tccagcccagttggcaaagtgagactccgtctcaaaaaaaaaaaaaaaaaaaaaatgcaaaaagcaaaatatgttgttcctgcatggagattgggggaggaagagaattatattttgcagtgtcttgcaaggaataaataccatcaaaacacttgaatatgaagttgacactactttggaataatgtagcccattgtgcctgaagcttaacagacatgacccaaagaaaagaatggttcacacaatatcaagagtactttgtggcagaggtgggaccagactccatcccctggtcctcactgcacagccttataacgtcatagcttctcaaaagtatcctaagattgcaatggagaccagaccaagcagtcagccccatcagagcttggaggatgctatcagggaagtgtatgtttgtttcttcttaatcacagtcctattgtaagcctcaaggatttaggacccacaaaaggaaattctcaatttccactgctttttgtactcaacttttaaagtcaaagatggaaaaggtaagaaaataaacaagagactttttttaaaaaacaatattctgtatgacaccacttatatgaggtaccta

SEQ ID NO: 58624 - DNA, 601 bp, Human
ttgtttcttgaatgtctcatttgtgaataatgtagcttccaaaatggaatgattggagaaaaaatatgaacgagggtgtcttgtttggcacctgtaagttttttaagcatttatagcaaaaatgaattattgagtcccccctctttctctctcatactctctctcactcactcatctgcattctctttccttcctattctctccattctactccatttcccaaaaaacaattgctagataatgaccattatggtggctaatatcaggtaactaccaagaagtgccttcttccaggcttctstaagtattcttgtttatttgaaagattgatagatcagagggtcaggggatgtgttttattgtaagtttctgttccaaatttcctgacattttccattaaaatatataaataaataagccttttaaaaggaagaaatggaactaataagaaccagaccctaaagtgatggtcaaaatgtcaaaaataactgcttttcctttattcagtatcattaatctcgaggtagatacctacctttccatagactctccctaatagcttgacctgattctcttgctgggctattcacaaatagagtga

SEQ ID NO: 58625 - DNA, 601 bp, Human
tgccttcttccaggcttctctaagtattcttgtttatttgaaagattgatagatcagagggtcaggggatgtgttttattgtaagtttctgttccaaatttcctgacattttccattaaaatatataaataaataagccttttaaaaggaagaaatggaactaataagaaccagaccctaaagtgatggtcaaaatgtcaaaaataactgcttttcctttattcagtatcattaatctcgaggtagatacctacctttccatagactctccctaatagcttgacctgattctcttgctggrctattcacaaatagagtgacttctaaagtgacaccaaaatcctcagtagctcttcaggaattggtgtgggagttcagtggcaatattttcatatgtttttcaaatcacatcttttggtaaagtgatgagaaaggaggctgtggcacacactagcagtccagagcacaaggccccctcatgagtctccatcatcataatgtttgtgagatcatcctaaaggtgctagaaaatagtgatgcttgtgtgcaacctagatgaatttgaaaattaactgattttcctcaagtttgtcagagtttc

SEQ ID NO: 58626 - DNA, 601 bp, Human
aagtgacaccaaaatcctcagtagctcttcaggaattggtgtgggagttcagtggcaatattttcatatgtttttcaaatcacatcttttggtaaagtgatgagaaaggaggctgtggcacacactagcagtccagagcacaaggccccctcatgagtctccatcatcataatgtttgtgagatcatcctaaaggtgctagaaaatagtgatgcttgtgtgcaacctagatgaatttgaaaattaactgattttcctcaagtttgtcagagtttctaaagtggctttggaaagggttccaktgcacacgaagaggaagcttaagttagacaatgtttgtccttatcaataatccatacaaaaattgtttatttcattttcttggactttatatgcgatacctttcagggaggctgcctacctcataatagccctctgttgtctgatagctgctttcacgacccatcatgaggggccttcagcagccatgtttgaatttataaccctgtccttctggtgagagttgattggaccagggagaggacacctggcccaggttacgccagatctctttcccaggaatttgcaattggaactcagag

SEQ ID NO: 58627 - DNA, 601 bp, Human
tgagaaaggaggctgtggcacacactagcagtccagagcacaaggccccctcatgagtctccatcatcataatgtttgtgagatcatcctaaaggtgctagaaaatagtgatgcttgtgtgcaacctagatgaatttgaaaattaactgattttcctcaagtttgtcagagtttctaaagtggctttggaaagggttccagtgcacacgaagaggaagcttaagttagacaatgtttgtccttatcaataatccatacaaaaattgtttatttcattttcttggactttatatgcgatacytttcagggaggctgcctacctcataatagccctctgttgtctgatagctgctttcacgacccatcatgaggggccttcagcagccatgtttgaatttataaccctgtccttctggtgagagttgattggaccagggagaggacacctggcccaggttacgccagatctctttcccaggaatttgcaattggaactcagaggtagcctgttagtgtttgtcagttgctgttagtgccaagagatcaatctgggggccgtagagtgttgatcttctactgtgtgcatagaaaagccaagaaa

SEQ ID NO: 58628 - DNA, 601 bp, Human
caaaaattgtttatttcattttcttggactttatatgcgatacctttcagggaggctgcctacctcataatagccctctgttgtctgatagctgctttcacgacccatcatgaggggccttcagcagccatgtttgaatttataaccctgtccttctggtgagagttgattggaccagggagaggacacctggcccaggttacgccagatctctttcccaggaatttgcaattggaactcagaggtagcctgttagtgtttgtcagttgctgttagtgccaagagatcaatctgggggccrtagagtgttgatcttctactgtgtgcatagaaaagccaagaaagctggttttcaaagagagatttaagcagattcataaagagaattagagtctgggggtggagggagattcctgatctggttcccggcagctttccagttcttggttctcgttcctcccgaaacctggccagacatcttgccagagtttcacaagaaacccttgcatcctgtgttaaattccccatccacctcgtctgcttttcctcaccctcttacactggcttgagttagttcctgttgcatgtaatcaaagagtct

SEQ ID NO: 58629 - DNA, 601 bp, Human
caaacctcagagatctcctagccttatcctcacattagacagatatggaaactgaagactatagacaggtaaaataagtgatttacccagggtcacacagctaggactcgatccctagccttctggtcctcaggccagccaatgttctttctaggctggctccctagtgccatccatccatccatccacccatccatccagtaaatataaactgagcaagattctgctacatgacaggtactggggtacatgttttttgtcctcaacaaactcacagtgtggaaggaccaaagttctttawgtttatttttacttcattccctggggtttcccatctggagggcactttgctaactttgctagcccacgatcacagcgagttcatccaggagtctcccagaatatactcccatcatgtattctctgtgcctcttgggtctattctttcctaatatttgtgataatccatgttcatattgaatctcccctgggagatccttgaaaccagggactgtgtgtaagtcattgcttttacttcctagcacggaatccatcacaaggtacttctccaataaatgtctgcttttctagagaatttact

SEQ ID NO: 58630 - DNA, 601 bp, Human
aactgaagactatagacaggtaaaataagtgatttacccagggtcacacagctaggactcgatccctagccttctggtcctcaggccagccaatgttctttctaggctggctccctagtgccatccatccatccatccacccatccatccagtaaatataaactgagcaagattctgctacatgacaggtactggggtacatgttttttgtcctcaacaaactcacagtgtggaaggaccaaagttctttaagtttatttttacttcattccctggggtttcccatctggagggcactttrctaactttgctagcccacgatcacagcgagttcatccaggagtctcccagaatatactcccatcatgtattctctgtgcctcttgggtctattctttcctaatatttgtgataatccatgttcatattgaatctcccctgggagatccttgaaaccagggactgtgtgtaagtcattgcttttacttcctagcacggaatccatcacaaggtacttctccaataaatgtctgcttttctagagaatttacttcactccttagaatctcaagtgagagctgtgtatcagttagctcctgct

SEQ ID NO: 58631 - DNA, 601 bp, Human
gttttttgtcctcaacaaactcacagtgtggaaggaccaaagttctttaagtttatttttacttcattccctggggtttcccatctggagggcactttgctaactttgctagcccacgatcacagcgagttcatccaggagtctcccagaatatactcccatcatgtattctctgtgcctcttgggtctattctttcctaatatttgtgataatccatgttcatattgaatctcccctgggagatccttgaaaccagggactgtgtgtaagtcattgcttttacttcctagcacggaatcyatcacaaggtacttctccaataaatgtctgcttttctagagaatttacttcactccttagaatctcaagtgagagctgtgtatcagttagctcctgctaggtaacaaaccacaacaaacatagtagcttccagcaacaatcatgtattattattctctctcctggttctgagagttgactgggatcagctagatgattcttgtgcagagtctctcatgtggttgcagtcagatggtggctgggtctagggtcatcttaaagactttgtcattcacatgtctggtgtctcgactgagagga

SEQ ID NO: 58632 - DNA, 601 bp, Human
ttttttgtcctcaacaaactcacagtgtggaaggaccaaagttctttaagtttatttttacttcattccctggggtttcccatctggagggcactttgctaactttgctagcccacgatcacagcgagttcatccaggagtctcccagaatatactcccatcatgtattctctgtgcctcttgggtctattctttcctaatatttgtgataatccatgttcatattgaatctcccctgggagatccttgaaaccagggactgtgtgtaagtcattgcttttacttcctagcacggaatccrtcacaaggtacttctccaataaatgtctgcttttctagagaatttacttcactccttagaatctcaagtgagagctgtgtatcagttagctcctgctaggtaacaaaccacaacaaacatagtagcttccagcaacaatcatgtattattattctctctcctggttctgagagttgactgggatcagctagatgattcttgtgcagagtctctcatgtggttgcagtcagatggtggctgggtctagggtcatcttaaagactttgtcattcacatgtctggtgtctcgactgagaggac

SEQ ID NO: 58633 - DNA, 601 bp, Human
cctcaacaaactcacagtgtggaaggaccaaagttctttaagtttatttttacttcattccctggggtttcccatctggagggcactttgctaactttgctagcccacgatcacagcgagttcatccaggagtctcccagaatatactcccatcatgtattctctgtgcctcttgggtctattctttcctaatatttgtgataatccatgttcatattgaatctcccctgggagatccttgaaaccagggactgtgtgtaagtcattgcttttacttcctagcacggaatccatcacaagrtacttctccaataaatgtctgcttttctagagaatttacttcactccttagaatctcaagtgagagctgtgtatcagttagctcctgctaggtaacaaaccacaacaaacatagtagcttccagcaacaatcatgtattattattctctctcctggttctgagagttgactgggatcagctagatgattcttgtgcagagtctctcatgtggttgcagtcagatggtggctgggtctagggtcatcttaaagactttgtcattcacatgtctggtgtctcgactgagaggacaaaaacag

SEQ ID NO: 58634 - DNA, 601 bp, Human
tccatcacaaggtacttctccaataaatgtctgcttttctagagaatttacttcactccttagaatctcaagtgagagctgtgtatcagttagctcctgctaggtaacaaaccacaacaaacatagtagcttccagcaacaatcatgtattattattctctctcctggttctgagagttgactgggatcagctagatgattcttgtgcagagtctctcatgtggttgcagtcagatggtggctgggtctagggtcatcttaaagactttgtcattcacatgtctggtgtctcgactgagargacaaaaacagctggagtctggaacagctggggctgtttcacacacaagtgttgtttgcacaagagatgtccaagagcttctctttattctctccaagcactctccatgtggtggcctcagggtaactggtgactgaaggctcccagagggattgcctcaagtttttttaaacctgactctgaagtctctcacacagtgtcacttctgcaacattctgttctcagaggtcctgccacatgcaagaaagacacgatcacagaggtcctgccaggtgcaaggaaagggcacacagactccac

SEQ ID NO: 58635 - DNA, 601 bp, Human
cttgtgtgctgggaactggctaggctctatggttaataagaccgtgatgaaaagatgccttggggttcctcaatgtagtcatatatgagtggttctgtttttagttgtcaccatgatgagggtgtgcagttgacatttattgaataggggtttaggatgttaaacacgctaccatgtgctagcaatcctgctggagaaggaactttcctaccaaaaatgctaataatttctgacctaatgtcagaaacacagtgaagtggggaagctgtgagaagtgcactgtggagtcctcagcagataygcatggtacatgtcaccaagggtggcatctggtttgagtgccacactctccccaaaacaactgcacagcttctgcccttcctctcccctctgcagccttgctctccatcaaggcccaatgcaagcaccccctactctctcacaccttccctgatttctagagctggacaggttcaccccctcctgagcataaaacagccctttccttacctctttccttgttctgattattttcatatgtttcttttgtatcactgttttgcgaggccagggagagatgggacaggtcccccctccatgt

SEQ ID NO: 58636 - DNA, 601 bp, Human
aagaccgtgatgaaaagatgccttggggttcctcaatgtagtcatatatgagtggttctgtttttagttgtcaccatgatgagggtgtgcagttgacatttattgaataggggtttaggatgttaaacacgctaccatgtgctagcaatcctgctggagaaggaactttcctaccaaaaatgctaataatttctgacctaatgtcagaaacacagtgaagtggggaagctgtgagaagtgcactgtggagtcctcagcagatacgcatggtacatgtcaccaagggtggcatctggtttgwgtgccacactctccccaaaacaactgcacagcttctgcccttcctctcccctctgcagccttgctctccatcaaggcccaatgcaagcaccccctactctctcacaccttccctgatttctagagctggacaggttcaccccctcctgagcataaaacagccctttccttacctctttccttgttctgattattttcatatgtttcttttgtatcactgttttgcgaggccagggagagatgggacaggtcccccctccatgtccgcacaagtgtttaataagtatttgcttatttatct

SEQ ID NO: 58637 - DNA, 601 bp, Human
ggtgttctcttattcactacacaggagaatcatttggagaagggcttttaaaaatgctcatgtctggattccatcctcgaacaattaaattagaatctctaagggtgggacccaggtatcagtatttttttctggaatacttttgatattccagagatggattaaatcctttaacccccacaacatccctaatgggtaggtatcattattagcccatttcacatttgaggaaactgaggcttagagaggttaaatcacagcaagtaaaaggtgatgctcagatatgaagccaagcagtctrgctccagagcccatgctcttggttggtgtgacgcagtctattattataagcagtgcctccagtgagatgtccggtgagaactaagatccagcaggtggggtcatccgatggtttcggtcccttcataccttcaggttacccacctcctgcttttaccttcagctctgtgtgttcaggacttcccagcagccctgtatcagataatgaactgtggttattcagaagtcccccgctattttcggctgattttattaaactcagcttgtggcttgaactcaagaatgtgcaagctgatttaga

SEQ ID NO: 58638 - DNA, 601 bp, Human
tgcattgagtttattaagataaaaaatatttcccgagatagtgagtcagaagtatttatggtgaagtgtgctgaaagtgaatgcaggttgatagcgtgaacagaatgttctctccaagtcaaatgcgatgacctaactgtgtttggcagccttcctttatgtttagctaagcatttcatttcatgttgggaacctcctccctcttctgaaaagcatcagtcatgtgggaggctaggattttggcatgtgcctcttttgataccaagacccaggccctaaacctaattgtgactggctcctyggctgactggctgggttgccatggcaatggactgctcaactctttatatctcagtttctctcacctgtcaaaatgggaatataacacttggccccaccttcctccctgaggagagatgggggcactttgaaaattaagtaataaatgttgggaaggatttgtggatttgtggatgtgacatcttgtcaagtgggtaaataataaatggggtgtctccaaagctaatttgcctaaaattcacttgagccttccatttacttcatcaaccagcgtttattaaatgcctatgaagttcacaat

SEQ ID NO: 58639 - DNA, 601 bp, Human
atataacacttggccccaccttcctccctgaggagagatgggggcactttgaaaattaagtaataaatgttgggaaggatttgtggatttgtggatgtgacatcttgtcaagtgggtaaataataaatggggtgtctccaaagctaatttgcctaaaattcacttgagccttccatttacttcatcaaccagcgtttattaaatgcctatgaagttcacaataacacatgaagtgctgaggggaatacaaaaaatgtaaaaaggaggaaatagagtctcaattcccagagaggtcataaamtaacttttttcttgcagtttgctttttctggttcattaagcctcagtacagaccatgcctgcactgtatttaaaaagctcattctcaatgatgacttccagttacgtcataagcaactagtggtgatttagttgttttcagtaccagtgggtattgtcacatgcttgatggactcataaaaaggcaagaatattttttagttcaggttatgagtggtgcaaaggacaatgaaagactacaggttggattgattgggaatctgattgcatcagaacataatatggtctctgctgttcaaag

SEQ ID NO: 58640 - DNA, 601 bp, Human
tccaagccactctgctctctgactcataccgttcagggcctgagctaacccattttgttctgaaagccttacaccagtctaggaccctgagggctgggaaagggcagctatggagtgtgatggaaacagcgctgggcttggtgtccaaatcctggctttgccttttattagctgtgaactctgggataggctgttaagtcctctgaactgcggtttacccatcctaattgtgcaaaagcaatggtgggtgaaactgctcaaacaaattcagacaatggcaccaacggtaccaaactagtgstcactgtacattccactgccatatacttgtagttgaaaagaaaaaaaaagccaattgcacttaagaatatcttccatggagcagtaaaaattattaattgtattaaatcttgacccttgaatacatagatttttaatatttcatatggcagatgggcagtatacgtaaagtactcctgccaagtactatgactgtctcaaagaaaagcatttgagttctgagctgaactagccacttttactttaaagaatgaccgacagaaaaattatggttagttattcttgaatattctttaaaatg

SEQ ID NO: 58641 - DNA, 601 bp, Human
cctacctcccacttaccatctgccatcttgacatttgcagtctagggaagaagggaaaaaaagatgagaaatcttccatagctcaagcacatatcatcagagctactgaatcaaaccattgaaaaaggtacaaacagccaggtttacacataaaagccagattgctttgtctggcattcaagctcactggacacctgctgcctgtcatccagttgttctgcagctgcccatatagaaacacaaactgtctcagaagaagcagacccaaccccaaaggcccagattatgaatccaaagcccrgggaggtgaagtgatggtctgacacacatcgctagagagtggcagaactgctacttgagtctagtgtgaattccctctggactggacacctttgctgggatgcccaggtgttctcgttctgcttactaagtaagcagctacagatggccaacaaatttgaaacttcttcttcgtcagtgaaaaggtaaaaccaaattccctgtttgtggcaaggctcctttgttcagtaaacacaaagatctatttacatttcttttgttctctctggaaacacactgcttgggtcatctactacactga

SEQ ID NO: 58642 - DNA, 601 bp, Human
actggacacctgctgcctgtcatccagttgttctgcagctgcccatatagaaacacaaactgtctcagaagaagcagacccaaccccaaaggcccagattatgaatccaaagcccggggaggtgaagtgatggtctgacacacatcgctagagagtggcagaactgctacttgagtctagtgtgaattccctctggactggacacctttgctgggatgcccaggtgttctcgttctgcttactaagtaagcagctacagatggccaacaaatttgaaacttcttcttcgtcagtgaaaagktaaaaccaaattccctgtttgtggcaaggctcctttgttcagtaaacacaaagatctatttacatttcttttgttctctctggaaacacactgcttgggtcatctactacactgatttcaaggtgccctgcaaccctcatgttgtttttagatagatattttatagagcagatcaggtgaggtgcctggcctctggagggaaaccagaaagaacatcagccagcacccatggctaaagcttaggcccattaaccagacagtcttggctgaagttaggggaagagcacaaccctgtgggta

SEQ ID NO: 58643 - DNA, 601 bp, Human
gcaaataatgaatcaattatttttagcatttatgaactcattttacagacatttgggcaattaaattacccggttaaatagctcagaaaaatgttacttttcaataaacttccattaaattcaacaaatttgtggcgttctacctgtgctgtccagtacagtagccactagccacatgtggctatttaaatttaaaaattcagttttcagttgctccagccatgtttcatgcattcagtaagccctgtgtgactagtggctatcaatcagacagtgcagattatagaacatttccatcatygcagaaagttctggtggataacactgctagacagtagtatacactgaggatgcagtgatgaccagaacattcccatccctgcccttatggggctgatagctctgctgaacaagttaccccagacttggacctacggaaggacataggacaatgagaaagtatggcaggggatctatccaagaaggggtgcttaggaaaaatgaaaccaaagaaagctccctacccatgaataacagagcacgtttttaaaagaaatcaaacttaattaaaaataaataaataattttatctgcaattgga

SEQ ID NO: 58644 - DNA, 601 bp, Human
aaaagcagaagttctggctgggcgcggtggctcatgcctgtaatcccagcactttgggaggccgaggtgggtggatcacgaggtcaggagattgagaccatcctggctaacatggtgaaacccgtctctactaaaaatacaaaaaattagccgtgcgtcgtggtgggcgcctgtagtcccagctactcgggaggctgaggcaggagaatggcgtgaacccgggaggcggagcttgcagtgagcccagatggcgccactgcactccagcctgggcagcagagtgagactccgtctcaaaaataaaaaaaaaaaataaaataaaataaaataaaataaaataaaaaagctgaagttctaacttacactgggaaagaaagtcccaagcttggactgagagttgcatggaagtttgattcattttgagtccctcgttaatggagtctaaaggtccaatttctttcactaatgctattgttgatgcgtttgtcatttgttctggctaaaggattctcatctttcactttaagagtatctacttggggcatttttctttatctatatttttattttgggggaaggacccacttattaaaactcttac

SEQ ID NO: 58645 - DNA, 601 bp, Human
aaagcagaagttctggctgggcgcggtggctcatgcctgtaatcccagcactttgggaggccgaggtgggtggatcacgaggtcaggagattgagaccatcctggctaacatggtgaaacccgtctctactaaaaatacaaaaaattagccgtgcgtcgtggtgggcgcctgtagtcccagctactcgggaggctgaggcaggagaatggcgtgaacccgggaggcggagcttgcagtgagcccagatggcgccactgcactccagcctgggcagcagagtgagactccgtctcaaaaataaaaaaaaaaaataaaataaaataaaataaaataaaataaaaaagctgaagttctaacttacactgggaaagaaagtcccaagcttggactgagagttgcatggaagtttgattcattttgagtccctcgttaatggagtctaaaggtccaatttctttcactaatgctattgttgatgcgtttgtcatttgttctggctaaaggattctcatctttcactttaagagtatctacttggggcatttttctttatctatatttttattttgggggaaggacccacttattaaaactcttact

SEQ ID NO: 58646 - DNA, 601 bp, Human
ctggctgggcgcggtggctcatgcctgtaatcccagcactttgggaggccgaggtgggtggatcacgaggtcaggagattgagaccatcctggctaacatggtgaaacccgtctctactaaaaatacaaaaaattagccgtgcgtcgtggtgggcgcctgtagtcccagctactcgggaggctgaggcaggagaatggcgtgaacccgggaggcggagcttgcagtgagcccagatggcgccactgcactccagcctgggcagcagagtgagactccgtctcaaaaataaaaaaaaaaaawaaaataaaataaaataaaataaaataaaaaagctgaagttctaacttacactgggaaagaaagtcccaagcttggactgagagttgcatggaagtttgattcattttgagtccctcgttaatggagtctaaaggtccaatttctttcactaatgctattgttgatgcgtttgtcatttgttctggctaaaggattctcatctttcactttaagagtatctacttggggcatttttctttatctatatttttattttgggggaaggacccacttattaaaactcttactctacaaaaaaaa

SEQ ID NO: 58647 - DNA, 601 bp, Human
ggctgggcgcggtggctcatgcctgtaatcccagcactttgggaggccgaggtgggtggatcacgaggtcaggagattgagaccatcctggctaacatggtgaaacccgtctctactaaaaatacaaaaaattagccgtgcgtcgtggtgggcgcctgtagtcccagctactcgggaggctgaggcaggagaatggcgtgaacccgggaggcggagcttgcagtgagcccagatggcgccactgcactccagcctgggcagcagagtgagactccgtctcaaaaataaaaaaaaaaaatataataaaataaaataaaataaaataaaaaagctgaagttctaacttacactgggaaagaaagtcccaagcttggactgagagttgcatggaagtttgattcattttgagtccctcgttaatggagtctaaaggtccaatttctttcactaatgctattgttgatgcgtttgtcatttgttctggctaaaggattctcatctttcactttaagagtatctacttggggcatttttctttatctatatttttattttgggggaaggacccacttattaaaactcttactctacaaaaaaaaat

SEQ ID NO: 58648 - DNA, 601 bp, Human
ttaacttgattacctctgtaaagacctatttccaaataagatcacattccaaggtacctggaaattaggacttcaagatacatatttgggaggacatggttcaacccataacacttgatattgcaaagtttttctcagccatgcaaaactcttgcaaatgttattctaatgtgtgagagctttcagaagcgctggttggaatataatgaaaatagatgtttggtaatattgggaatgatagtttgttgtgcaagaatattttgcattcaaactgagagaagaatttgacacattggttaatttatcttttctcctgctgaagtggctctgccactgtagtttctcctaggctctaagaagagtccatctcctccactggcagtgtcacaatacacaaaactttgacagtatgcagttgtggtcaccttctattccaaggacagagggcaagacatgtagagaaatgttccctgggccagaacagtgctggtcacaaaaatagatgtctaaggttttgattacattgtgcgagcactcattgccagatcccaagaggcaaagggttccatgcgtactctttactctcattacatatattccc

SEQ ID NO: 58649 - DNA, 601 bp, Human
gggcgcagtggttcatgcctgtaattgcagcactttgggaggccaaggcgggtggatcacctgagatctggagtttgagaccagcctggccaacatggtgaaaccccgtatctactaaaaatacaaaaaattagccaggtgtggtggcgagcatctgtaatcccagctactcgagaggctgaggcaggagaatcacttgaacccaggaggcagaggttgcaatgagctgagatcatgccattgcagtccagcctggccaacagagcaagactctatctccaaaaaaaaaaaaaacaaacaytattatagccatcctcgtgagtgtgaaatggtatctcattgtggttttgatttgcattttcctaatgactcatgatgttgagcatcttttcatgtgcatattggccatttatgttttctttggggaaatgtttgttcaaactttttacccattttttaaattgaattaattgtctttttattcttgaggtgtaagagttacttattttgggtatatacccttattagatatatgatttgcaaatattttcattctatggattgtcttttcattttcttgatagtgttctttgaaacacaa

SEQ ID NO: 58650 - DNA, 601 bp, Human
ttaggggaatgctgcaagaaactatatgacacagggagcctgagaatcacagcctgcagaggtcatctgccttgcagatgctgacccaagcaggaaacgggcaaggaacggatctgaagacaaataggtgcagcaacagcactcataccccagattgatttccatgccactagaaagccgagcctgcagacagccttgaagaaacaggctggggagaagacaaagcattcaaagctgcaattcctgcccaaccttcaggtagaacattcagtggacagtttggattgtggaactgaggccyggagcaaaggtcaaggctgagggggcagacatggtggtacatttggctaagttggtggacaaactttgaagggagtaaaactccccaagagaaactaaaaaggaacaagaataagcagacctcttttatttatagtactgtctgtaattttcagaatattttttcttttctcctttgatcttagagccatctaatagctttgactagataccctggtatttttgttttctatctagaaaaataaaaaattgataaatcatcatacccttgccctttatcataacaagcactttttaattg

SEQ ID NO: 58651 - DNA, 601 bp, Human
tgacatttctttgtgaatttggaagtcctttaaagtaaacatacccaaaatatatcttttcaagtttctcttgtatgtcatgcctcatcaaaaactgaagaaaagtttctgcaatttttcaaaattttaatcaattgattttatttttatattctataagctaaataatagctaaaataattatttcttttaccatctctgtatctgaaagtggttttatagctgtacaaagttgcaagcacagattctgttaaaattgtgtagacttttttttgtaggacatttatttaattctaatttyaggtgaccaatttcatcaattttttttaactggtggcggggggaactttaaaaaaaaaatcaaaatcactgtgtatttgctgaaaagggtctctttattattgtccactttattatctttaaagttctttttgcacaacaaacttttttgtgatgatccattatgaaatttgtggcatatcttcttcccgtctcttttttccattacttttttgtttcggagagactttccttgcctcaaacactacagaactcgtaacttctccacaatagtacatgtttgaatcaattttctgtttag

SEQ ID NO: 58652 - DNA, 601 bp, Human
ttttaatcaattgattttatttttatattctataagctaaataatagctaaaataattatttcttttaccatctctgtatctgaaagtggttttatagctgtacaaagttgcaagcacagattctgttaaaattgtgtagacttttttttgtaggacatttatttaattctaatttcaggtgaccaatttcatcaattttttttaactggtggcggggggaactttaaaaaaaaaatcaaaatcactgtgtatttgctgaaaagggtctctttattattgtccactttattatctttaaarttctttttgcacaacaaacttttttgtgatgatccattatgaaatttgtggcatatcttcttcccgtctcttttttccattacttttttgtttcggagagactttccttgcctcaaacactacagaactcgtaacttctccacaatagtacatgtttgaatcaattttctgtttagggctaaaaatagaaattcagaaaacaggagcagcagtctgataggatttcaaagcagcattcagcagactacatttcctcttgggttaaatgtgtgtgtgtgtgtgtgtgtgtacacgtgttca

SEQ ID NO: 58653 - DNA, 601 bp, Human
taaacaagatttaaaggaaatgctaactgcaagagagcctttggtattcatggtagcctcacccacttctgtgtgctcctctctcacctatgcagaagcattgaaattccaggcttcatctccagtctcaccaccctgaacccctactttgcttagcttccctcctctatgtaaatttgttttatttatttaggccttttgtaaggtgtgtgaaggtatctgggctaagagagtggaaggtcagtgaacccctgagaaaatactagccacttgggggtcctcattcttgcccaatcagtcmgaagatccaactactcctctgtgtgccccttcctgctccatgtgctcctttattttacccatttttctccatggtaaatgcaagtgtaaggctttgaaggcacaggggagcctctacaagccctgagtggaaattcgcagccagtatgtgaaagcatgacttcaattttttgaagactgggccctaagaactggacatgatgaagcttaccagtttgccaatcttcaccttctgttttcttcccctgagagtttccactagaaattccccagctttggtttgagtgcttggctctgtaat

SEQ ID NO: 58654 - DNA, 601 bp, Human
gtaaatttgttttatttatttaggccttttgtaaggtgtgtgaaggtatctgggctaagagagtggaaggtcagtgaacccctgagaaaatactagccacttgggggtcctcattcttgcccaatcagtccgaagatccaactactcctctgtgtgccccttcctgctccatgtgctcctttattttacccatttttctccatggtaaatgcaagtgtaaggctttgaaggcacaggggagcctctacaagccctgagtggaaattcgcagccagtatgtgaaagcatgacttcaattttwtgaagactgggccctaagaactggacatgatgaagcttaccagtttgccaatcttcaccttctgttttcttcccctgagagtttccactagaaattccccagctttggtttgagtgcttggctctgtaatcttggagacactctgcatacaccccacaattaagacatcgcaactccatgcaatgtttcttcagagaaagttagatgcaattagatcatttgaagatggattagcctgccatctgcacaatattaagaaaaatcatgttggcaaatgatggggcctctttgaagagctct

SEQ ID NO: 58655 - DNA, 601 bp, Human
ctgggtttcccccctgttcccgaagggttaacacaatgtgtgggaaaggaaaaaaaaatcccctgtggcattaaaatgctgtgtcagagatttgtaagctcccctttgtagctctgccctggggcctggctcacttcagtggagatgaggttaataagacctctgttgctgcttggcagttcttaacggggttacagtctggtgcctgaccagtgaaggacagttattattaaagtgctgaggaatttaattcaataaggtcagggacatctgctgtgcttgcttgcccaatgtccatttmttcttctttttacaagaactgcttgcttttcctttgcggaaaaccacctcatgcccattctgtctaggtggagctgacccttacctaaatcagggtggccacatgaccaagccagcccagttagtgtatttgggtatccaaccgtgccccaaagtcactggacttgtcagttacataagcctataaacacctttacccctcaaccctcatttttctttttcagcttctgcaaggtggagtagctacattaactatttaagggattaaatggcatgaagtataattagatagaaactaaac

SEQ ID NO: 58656 - DNA, 601 bp, Human
ccgaagggttaacacaatgtgtgggaaaggaaaaaaaaatcccctgtggcattaaaatgctgtgtcagagatttgtaagctcccctttgtagctctgccctggggcctggctcacttcagtggagatgaggttaataagacctctgttgctgcttggcagttcttaacggggttacagtctggtgcctgaccagtgaaggacagttattattaaagtgctgaggaatttaattcaataaggtcagggacatctgctgtgcttgcttgcccaatgtccatttattcttctttttacaagaastgcttgcttttcctttgcggaaaaccacctcatgcccattctgtctaggtggagctgacccttacctaaatcagggtggccacatgaccaagccagcccagttagtgtatttgggtatccaaccgtgccccaaagtcactggacttgtcagttacataagcctataaacacctttacccctcaaccctcatttttctttttcagcttctgcaaggtggagtagctacattaactatttaagggattaaatggcatgaagtataattagatagaaactaaactctgtgggaagtcaagaga

SEQ ID NO: 58657 - DNA, 601 bp, Human
ctgacccttacctaaatcagggtggccacatgaccaagccagcccagttagtgtatttgggtatccaaccgtgccccaaagtcactggacttgtcagttacataagcctataaacacctttacccctcaaccctcatttttctttttcagcttctgcaaggtggagtagctacattaactatttaagggattaaatggcatgaagtataattagatagaaactaaactctgtgggaagtcaagagagggagaggttgatgtgggtgggtgggcttcctggcagaggctgaacttgaactgrtcttaaaggatggagaggattaggtgagaccaagagaatgcagaactctgtgcaaggcacagagggagggagaactcagttaaaatgaagatctgtggacaagaaatgaaaagtgggttttgacaaatagaggcagggaaaatgccagaggacttggaatcccaggatgagaagtttgaacttacctggatagttccccagtgtggacttatgtatgggtggggaaaatccacaccagattgtgctaccagtttgggcaagtatatgactctatgccttacctgtgttagagactggcac

SEQ ID NO: 58658 - DNA, 601 bp, Human
ttcctcatctgtccttatacgatgtttctagaagcttcttcataggggttttttgttttgtttttggcaaggtttaagagtgataattcatgctgtatggagcatctgacacataatacaccatcaatgttagctcctatgaatgcctccagtcactgtcctatacattttccctgtgattgcaataaccgtgtatatgcagttgcatccttattttttcacttaacactgtatctcaggcatctttataagtaacaagatctccctgtccctcattcctaatgtatatgttctcctaaartcactttaagtgtatcaacttgctcttgcttcatcttttaaaaacatgtataagtaatgctacactccacacctttacgcttaatggctctaagagttcacgtttcagtgcaccatctctttgagttcaaattatggttctgcccacaccttttcagaatgtggtgagaatgaatgacacccaagtcaggaaaggcctttgacaaattgcagattatgctggcttgataagtgaccacaggaaagtatgattgtcacttttccagcagtgggtttcctccagtgtgatattctgtgcctc

SEQ ID NO: 58659 - DNA, 601 bp, Human
tttggcaaggtttaagagtgataattcatgctgtatggagcatctgacacataatacaccatcaatgttagctcctatgaatgcctccagtcactgtcctatacattttccctgtgattgcaataaccgtgtatatgcagttgcatccttattttttcacttaacactgtatctcaggcatctttataagtaacaagatctccctgtccctcattcctaatgtatatgttctcctaaaatcactttaagtgtatcaacttgctcttgcttcatcttttaaaaacatgtataagtaatgctrcactccacacctttacgcttaatggctctaagagttcacgtttcagtgcaccatctctttgagttcaaattatggttctgcccacaccttttcagaatgtggtgagaatgaatgacacccaagtcaggaaaggcctttgacaaattgcagattatgctggcttgataagtgaccacaggaaagtatgattgtcacttttccagcagtgggtttcctccagtgtgatattctgtgcctcacctatcaagaggtgttactgtgggtcttcctgtcagctcagttctcctacccttcttgctg

SEQ ID NO: 58660 - DNA, 601 bp, Human
actacctgagcctcagtttcctcatatagaaaaaatataccctcctcatatggctgttataggggaaaaagacacaatatgcaaagcacatagtacggaggcaaagtatctggcacatagtatggttcaatagataaataattttcccatagaaactgcaaatttatatatgagacaaaaaacatttcaagtatatgttcttgagggcagggagatgtaaggtttttaaaggttctttgataaaaaggttggagcatggctctttggctctgatcactccattggatacttaaaacaatgwtcaactctgtcatcagaatgaaatgtccactgattcatctccatttcttaactaccaagcaacgttcttttgagggctttcacaccctcacgtatcctttccacctgaacctcagtggctgactttaccccaggccctgaaggcagaggtggagctgagctctgtgtctgggaagagagaagcaggcacgtcctctgatccttgcccaagggcctgctttgtgagtggggcatcaatgccgcttttgttccacctttagcgtctggcccacagctgaactcaaagaggctggctgctcgg

SEQ ID NO: 58661 - DNA, 601 bp, Human
taaaaaggttggagcatggctctttggctctgatcactccattggatacttaaaacaatgttcaactctgtcatcagaatgaaatgtccactgattcatctccatttcttaactaccaagcaacgttcttttgagggctttcacaccctcacgtatcctttccacctgaacctcagtggctgactttaccccaggccctgaaggcagaggtggagctgagctctgtgtctgggaagagagaagcaggcacgtcctctgatccttgcccaagggcctgctttgtgagtggggcatcaatgcygcttttgttccacctttagcgtctggcccacagctgaactcaaagaggctggctgctcggggcaaccctggcccacaaaggacagacagcaccaagcccagccaagggttcactcaagaccccaagatccagcacggtggttctccccactggggaggcagcctcagggaacattctgtctgcctttggcattctaaaccatttctaatttcatgaagataagtcagaggttttaaatgtgatatcactgctgaaaaggccagagccatcagcgtagaaccagcatgtccttgctaatta

SEQ ID NO: 58662 - DNA, 601 bp, Human
gaggtggagctgagctctgtgtctgggaagagagaagcaggcacgtcctctgatccttgcccaagggcctgctttgtgagtggggcatcaatgccgcttttgttccacctttagcgtctggcccacagctgaactcaaagaggctggctgctcggggcaaccctggcccacaaaggacagacagcaccaagcccagccaagggttcactcaagaccccaagatccagcacggtggttctccccactggggaggcagcctcagggaacattctgtctgcctttggcattctaaaccatttckaatttcatgaagataagtcagaggttttaaatgtgatatcactgctgaaaaggccagagccatcagcgtagaaccagcatgtccttgctaattacaatacacaatcattgccttatgttgatgcagtcatttgctcattcatcagctattaattgagttcctactatgtgctcaatgtgatgctcaatgtgagggacatggaggtgaaaagatgatgtccctgcccttaactctctggtgtactggcaaataaactgtcacctgctaagacaaatagaacataatatctggacactataa

SEQ ID NO: 58663 - DNA, 601 bp, Human
attcttaaaacacagctataatagtagtttgattctcttcctatctctctgggaaaggccatgcaaagaaaatggcatgtgagggtcttggaaaaagaataggagtttgccaactagacaagcaggggagatcattgcgggcacaggaaacaaaaatgatctgtttggagaactgcagatctttggtatgtgtggagcaaagggaatatgcagggcctcgtgtgagaatagtgattgcagtgaagtgagaactaagtgggatgaagcttcaaatgtggaagactgtaagcagagctaagaygtcgaggaaggagactcggtaggatagtgcttcagttagaaggagggatggccacgtttgttggttcacttttgagatgcagagcctattcctagggtaggctatgagaagggaacaatgagagggagaaactaaaaatgccggacagagagtgactagtggagacaggacctcaccctcctctgattggaagaaagataagaagagaaccaaagacatagacacattctaagaataggtgttgggaggcagaacacaggtaagagggggcagaaggaaaagatacgatcttaagagttg

SEQ ID NO: 58664 - DNA, 601 bp, Human
agacacattctaagaataggtgttgggaggcagaacacaggtaagagggggcagaaggaaaagatacgatcttaagagttgtacctgcatgacgcctgatgtctctgaggttaaaggcaagtccaacaaggagagtgagaggtgacagagtattatagaggccttggtgaaaggagtaaaagtttggagtcattgttgagtacgatgatgaggtgctgataacacaaactcttgatttcgaggaaggagtgttcaaaggaggaggaggaaaatgactgctagagagaaaggtgatggatgkcatgtgaaaatagttgagtgtgctgagaatcgttgattagagtggcgaaaggtaatgaagggaagacttaataggtgatttcaggttcagacatctgaatgagggcatggacctattccatgcagcttcaggagacagaacgaggtccaacaagtggtcattcctaggagacagattctctacccccaaacattaaacattaaaacatgtaagtaagtgtacattaaaaacattaaaatgtgtaagtaagtagcactatccagcaatggaataatctgcctcttgaaggatttcaatcat

SEQ ID NO: 58665 - DNA, 601 bp, Human
gagaggtgacagagtattatagaggccttggtgaaaggagtaaaagtttggagtcattgttgagtacgatgatgaggtgctgataacacaaactcttgatttcgaggaaggagtgttcaaaggaggaggaggaaaatgactgctagagagaaaggtgatggatggcatgtgaaaatagttgagtgtgctgagaatcgttgattagagtggcgaaaggtaatgaagggaagacttaataggtgatttcaggttcagacatctgaatgagggcatggacctattccatgcagcttcaggagayagaacgaggtccaacaagtggtcattcctaggagacagattctctacccccaaacattaaacattaaaacatgtaagtaagtgtacattaaaaacattaaaatgtgtaagtaagtagcactatccagcaatggaataatctgcctcttgaaggatttcaatcatctgccaaggatgttgtgctggaaatttggtatgcttaattagatggcttcttctatcttttttaatactaacatatcatagatacttaatatatggagcattgaaatagatagcagccaattttggcattcttgca

SEQ ID NO: 58666 - DNA, 601 bp, Human
ttctctacccccaaacattaaacattaaaacatgtaagtaagtgtacattaaaaacattaaaatgtgtaagtaagtagcactatccagcaatggaataatctgcctcttgaaggatttcaatcatctgccaaggatgttgtgctggaaatttggtatgcttaattagatggcttcttctatcttttttaatactaacatatcatagatacttaatatatggagcattgaaatagatagcagccaattttggcattcttgcaggttgtcccactgtctgagcaagagaatcttgattgggattttttttttttcttttttggagacagagtctcgctctgttgccaggctggagtacagtggcgcagtctcggctcactgcaacctccacctcccaggttcaagcaattctcccacctcagccttccaagtagctgggattagctgggattacaggcacctgcaaccacgcccagctagtttttatatttttagtagaaacggggtttcaccatgttggccaggctggtcttgaactcctgacctcaagtgatctgccctcctcggcctcccaaagtgctgggattataagcatgagccacc

SEQ ID NO: 58667 - DNA, 601 bp, Human
agtaagtgtacattaaaaacattaaaatgtgtaagtaagtagcactatccagcaatggaataatctgcctcttgaaggatttcaatcatctgccaaggatgttgtgctggaaatttggtatgcttaattagatggcttcttctatcttttttaatactaacatatcatagatacttaatatatggagcattgaaatagatagcagccaattttggcattcttgcaggttgtcccactgtctgagcaagagaatcttgattgggattttttttttttcttttttggagacagagtctcgctytgttgccaggctggagtacagtggcgcagtctcggctcactgcaacctccacctcccaggttcaagcaattctcccacctcagccttccaagtagctgggattagctgggattacaggcacctgcaaccacgcccagctagtttttatatttttagtagaaacggggtttcaccatgttggccaggctggtcttgaactcctgacctcaagtgatctgccctcctcggcctcccaaagtgctgggattataagcatgagccaccgtatctggccttgattggaattttcagtaagattta

SEQ ID NO: 58668 - DNA, 601 bp, Human
ccactcttctttctcagatatcaagtctgtatcatggtctgaatgctctccctgcctgctcttctctctctccctctttctcttccacaaacactgcccccagtaaatctcttgcactttgaattccatcttggtatctgctttccagaggaccagaaccaacacaagtgatggttacatatccaaaagaaattattgtggaaggaaaatagtacagttcttgaaagcaatcaggattgagggataactgaatctcaagagtctccctaatagcataattagagggaggagtggaggacarggtttgaatcttatgttacagtcataattgggaaagagtacagttagtcttgtaattgggaagagaattcaggatggtggggggaagttattgaaaaagtagaaggaaactctgggaagtgtaggatcatagaacatgaaatagagagagagctttttaggaacaggtgataatcagcgcagatgtcatcaaagaaaatctgagtagggactgaggtcttgtatttagagactgacagtgtggctggctggccatcaagtgattatttcagggaaagaatgagaataggtgccaagttta

SEQ ID NO: 58669 - DNA, 601 bp, Human
tgttcagagaaacaaactggctttacgcagtccacttttgtaattatcaacaatcatagaaaaggaactagtatatagctacttatttgctttgtttgaatggcactgtactttatcataacaatgggtgataaagatgataaaaatatccaagaaccacaatgctctatgtcagaactaggttgactggagaagaaatgctctctgaagcaaacgttctggatactcaaagactggatttgtacagtggtctttaggcgttataactctgtccaggtctctcaacacttacagctatcarggaaactttattattgatattctacagaaaaaatcacgattactgcaagtctgtaagctcttaagtatttttcccattgaaattattgtttcattaatataatatattcaaccttgtgctatcttgggtatgcaactctacagttagagcagatcaaagggcagtagcctgaaaggagctgaatgacaaaatccatggcatttctcattagtcttagccagaagtggctctttatggagaggactcatcctggtcttgtgaagagaaatgcactgaaactggaaaggaatgagctggcca

SEQ ID NO: 58670 - DNA, 601 bp, Human
atggaacccactgaggggcttctgaccacagtcccatgcagagccaacaatggcattcgttgttataagcaagtgtcagtcacaagagagctgccattacagagtgttgcccagctttccatattcccaacatggccagaggtttcattctttgagaatgtgtttattcagcctagtaaaaacattaaaaaggggaataaatctctgccgaccccaaaatgcttttcaccacagctgtaaaccataaaacatttagaaaggtaagcaggactaaagataatatagtttccccaagcagcawggagggcagacctggaggtggcccttgcaaagacagctgcagtgcacagagcttccctgcaaaatcattaagaaagggacaggttctataaggtgctaaattattattagtttttttttaagttgggggagggcaataataaaaaccatgtgctcagcagcctgcttggccatataaaacagaaaggcctgtgactttaagtgttgtaaaaggggttaattgtcgatttctgaatgtggcaagtttactgatcttgttaacagcaacggggcatgtgccgttggttatcatggcgggaaa

SEQ ID NO: 58671 - DNA, 601 bp, Human
attctttgagaatgtgtttattcagcctagtaaaaacattaaaaaggggaataaatctctgccgaccccaaaatgcttttcaccacagctgtaaaccataaaacatttagaaaggtaagcaggactaaagataatatagtttccccaagcagcaaggagggcagacctggaggtggcccttgcaaagacagctgcagtgcacagagcttccctgcaaaatcattaagaaagggacaggttctataaggtgctaaattattattagtttttttttaagttgggggagggcaataataaaaamcatgtgctcagcagcctgcttggccatataaaacagaaaggcctgtgactttaagtgttgtaaaaggggttaattgtcgatttctgaatgtggcaagtttactgatcttgttaacagcaacggggcatgtgccgttggttatcatggcgggaaagaaaaacagccatccatcccttattccctggatgccgttattagtcttggaacccaagttaagggacatatgggtgaatgcagtcttaaaattgctcctttccacctgtccaaatttctacccattctaaagcttccagttccacc

SEQ ID NO: 58672 - DNA, 601 bp, Human
aatcattaagaaagggacaggttctataaggtgctaaattattattagtttttttttaagttgggggagggcaataataaaaaccatgtgctcagcagcctgcttggccatataaaacagaaaggcctgtgactttaagtgttgtaaaaggggttaattgtcgatttctgaatgtggcaagtttactgatcttgttaacagcaacggggcatgtgccgttggttatcatggcgggaaagaaaaacagccatccatcccttattccctggatgccgttattagtcttggaacccaagttaasggacatatgggtgaatgcagtcttaaaattgctcctttccacctgtccaaatttctacccattctaaagcttccagttccacctaacaactgcatttttactgccatttttcaaatgcctgctgtggatcagttcctttcacacaaaatgtgttgtctatttgtatgacaacctaatggagtgggcaaggatgatacaaccattttacagacaaagcaactgaggttcagagaagttaagaaagttatctatggcgacagagctatgaagcagaggttcaaacccgtctttatattccaa

SEQ ID NO: 58673 - DNA, 601 bp, Human
aactgcatttttactgccatttttcaaatgcctgctgtggatcagttcctttcacacaaaatgtgttgtctatttgtatgacaacctaatggagtgggcaaggatgatacaaccattttacagacaaagcaactgaggttcagagaagttaagaaagttatctatggcgacagagctatgaagcagaggttcaaacccgtctttatattccaagtccaggtcttttcaactagttattcaaataattcatttgttcatccatttactcaatagatagttattggccatgcactaagagccrggtgctggtctagttgttgaggatagagccctggacacaactgacaatgttcctgccatcacaaggcctatagtttaggaagcactagtctaacttccaataaccatcctctcttctaacctactttcacatgcacagtcagcatctgtaatttgatattttattttgctgttgagtattgcacattacctttgagtatggtgtgttacctttggctcccccagctagatgatgagcctggtgaaggcagggctgttgtctaatatttctctttttcacagtctacccagcacaacccat

SEQ ID NO: 58674 - DNA, 601 bp, Human
tggtctagttgttgaggatagagccctggacacaactgacaatgttcctgccatcacaaggcctatagtttaggaagcactagtctaacttccaataaccatcctctcttctaacctactttcacatgcacagtcagcatctgtaatttgatattttattttgctgttgagtattgcacattacctttgagtatggtgtgttacctttggctcccccagctagatgatgagcctggtgaaggcagggctgttgtctaatatttctctttttcacagtctacccagcacaacccattaaatragtgctttttttctcctgtagaacatctttattactgtgatcttaagatcatttggggttttatttagagcttagctattgcagcttctgttattgagctttgtcaaatgttatgtttatattgtctcattagtgctgacaccacccaactataagacccattttacagttgaggaaattgtggcttatgagggctgagaaacttgcccgagttcttagagtcagtaagaagaaaagctaggattctgccagtggctgaattcaaaagcccaatttctgtataccatgtacttgagcctg

SEQ ID NO: 58675 - DNA, 601 bp, Human
attgcacattacctttgagtatggtgtgttacctttggctcccccagctagatgatgagcctggtgaaggcagggctgttgtctaatatttctctttttcacagtctacccagcacaacccattaaataagtgctttttttctcctgtagaacatctttattactgtgatcttaagatcatttggggttttatttagagcttagctattgcagcttctgttattgagctttgtcaaatgttatgtttatattgtctcattagtgctgacaccacccaactataagacccattttacagttkaggaaattgtggcttatgagggctgagaaacttgcccgagttcttagagtcagtaagaagaaaagctaggattctgccagtggctgaattcaaaagcccaatttctgtataccatgtacttgagcctgagcagtgagggaatctttgcccacctgaaacatatagagaatatcaaaagaccctatgatatgatatacatgatacataaggtgaatttaataccagccattgattcatccagtcactccaatcactcagaccttcatagtaaaattcatgtggcatcttggctcctgcccc

SEQ ID NO: 58676 - DNA, 601 bp, Human
tagagaatatcaaaagaccctatgatatgatatacatgatacataaggtgaatttaataccagccattgattcatccagtcactccaatcactcagaccttcatagtaaaattcatgtggcatcttggctcctgccccaccctctattttgtggtcttcttaaaatgctatcttttttcaatagaataattttcaaaggaatccctgtgttcctagaaaggtgacaaatcagagattgactagcatgaggagggtagtggaaggttcacacctgtttgtaataactggcttatacaaaacrtaagtacgaacacaatggatggcgattgtgttctgccaatgcggttggcattcattctgagaaaagatggcagaccaaggccagagcatggcccagttgctgaaaatcagaaccacactggagccaccagggaccctggtaactaggtggagctgaaccatttatttctgttttgatggcatagtttccactttaagtaatgtgggcttaatcttcatttacattcttcaatctacacagaagtgtatttattattgtcttgtgataagcagtagtgttaatataaagcagtgctccctg

SEQ ID NO: 58677 - DNA, 601 bp, Human
aagctacatttctgccagttgtggttttgagataacaaggcttaaaatttgtatgccaaagttaaaattcatgatctttttcctgtgggcacattttagttcagtctctttgctcaaaagaatttgacaccaattattgcttttcagtactattgagcatgagacaatctatagaataatccaaaaaggaagatctataattatacaccttctcataaagggatcatggatattattgctatgtatgtccagaatagctcttcttacttttgaggagtaactattagagtcttaccaggtrccaaccacagtgcttcacattcttgccacagagactggtccaaggataggcagatgacaaaaccaggcaaattctaattcttccacaaatgttttctaatatagagctgccaaaattgctctcctgcattttttaggtgtgcaattgcaatataaatctgaaaatgcccatggccatgaaagatctggaaatgaaaaatagcattatctgattctttggatctagtcttccctgagccagctccacttttcccatgcatggggcgggggggtcggggctagcgagctaataaatatcctt

SEQ ID NO: 58678 - DNA, 601 bp, Human
agctacatttctgccagttgtggttttgagataacaaggcttaaaatttgtatgccaaagttaaaattcatgatctttttcctgtgggcacattttagttcagtctctttgctcaaaagaatttgacaccaattattgcttttcagtactattgagcatgagacaatctatagaataatccaaaaaggaagatctataattatacaccttctcataaagggatcatggatattattgctatgtatgtccagaatagctcttcttacttttgaggagtaactattagagtcttaccaggtgycaaccacagtgcttcacattcttgccacagagactggtccaaggataggcagatgacaaaaccaggcaaattctaattcttccacaaatgttttctaatatagagctgccaaaattgctctcctgcattttttaggtgtgcaattgcaatataaatctgaaaatgcccatggccatgaaagatctggaaatgaaaaatagcattatctgattctttggatctagtcttccctgagccagctccacttttcccatgcatggggcgggggggtcggggctagcgagctaataaatatccttt

SEQ ID NO: 58679 - DNA, 601 bp, Human
ctgcagactcaacttcccaggctcagatgatcctcccacctcagcctccccagtagctgggactacaggcacatgccacaatgcccagctaatttttcgtatttttggtagagtcagggatttgccatgttgcccaagctggccttgaactcctgggctcaagtgatacacccacctcagcctcccaaattgctggctttataagggtgagccaccgcgccaggcctcaaagcagtacattaagaactgttcgtgtaaataagctctgttgagggacattaactggggaataaagtggctggaaaggacacattgaactcctttttcatcttctctgaaaatgttaataataactgagacacatctctgtgtctatatctatacttttcataagtgaggaaagaatatgtgaaaatttggccaaaacttaaagtttttgaatgcaggaaaaggtttgttattcacagtggaacaggggaaatgtaagaagatgatacggtttggttgtttccctacccaaatctcatcctgaattgtagctcccgtaattctcacgtgttgtggcagagacctggtgggagataattgaatcgtcggggca

SEQ ID NO: 58680 - DNA, 601 bp, Human
gtggccattgttacagactagaatctggattttgtttgctcttgattacacagaggaagaaacaaaaaataagttgtcctggtgataagcaaatggctgggatggttttcctcagtgaaaatcaatgtgatgtcttattcccaggcctagagataggtgggagatggggagggaagctatttagtttaccagcattactaaagttgcccttttttccctggtggatttccttttcctgatttcagagcttagagaactcagttctgtctagaggccctaacattccacttcccacactcarcatgggcctattgtcatcatggacattttttaatgtataattcaagtaatcctcaaagcagccctaatagtttggtatctttattgttatcagcctctcttgagaatcagaaaagttaaatacttttttaaagatcctgtagatggttagaggcagctaggattcaaatacccatctgtctggatctgaagcctatctcttaatccccaaacccactgcaacatgcagtccattctcacatgtgcaagtgcatctaacccacaaatgctttttttaaaaaaaatattaaggatgagctgg

SEQ ID NO: 58681 - DNA, 601 bp, Human
aagcaaatggctgggatggttttcctcagtgaaaatcaatgtgatgtcttattcccaggcctagagataggtgggagatggggagggaagctatttagtttaccagcattactaaagttgcccttttttccctggtggatttccttttcctgatttcagagcttagagaactcagttctgtctagaggccctaacattccacttcccacactcagcatgggcctattgtcatcatggacattttttaatgtataattcaagtaatcctcaaagcagccctaatagtttggtatctttattgttatcagcctctcttgagaatcagaaaagttaaatacttttttaaagatcctgtagatggttagaggcagctaggattcaaatacccatctgtctggatctgaagcctatctcttaatccccaaacccactgcaacatgcagtccattctcacatgtgcaagtgcatctaacccacaaatgctttttttaaaaaaaatattaaggatgagctggtggtgtttcctccataccccggccagtcacagtttagcatcatgggataagtgtgggaaaggtctgactagagtagaaatacagat

SEQ ID NO: 58682 - DNA, 601 bp, Human
gcaaatggctgggatggttttcctcagtgaaaatcaatgtgatgtcttattcccaggcctagagataggtgggagatggggagggaagctatttagtttaccagcattactaaagttgcccttttttccctggtggatttccttttcctgatttcagagcttagagaactcagttctgtctagaggccctaacattccacttcccacactcagcatgggcctattgtcatcatggacattttttaatgtataattcaagtaatcctcaaagcagccctaatagtttggtatctttattgtwatcagcctctcttgagaatcagaaaagttaaatacttttttaaagatcctgtagatggttagaggcagctaggattcaaatacccatctgtctggatctgaagcctatctcttaatccccaaacccactgcaacatgcagtccattctcacatgtgcaagtgcatctaacccacaaatgctttttttaaaaaaaatattaaggatgagctggtggtgtttcctccataccccggccagtcacagtttagcatcatgggataagtgtgggaaaggtctgactagagtagaaatacagattg

SEQ ID NO: 58683 - DNA, 601 bp, Human
catggacattttttaatgtataattcaagtaatcctcaaagcagccctaatagtttggtatctttattgttatcagcctctcttgagaatcagaaaagttaaatacttttttaaagatcctgtagatggttagaggcagctaggattcaaatacccatctgtctggatctgaagcctatctcttaatccccaaacccactgcaacatgcagtccattctcacatgtgcaagtgcatctaacccacaaatgctttttttaaaaaaaatattaaggatgagctggtggtgtttcctccatacsccggccagtcacagtttagcatcatgggataagtgtgggaaaggtctgactagagtagaaatacagattgtgcccagccttaaaacaataacatgtttctttcacatttcacattaacaaatctaaacagctgatgaaatactgtaatcctaggattatataccatgaggagcctaagaacccctttttaatttatcaaagattcagtatatttgtaatcacatgtaataagtgaggttgctgatgtagaggaaaaagaaatgacaatctttgatcccattgtaccctgggatcccgaaa

SEQ ID NO: 58684 - DNA, 601 bp, Human
tcagaaaagttaaatacttttttaaagatcctgtagatggttagaggcagctaggattcaaatacccatctgtctggatctgaagcctatctcttaatccccaaacccactgcaacatgcagtccattctcacatgtgcaagtgcatctaacccacaaatgctttttttaaaaaaaatattaaggatgagctggtggtgtttcctccataccccggccagtcacagtttagcatcatgggataagtgtgggaaaggtctgactagagtagaaatacagattgtgcccagccttaaaacaawaacatgtttctttcacatttcacattaacaaatctaaacagctgatgaaatactgtaatcctaggattatataccatgaggagcctaagaacccctttttaatttatcaaagattcagtatatttgtaatcacatgtaataagtgaggttgctgatgtagaggaaaaagaaatgacaatctttgatcccattgtaccctgggatcccgaaaatcatccttagcctgctggtagccagtctggtctttggtgttcctgggcatgtgtcccattctgagccatgggaatacttcttctcatg

SEQ ID NO: 58685 - DNA, 601 bp, Human
gggtgtgggtttatggtgggtggcggtagttgcccatgcttttggagctgagatgtaattcttccctccctccctccctccctccctcccttcctccctgcatgcctccctacctcccttcctcccttcttccattccttccttccttccagaaattctttagacaagcaaagaaagaaacttcacagagactttaagcagtttatatccaactatgtgactcctaagaggtgaccgcaggtggtttcaaaaatcttctgggaatgatcccatgttatataataatgagaacactgagctygacatcaggaggcctggctttagctttggtctcccttttcagtatgcctggaattctgggcagatcacttggcctctctgtgcttagttttgtcatctgtaaatagggaaggtaggactaatgagtgatttttaaactgttcctgggagccctcaaagattcatggaggtgtcttgagagtctgtcctacaagggatgttatggtagagaaggaggtggttgcatagatcaggcagggctgagtccctcattcctacttcaacctgaattaatgttctggtgaaactttttgaatgtatc

SEQ ID NO: 58686 - DNA, 601 bp, Human
tttgtcatctgtaaatagggaaggtaggactaatgagtgatttttaaactgttcctgggagccctcaaagattcatggaggtgtcttgagagtctgtcctacaagggatgttatggtagagaaggaggtggttgcatagatcaggcagggctgagtccctcattcctacttcaacctgaattaatgttctggtgaaactttttgaatgtatcccatttttaagctttctgctagaaaacctactccaaaaaagtttgaaaactaccagactggattatctttaaggtgccttccagcatamctgacttcaatatataaattatctgtgtgtgatcttcctttacagaaataatggagcctttcttttcctcgtgtggttgttgctctaagaatgcatttcttatcaagagaataatctgcttttcattctgcttcctacctagctcaacagagcacaaaatgcccaagctagatcccttattcccctgtgaatatcttctgtttagactcatccatcatcggtggggcttatgacagacatagatgttttcacagttaccacacagggccaactgttttagtaagggtgaccacttaggac

SEQ ID NO: 58687 - DNA, 601 bp, Human
ccaccctccaataggccccactgtgtgttgttctcctccatgtgtccatgtgttctcatcatttagctcctacttacaagtgagaacatgtggtatctgcttttctgttcctgcattggtttgctaaggataatggcctccagctccgtccatggccctgcaaagaatatgatctcattcttttttatggctgcattgtattccatggagtatattatacatgccacattttctttgtccagtctatcattgatgggtatttgggttgattccatgactttgctattgtgaatagtgctgyaatgaacatactcatgcacatgtctttataatagaatgatttatattcctttgggtatatacctagtaatggaattgctgagtctaatggtatttctgtctttaggtctttgaggaatcaccatactgtcttccacagtggttgaactaatttacactcccaccaacagtgtatacgcattcctttttttctccacaacctcaccagcatctgtttttttttttttaataatagccatgaaataaagtcttgatgatgataatgatgatgatgtcaaggattctgacaatgtaaacaatg

SEQ ID NO: 58688 - DNA, 601 bp, Human
ccttctgaacactgcatcattgtaacattctgactttctgcctctttcctccatatttaaaggatgtttatattccactggacccacccaaaaaattcaggagaatctccttattttgaggtcagctgattactgatcttaatgccatctgcagccttaattcccacttgccatgtaacatattcaaatgctctggggattaggacattcacatttttaggggcctttattctgtttatcacagacaagattgtatttatgcatttttgaaatacatacatatatacatatttcatatagaatatatatatataaggccttgagacaatgctttctttacctagaacaaagttattttgttctaggtataattatttccattttaccaagggaaaaaaaaagaataaggtgaagcaaattgcctacatttctggagctggttatggcagagccaggactggaagccagatttccaaacccagtgttctcattcagtgaaaagtggttttcctaaacccagctgtcatgttcctcaagctccagaacctctggagggtgagctgtggtggacaatttgagaatttaggtgggttttgtttca

SEQ ID NO: 58689 - DNA, 601 bp, Human
aggatgtttatattccactggacccacccaaaaaattcaggagaatctccttattttgaggtcagctgattactgatcttaatgccatctgcagccttaattcccacttgccatgtaacatattcaaatgctctggggattaggacattcacatttttaggggcctttattctgtttatcacagacaagattgtatttatgcatttttgaaatacatacatatatacatatttcatatagtatatatatatataaggccttgagacaatgctttctttacctagaacaaagttattttgtyctaggtataattatttccattttaccaagggaaaaaaaaagaataaggtgaagcaaattgcctacatttctggagctggttatggcagagccaggactggaagccagatttccaaacccagtgttctcattcagtgaaaagtggttttcctaaacccagctgtcatgttcctcaagctccagaacctctggagggtgagctgtggtggacaatttgagaatttaggtgggttttgtttcagagattgaaggatttgagagatgaaggattggcagttgctgaatagtaagtgctagtcca

SEQ ID NO: 58690 - DNA, 601 bp, Human
agccaggactggaagccagatttccaaacccagtgttctcattcagtgaaaagtggttttcctaaacccagctgtcatgttcctcaagctccagaacctctggagggtgagctgtggtggacaatttgagaatttaggtgggttttgtttcagagattgaaggatttgagagatgaaggattggcagttgctgaatagtaagtgctagtccatggacaaatttatgcaaaaggctgcgttctccgtcaatttacacacaattgctactcatctgtaagacttagcatctgcctcacactcycctatatttaaccctcagcctgatcatgtgcttgtcacaaatcaatatttctcccactcgacaggaacttcagccctttcaaatttgttccaggtaatttgaggagactccagggcagtgatgaaataaagtgaaagcccgtgatttactggatctggaggcttgtgctgtgagtgagaagtgagggtgaaagacccttatcacaagtatttgtgcttttagatgcactgagtccccacccagaggtaggctccctgccaactcagtcccaaaccccctctgaaatggggaagaaggggc

SEQ ID NO: 58691 - DNA, 601 bp, Human
tggttttcctaaacccagctgtcatgttcctcaagctccagaacctctggagggtgagctgtggtggacaatttgagaatttaggtgggttttgtttcagagattgaaggatttgagagatgaaggattggcagttgctgaatagtaagtgctagtccatggacaaatttatgcaaaaggctgcgttctccgtcaatttacacacaattgctactcatctgtaagacttagcatctgcctcacactctcctatatttaaccctcagcctgatcatgtgcttgtcacaaatcaatatttctsccactcgacaggaacttcagccctttcaaatttgttccaggtaatttgaggagactccagggcagtgatgaaataaagtgaaagcccgtgatttactggatctggaggcttgtgctgtgagtgagaagtgagggtgaaagacccttatcacaagtatttgtgcttttagatgcactgagtccccacccagaggtaggctccctgccaactcagtcccaaaccccctctgaaatggggaagaaggggcccgggctgtgcagttcaggtaccacaaggtcttcatttgtgcttgcagcaaat

SEQ ID NO: 58692 - DNA, 601 bp, Human
gttttgtttcagagattgaaggatttgagagatgaaggattggcagttgctgaatagtaagtgctagtccatggacaaatttatgcaaaaggctgcgttctccgtcaatttacacacaattgctactcatctgtaagacttagcatctgcctcacactctcctatatttaaccctcagcctgatcatgtgcttgtcacaaatcaatatttctcccactcgacaggaacttcagccctttcaaatttgttccaggtaatttgaggagactccagggcagtgatgaaataaagtgaaagcccstgatttactggatctggaggcttgtgctgtgagtgagaagtgagggtgaaagacccttatcacaagtatttgtgcttttagatgcactgagtccccacccagaggtaggctccctgccaactcagtcccaaaccccctctgaaatggggaagaaggggcccgggctgtgcagttcaggtaccacaaggtcttcatttgtgcttgcagcaaatagaaaagcatgtttctgacttggcccctagtgtgaggtctggtcttggaggttccgcggtctctcttaagactctcactggctcacct

SEQ ID NO: 58693 - DNA, 601 bp, Human
agacccttatcacaagtatttgtgcttttagatgcactgagtccccacccagaggtaggctccctgccaactcagtcccaaaccccctctgaaatggggaagaaggggcccgggctgtgcagttcaggtaccacaaggtcttcatttgtgcttgcagcaaatagaaaagcatgtttctgacttggcccctagtgtgaggtctggtcttggaggttccgcggtctctcttaagactctcactggctcacctctgctgcccctccacatgccagaattctcaggcaaactaagcttaagcacmaactagggctccagtgcagcccagaacttaaagcactttgctaggtgcagacctggctttggtatgagtctgtgtaatttgtcccatgttgtcacagttgtcagtcacacctccctgtttatagtggttccagggctttgggattcttcaggatcagtcctgcatagtccagccagaggggattactgttccccaaggtactacaggcctcttctttcatcccagctgactgtggggcagaatcagctctgtgatattgataaagaactgaaatagatccttttagacttcaggacttca

SEQ ID NO: 58694 - DNA, 601 bp, Human
gctaggtgcagacctggctttggtatgagtctgtgtaatttgtcccatgttgtcacagttgtcagtcacacctccctgtttatagtggttccagggctttgggattcttcaggatcagtcctgcatagtccagccagaggggattactgttccccaaggtactacaggcctcttctttcatcccagctgactgtggggcagaatcagctctgtgatattgataaagaactgaaatagatccttttagacttcaggacttcatcagcctgaaataattttctcagtactaaataaatagttrccccaacaatgatgaaaaataaatatcggggctatgggtgaaataagttgctgaaggaaatttaatgttatcaataatataatggaattttgccctgttttacagttcataaagcactttcacacatgttattcatgtcatcaggaaatgtttactggcgggccccagtgctggagatacaccaggaagtgaagcagagattgtgttctcgcaggccttcttctgggattataaagtggggctgctgaggagtgaacctgtaatcttacacattagcgtatactcccaccatggagccat

SEQ ID NO: 58695 - DNA, 601 bp, Human
tgctttaaagtttgcagattgagtaatgtctttttccgacagtaaatttagttaacagttatttgtaaaataattaaaatttcaagtaacacatgctcattttgcttaactaagtttgtgggtttattgttgaaaataaagatcaaataggccgggtgcagtggctcacgcctgtaatcccagcactttgggaggccgaggcaggtggatcacaaggtcaagagtccaagaccagctggccaatatggtgaaaacccatctctactaaaaaatacaaaaattagctggacgtggtggcgcrtgcctatagtcccagctactcaggaggctgaggcaggagaattgcttaaacccaggaggtggaggttgcagtgagccaagatcacaccactgcagtccagcctgggcaacagagtgagactctgtctcaaaaagttgagtttatttttcagctaactggctattttaaaattttggaaaaatttaaaaatattacaaatcatacacaatagatgttgagttaaattcaattcagttgacttttttgatttggtatttttttaaaaaaaaagttgaccatgtgtggtggctcgtgtctgta

SEQ ID NO: 58696 - DNA, 601 bp, Human
aaagtttgcagattgagtaatgtctttttccgacagtaaatttagttaacagttatttgtaaaataattaaaatttcaagtaacacatgctcattttgcttaactaagtttgtgggtttattgttgaaaataaagatcaaataggccgggtgcagtggctcacgcctgtaatcccagcactttgggaggccgaggcaggtggatcacaaggtcaagagtccaagaccagctggccaatatggtgaaaacccatctctactaaaaaatacaaaaattagctggacgtggtggcgcatgcctrtagtcccagctactcaggaggctgaggcaggagaattgcttaaacccaggaggtggaggttgcagtgagccaagatcacaccactgcagtccagcctgggcaacagagtgagactctgtctcaaaaagttgagtttatttttcagctaactggctattttaaaattttggaaaaatttaaaaatattacaaatcatacacaatagatgttgagttaaattcaattcagttgacttttttgatttggtatttttttaaaaaaaaagttgaccatgtgtggtggctcgtgtctgtaatccca

SEQ ID NO: 58697 - DNA, 601 bp, Human
tatggtgaaaacccatctctactaaaaaatacaaaaattagctggacgtggtggcgcatgcctatagtcccagctactcaggaggctgaggcaggagaattgcttaaacccaggaggtggaggttgcagtgagccaagatcacaccactgcagtccagcctgggcaacagagtgagactctgtctcaaaaagttgagtttatttttcagctaactggctattttaaaattttggaaaaatttaaaaatattacaaatcatacacaatagatgttgagttaaattcaattcagttgactttwttgatttggtatttttttaaaaaaaaagttgaccatgtgtggtggctcgtgtctgtaatcccagcactttggaaagctgagttggaaggatagcttgagaccaggagtttgagaccagcctgggcaacatggcaagacctcatctctactaaaaataaaaaataaaaaataagctaggcatagcagtgtgttcatatagtcccagctactcaggaggcacaggtgggaggatcgcttgaacccaggaggttgaggctgcagtgagctgtgatcacaccactgcactccagcctaggtgac

SEQ ID NO: 58698 - DNA, 601 bp, Human
tactaaaaaatacaaaaattagctggacgtggtggcgcatgcctatagtcccagctactcaggaggctgaggcaggagaattgcttaaacccaggaggtggaggttgcagtgagccaagatcacaccactgcagtccagcctgggcaacagagtgagactctgtctcaaaaagttgagtttatttttcagctaactggctattttaaaattttggaaaaatttaaaaatattacaaatcatacacaatagatgttgagttaaattcaattcagttgacttttttgatttggtatttttttwaaaaaaaagttgaccatgtgtggtggctcgtgtctgtaatcccagcactttggaaagctgagttggaaggatagcttgagaccaggagtttgagaccagcctgggcaacatggcaagacctcatctctactaaaaataaaaaataaaaaataagctaggcatagcagtgtgttcatatagtcccagctactcaggaggcacaggtgggaggatcgcttgaacccaggaggttgaggctgcagtgagctgtgatcacaccactgcactccagcctaggtgacagagaaagaccttgtctca

SEQ ID NO: 58699 - DNA, 601 bp, Human
aggctgaggcaggagaattgcttaaacccaggaggtggaggttgcagtgagccaagatcacaccactgcagtccagcctgggcaacagagtgagactctgtctcaaaaagttgagtttatttttcagctaactggctattttaaaattttggaaaaatttaaaaatattacaaatcatacacaatagatgttgagttaaattcaattcagttgacttttttgatttggtatttttttaaaaaaaaagttgaccatgtgtggtggctcgtgtctgtaatcccagcactttggaaagctgagytggaaggatagcttgagaccaggagtttgagaccagcctgggcaacatggcaagacctcatctctactaaaaataaaaaataaaaaataagctaggcatagcagtgtgttcatatagtcccagctactcaggaggcacaggtgggaggatcgcttgaacccaggaggttgaggctgcagtgagctgtgatcacaccactgcactccagcctaggtgacagagaaagaccttgtctcaagaaataagcaaacaaaataagcctatcagtaatatccccaaatgttaataattgataccttg

SEQ ID NO: 58700 - DNA, 601 bp, Human
aggaggttgaggctgcagtgagctgtgatcacaccactgcactccagcctaggtgacagagaaagaccttgtctcaagaaataagcaaacaaaataagcctatcagtaatatccccaaatgttaataattgataccttgatttaaagatagtgatatctatttactttatatcagcatcacttaattttgataaatactccaagccttcattttgtttttaagtaaaagatgtaaaactcatctgggaatatatcaaacccctactagtgcctgccctcaaatgatcaagcctacacatarctgagtcgtaacaaatgtgttttaagggaatatcaagcattagcaatctacccaccacaggaaaacatctaattctataggagtcaagagttagtcctcattctaaatgcagatactctggggtgtgtaattcaacccatgtaagtgccccctctgtgcctggaccatggaatagatcgttcataagattgctgcatctcaggagacgggtcttttcaggagcactggatgattaggccaagttacttgggaaagccagtcactgtatttatttttacaagccagatgctggcacgtagt

SEQ ID NO: 58701 - DNA, 601 bp, Human
cacatagctgagtcgtaacaaatgtgttttaagggaatatcaagcattagcaatctacccaccacaggaaaacatctaattctataggagtcaagagttagtcctcattctaaatgcagatactctggggtgtgtaattcaacccatgtaagtgccccctctgtgcctggaccatggaatagatcgttcataagattgctgcatctcaggagacgggtcttttcaggagcactggatgattaggccaagttacttgggaaagccagtcactgtatttatttttacaagccagatgctggcrcgtagtgcattcttttacaaaaataaaagggatttggagaaaaagaaaggttcagggtcacagatgaaatcatgagggtattttacatggttttatgggtagaaatttttacttttaccttctacaatggttctaaaaaagccgttgagctgctctgtgcagaaagtacacagggaagagttttatgcccacagtagagtaaaaaccttaaactgggacatcaagggactccatgcctgaggccgtggagaggctaatagtgccacggggtagggaacaggggagtctctgttcaccatg

SEQ ID NO: 58702 - DNA, 601 bp, Human
acagatgaaatcatgagggtattttacatggttttatgggtagaaatttttacttttaccttctacaatggttctaaaaaagccgttgagctgctctgtgcagaaagtacacagggaagagttttatgcccacagtagagtaaaaaccttaaactgggacatcaagggactccatgcctgaggccgtggagaggctaatagtgccacggggtagggaacaggggagtctctgttcaccatggtcctgtctcattcctaaggagtctttgggagcccatagttaagctgttttgataaacastaagtaataaccagatatggacatgtggaattgattaagagaggagggattaactaatgcactaaataacccatcatgcgtggtgggttggggaggaggtagagacataatggtacaagctcctgacgaagaagggccctgagattttccttcagcccacagatatttactgagcacctactgtgagccagctcctgttctaagaacgaaggatatgacagtgaaacaggcacaaattctgctctattgcttgtggagcttacattcttgagggggaacccaaggatgcttaagaagaga

SEQ ID NO: 58703 - DNA, 601 bp, Human
gacatgtggaattgattaagagaggagggattaactaatgcactaaataacccatcatgcgtggtgggttggggaggaggtagagacataatggtacaagctcctgacgaagaagggccctgagattttccttcagcccacagatatttactgagcacctactgtgagccagctcctgttctaagaacgaaggatatgacagtgaaacaggcacaaattctgctctattgcttgtggagcttacattcttgagggggaacccaaggatgcttaagaagagacagaaatcatcacaatgagwagaaagagagtgatgtggtagaggttgctactttacatgggttgattagaggaggcctctccgataaggtgacatttgggcaaaggcttgaatgaagtgagagagtgagccatacgtttatctgagagagaggcagataattccaggcaaacgggacagctaacctaaaagctttgtgacagaatcatgtttggcagaatcaaggaataaaaaggcatcttagaaattgcttgggtaatgctttaagatcaattgtcatctcctttcaacttgttacagactcctgcttttaggtgtatg

SEQ ID NO: 58704 - DNA, 601 bp, Human
ggaggaggtagagacataatggtacaagctcctgacgaagaagggccctgagattttccttcagcccacagatatttactgagcacctactgtgagccagctcctgttctaagaacgaaggatatgacagtgaaacaggcacaaattctgctctattgcttgtggagcttacattcttgagggggaacccaaggatgcttaagaagagacagaaatcatcacaatgagaagaaagagagtgatgtggtagaggttgctactttacatgggttgattagaggaggcctctccgataaggtgrcatttgggcaaaggcttgaatgaagtgagagagtgagccatacgtttatctgagagagaggcagataattccaggcaaacgggacagctaacctaaaagctttgtgacagaatcatgtttggcagaatcaaggaataaaaaggcatcttagaaattgcttgggtaatgctttaagatcaattgtcatctcctttcaacttgttacagactcctgcttttaggtgtatgctatatagttattggtcaaacattaagagctggtccccattaataactataacacttcctgtattcaggtga

SEQ ID NO: 58705 - DNA, 601 bp, Human
gtgaaacaggcacaaattctgctctattgcttgtggagcttacattcttgagggggaacccaaggatgcttaagaagagacagaaatcatcacaatgagaagaaagagagtgatgtggtagaggttgctactttacatgggttgattagaggaggcctctccgataaggtgacatttgggcaaaggcttgaatgaagtgagagagtgagccatacgtttatctgagagagaggcagataattccaggcaaacgggacagctaacctaaaagctttgtgacagaatcatgtttggcagaatyaaggaataaaaaggcatcttagaaattgcttgggtaatgctttaagatcaattgtcatctcctttcaacttgttacagactcctgcttttaggtgtatgctatatagttattggtcaaacattaagagctggtccccattaataactataacacttcctgtattcaggtgatgagaaaaagaaggtcctgctctcaagaggtgcaaatagtgctggggagaggtctggagagaatgagagacagaggcaccaatagctaagtagactagaagtaggtagcagaaccctgacctccacatt

SEQ ID NO: 58706 - DNA, 601 bp, Human
atacgtttatctgagagagaggcagataattccaggcaaacgggacagctaacctaaaagctttgtgacagaatcatgtttggcagaatcaaggaataaaaaggcatcttagaaattgcttgggtaatgctttaagatcaattgtcatctcctttcaacttgttacagactcctgcttttaggtgtatgctatatagttattggtcaaacattaagagctggtccccattaataactataacacttcctgtattcaggtgatgagaaaaagaaggtcctgctctcaagaggtgcaaatagkgctggggagaggtctggagagaatgagagacagaggcaccaatagctaagtagactagaagtaggtagcagaaccctgacctccacatttctcctgtttgttttaacagctccgcttagcagcaccacaagaaggagcgtggaaagtatggaatcagatctgtttgtgcggtttttacatttcaggcgattaagtgaaatggtaaatgaaaccaaatctattgcctctatccctgtcagtgtgaggcaaagagggaaaataaacttcaactcctggtgtagacagtggaagggtgagaca

SEQ ID NO: 58707 - DNA, 601 bp, Human
gatacatgtatagaacacgcagatttgttacacaggcatacatgtgccatggtggtttgctgcacctattgacccgtcctctaagttccctcccctcacccccacccttcaataggccctggtgtgtgctgttcccctccctgtgtccatgtgttatcatggttcagctgccacttatgagtgagaacatgtggtgtttggttttctgttcttgtgatagtttgctgagaatgatggcttccagcttcatccatgaccctgcaaagggcatgatctcattcctttttatggctgcatagtrttccatggtgtatatgtaccacattttctttatccagtctatcattgatgggcatttgggttagttccatgtctttgctattgtaaatagtgctgcaataaacatatgtgtgcatgtgtctttatagtagaatattttatattcctttgggcatatacccagtaatggggctgctgggtcaaatgttatttctggttctaggtccttgaggaattgctgtactgtcttccacaatggttgaactaatttacgttcccattaacagtataaaagtgttcctatttctccacaacctcacta

SEQ ID NO: 58708 - DNA, 601 bp, Human
gttcatatttttcacccactttttgatggggttatttttttcttgtcaatttgtttaagttccttatagatgctggatattagacctttgttggatggatagatcgcaaaatttttctcccattctgtaggttgcctgttcactctgatgatagcttcttttgctgtgcagaagctctttagtttaattacatcccatttgtcaattatggcttttgctgcaattgcttttggcgttttcattatgaagtctttgcccatgcctatgtcctgaatggtattgcctaggttttcttctaggktttttatggtttggggctttacatttaagtctttaatccatcctaagttaatttttgtataaggtataaggaagggtgatccagtttcagttttctgcacgtggctagacagttttcccagaaacatttaatgaataggagatcatttcccgatcgcttgtttttgtcaggtttgtcaaagatcagatggttttagatgtgtggtgttatttctgaggtctctgttctgttccattggtctatatgtttgttttggtaccagtaccatgctgttttggttactgtagcctgtagtatagt

SEQ ID NO: 58709 - DNA, 601 bp, Human
aaatctgtgtctcagccccctgctccaagtttagctcatccattacctaaaattgggtttacacaaggaaaattactttagtgctaatccagttgacttgtaaagtaaatttagcttcctcgggttcctagtcccataatctaaactgatttcaacaacagctttaggagtcctcccacacttcttaagaaccctcaggagcatgggtccccagcaagctgaccacagctactagtcatcttcaagccagtgatgtttgctgccttggtacattgtccgtggctccacaattacacactgsagggtagggctgggagtagtgggagaagatagccttgggctattcatttcacatttctgtgtctccgtctgtaaaatcctggtaacaaatgaggtgccacatagagggaaaaagtggaattaaatgttttgaacccaactcacagaaaatctgtggagtaaaaagctgattacaggtaacaaaatcttcctttttttctcccttgttcctaagtgttagacctgggttcacttgccacaacttataaaccaatcaaatgtgatgatgtttaagacttgcttacagtggtttccccaaagc

SEQ ID NO: 58710 - DNA, 601 bp, Human
ccacacttcttaagaaccctcaggagcatgggtccccagcaagctgaccacagctactagtcatcttcaagccagtgatgtttgctgccttggtacattgtccgtggctccacaattacacactggagggtagggctgggagtagtgggagaagatagccttgggctattcatttcacatttctgtgtctccgtctgtaaaatcctggtaacaaatgaggtgccacatagagggaaaaagtggaattaaatgttttgaacccaactcacagaaaatctgtggagtaaaaagctgattacargtaacaaaatcttcctttttttctcccttgttcctaagtgttagacctgggttcacttgccacaacttataaaccaatcaaatgtgatgatgtttaagacttgcttacagtggtttccccaaagctaatcaatgaaaagtccttacattccacaaactagtcagctttgcagcaacagcctcaccttcttggggaggcacatgatgtgagtcacacaattttcatgccagcccagagcgttgggtgccattacaaagccatgggtgtcttacatgaatgggagcctcacggggggttgaa

SEQ ID NO: 58711 - DNA, 601 bp, Human
aagttccattgtgggtgagtgctattgtgatgtgctattgtgtgtgtactattgggtaagtgctattgtgatgtttatcagatcctcatcataaccacatgaagcagtaaaggtattatctccaactggggcacagaaaaaaaaagttaacttgtccaagtcacatagctagtaagtggcaggcctagaattccaacccaggcattctatcatgattactagtggccacgaatcagatgattgtagtaacttgtcctggacttgggagatctgtatgctgactcatagagccctaacagtktcttaattgatacgcccagtggtttcttctcagtcaccagtgaactttgtagaataggatgcagctggttaccctttcatagcatctttcacccttttttcccacctctttgagactctttttagtgtgctttgttgacttctcttcctctttcaacctcatatttgtggattcccccacaagtttctgtccctgcccttcctccttccctcaccatctaatctcacctgcatacccagtgtgctcatcaattcttataggttcaactgtcagttctataaggatgactgaaatttatca

SEQ ID NO: 58712 - DNA, 601 bp, Human
gatctgtatgctgactcatagagccctaacagtgtcttaattgatacgcccagtggtttcttctcagtcaccagtgaactttgtagaataggatgcagctggttaccctttcatagcatctttcacccttttttcccacctctttgagactctttttagtgtgctttgttgacttctcttcctctttcaacctcatatttgtggattcccccacaagtttctgtccctgcccttcctccttccctcaccatctaatctcacctgcatacccagtgtgctcatcaattcttataggttcaactgtcagttctataaggatgactgaaatttatcagccaaccctgactcttttcccgaatgcaagacctgcatttccagcctcccattggacatttccctatggacagcctgccagcattccctatttcacctctccacattgccgcactaatttgcacagtagccagtacataataagcatgtgataaattggtaatagatgaaagaatgcataatttaatgaaacagttgccaccttccatagatttaatcttccagactgctcttacctaagctactttcttccgtttttctgaatccc

SEQ ID NO: 58713 - DNA, 601 bp, Human
ctgtatgctgactcatagagccctaacagtgtcttaattgatacgcccagtggtttcttctcagtcaccagtgaactttgtagaataggatgcagctggttaccctttcatagcatctttcacccttttttcccacctctttgagactctttttagtgtgctttgttgacttctcttcctctttcaacctcatatttgtggattcccccacaagtttctgtccctgcccttcctccttccctcaccatctaatctcacctgcatacccagtgtgctcatcaattcttataggttcaactgkcagttctataaggatgactgaaatttatcagccaaccctgactcttttcccgaatgcaagacctgcatttccagcctcccattggacatttccctatggacagcctgccagcattccctatttcacctctccacattgccgcactaatttgcacagtagccagtacataataagcatgtgataaattggtaatagatgaaagaatgcataatttaatgaaacagttgccaccttccatagatttaatcttccagactgctcttacctaagctactttcttccgtttttctgaatcccctc

SEQ ID NO: 58714 - DNA, 601 bp, Human
atgcccttttgatactatcagtatgaaatgttgagaagcaaaagctcaaaggcttaattttagaagagagagagcagtttctaaaggagtgactgatgggagagagactcagtagttgactatgcaaaggtgcccagggcaggtgtgaacaacaaagctggcttcctgatacaggtagtactgaaagaaccccggctccacagccctgcagcacctttaaagaaagggtgagggagacatgcttaagcatttttttttctgctccacaacagggcccagggtattgacagtgctgacagarcaactgagaagttgtttaggttggcattaacaaacccggcacattgccttttctgattgacacaattcaaacgggtatcaactgcctttcagtaccactgagaagtggtgaacgatgagggaatcatagggccatccaagtgcattcctagcagggaccatgaatcagccttatcttgtcccacctcctctttacacagggaggtaagccaaggctcaggacatcatcagatatgtgataaatcctccattaactggaatagtcagttaacaagacttgtttgccttttatattgttata

SEQ ID NO: 58715 - DNA, 601 bp, Human
catcatcagatatgtgataaatcctccattaactggaatagtcagttaacaagacttgtttgccttttatattgttatagtccaattttggttaagtagaggtaaaataggtaaaaataagatggttgtttgtttgcttgtttttgagacgaggtctcactctgtcaccaggctggattgcagtggtgcgatcatggctcactgcagcgtctacctcttggactcaagcaatccccctacctcagcctcccgagtagctgggactacaggcacgtgcccagttaggttgggattttttcaytgaagtgattttaagtaatatgtacagtttcacatctggtaccttgctccaccatttactaactaggtgaccctggacacatttctttatttttatttttataacttgctctgttgcccaggatggagtgcagtggtgcaatcatagctcactgcagccttgaactcctgagctcaagggatcctcttgcctcagcctcccgaagagctggggctacaggcacatgccaccatgcctggctaatttttaatttttatttatttatttatttattttgtagagacaggtcttgtcttattg

SEQ ID NO: 58716 - DNA, 601 bp, Human
cgtgcccagttaggttgggattttttcattgaagtgattttaagtaatatgtacagtttcacatctggtaccttgctccaccatttactaactaggtgaccctggacacatttctttatttttatttttataacttgctctgttgcccaggatggagtgcagtggtgcaatcatagctcactgcagccttgaactcctgagctcaagggatcctcttgcctcagcctcccgaagagctggggctacaggcacatgccaccatgcctggctaatttttaatttttatttatttatttatttwttttgtagagacaggtcttgtcttattgcccaggctggtcttgaactgctggctttaagcaattctcccaccctagcctcccaaagtgcatttcttaaattcttatatatgcctcagtttactcatctgtataagagggtaaatagaacttacctcttatggttgtaacgataaataaataagataaagtatatatatgtgtatatatatatatcacttaaaaagaataagcactcaatatatatttattttattaatactgctattatcatctgcttttgctctatctctattcctgcc

SEQ ID NO: 58717 - DNA, 601 bp, Human
tcactgcagccttgaactcctgagctcaagggatcctcttgcctcagcctcccgaagagctggggctacaggcacatgccaccatgcctggctaatttttaatttttatttatttatttatttattttgtagagacaggtcttgtcttattgcccaggctggtcttgaactgctggctttaagcaattctcccaccctagcctcccaaagtgcatttcttaaattcttatatatgcctcagtttactcatctgtataagagggtaaatagaacttacctcttatggttgtaacgataaatraataagataaagtatatatatgtgtatatatatatatcacttaaaaagaataagcactcaatatatatttattttattaatactgctattatcatctgcttttgctctatctctattcctgcctgatgcacctgaaggttgagcggcattgtaaacagagggtggcagcatgagcttaggcattgtgtggaactggatgtgaacttggggaaattgcttcattctctaaacctcagtttcctcatctattaaatgggaggagtaatacctgcctctacatgattcttgtatggaacaaat

SEQ ID NO: 58718 - DNA, 601 bp, Human
tccaggaagttatccctgaccaccccagcctacggtggattttcctgcactgaatgtgttacacttagattccatggtatatgatttaacacatggcctctcatatgaaataacatatgaaatgttatttcaacattttatatcttgtctctccagaaacgttacatgctccttgagggaagaaatcaagtctaacctgccttttgaaccctctatgtagtgctataaaataaatatgtcctcaaccaagtcctgattgactaagaaaaccagtgattggtcaatgatgttactttgtctyctgctaaacatttttggggcaggggatagaggggtgtgggagaatgggagttcaactcagaggaaacttagtaaagaggaaaagacataacagacctggtattgagtccccatctggccaattaatcaccaagttatcaaataaagcctatttgatctcttcgacctcattttcctcatctttgaaatatcttcctcttagcatgattttgaggatcaaatagagataatatatggaaaattctttgtatgcaggagcccactttgtaatgttattcattgcttcaattttcaatttggc

SEQ ID NO: 58719 - DNA, 601 bp, Human
aacctgccttttgaaccctctatgtagtgctataaaataaatatgtcctcaaccaagtcctgattgactaagaaaaccagtgattggtcaatgatgttactttgtcttctgctaaacatttttggggcaggggatagaggggtgtgggagaatgggagttcaactcagaggaaacttagtaaagaggaaaagacataacagacctggtattgagtccccatctggccaattaatcaccaagttatcaaataaagcctatttgatctcttcgacctcattttcctcatctttgaaatatctkcctcttagcatgattttgaggatcaaatagagataatatatggaaaattctttgtatgcaggagcccactttgtaatgttattcattgcttcaattttcaatttggcttgggttaagaaaaaaagtatttttttttctctcaaaccagtgagcgggggaagaatgataaaaatcacattttctgaaattactctagcttatgtaagaagtttgatctgccagtatttgcctttttctcacatcacctgctgcatgccacacacctgatttgtctgttgtgttcatgtaggattttgtagc

SEQ ID NO: 58720 - DNA, 601 bp, Human
ggagttcaactcagaggaaacttagtaaagaggaaaagacataacagacctggtattgagtccccatctggccaattaatcaccaagttatcaaataaagcctatttgatctcttcgacctcattttcctcatctttgaaatatcttcctcttagcatgattttgaggatcaaatagagataatatatggaaaattctttgtatgcaggagcccactttgtaatgttattcattgcttcaattttcaatttggcttgggttaagaaaaaaagtatttttttttctctcaaaccagtgagcrggggaagaatgataaaaatcacattttctgaaattactctagcttatgtaagaagtttgatctgccagtatttgcctttttctcacatcacctgctgcatgccacacacctgatttgtctgttgtgttcatgtaggattttgtagctcacaaaagcattttcacatgcattatcatacaaaaaccctgtgatacaggcactgtggaagtaagtattcccatttcattgatgagtaaactgagactcacagaggctttaaaaatgccccaacatcaccctatcaggctgacagtgcctgcc

SEQ ID NO: 58721 - DNA, 601 bp, Human
gtaggattttgtagctcacaaaagcattttcacatgcattatcatacaaaaaccctgtgatacaggcactgtggaagtaagtattcccatttcattgatgagtaaactgagactcacagaggctttaaaaatgccccaacatcaccctatcaggctgacagtgcctgccttcctccagccttgtcctctttccacaacaccacactggttctcctgtacaaatattaggcagctcccacaagacattctcagtcacaaacatgatcaccatctacttcctagtcaaggagatcagttcactcattttgtcttcatacaaataattaaaacagggactgggtaccttggcccatgcctgtaatcccaacactttgggagttcaaggcggggagatcacttgagcccagggatttgagaccagcctgggcaacatggtgaaaccttttctctacagaaaaaacacacaaaaattgctgggtttagtggtggcacttatggtcccagctacccgggaggctaaggtgggaggatcacccaagcccagtaggtcaaggttgcagtgagctgtgattgtgccacagcactcctgcctgggtgacag

SEQ ID NO: 58722 - DNA, 601 bp, Human
ggaggctttttaggcctcggtaaatcagagttaacaacacccagttaacaagcccagtgtcacagtgagagtgaaatgagataatgcatatatagcactttctcctccatgtgactcatagataaaagctgttgatatttcaactgttctgggctatgtaaattttaaaagatttcatgtctaggtgacacgtgaaagtccagcacgtggaccataaatgttgtcatggtttgacagtattaatgaaacacttcatcgtgtgtcagccagcctcaccttgacaggtcatctctggctggcrtaacccaagggccaatgtgaaaaggacatttcactgaggacatgatggggttgccttgtttttcttgcttcttaaagagccatttcaattaatttttttcacacataatcctgaccccttggcctcccagtagaatgctatacgtgcacaacaggaattttggcgtttattgtttatcctctgggggaatgtggtcccccttttactgcctttttcagcccactccccccagttgaatttttctgagaggcagtggaagggaaagtatatacccccatagttgtatttttttatccttat

SEQ ID NO: 58723 - DNA, 601 bp, Human
atgtgactcatagataaaagctgttgatatttcaactgttctgggctatgtaaattttaaaagatttcatgtctaggtgacacgtgaaagtccagcacgtggaccataaatgttgtcatggtttgacagtattaatgaaacacttcatcgtgtgtcagccagcctcaccttgacaggtcatctctggctggcgtaacccaagggccaatgtgaaaaggacatttcactgaggacatgatggggttgccttgtttttcttgcttcttaaagagccatttcaattaatttttttcacacatawtcctgaccccttggcctcccagtagaatgctatacgtgcacaacaggaattttggcgtttattgtttatcctctgggggaatgtggtcccccttttactgcctttttcagcccactccccccagttgaatttttctgagaggcagtggaagggaaagtatatacccccatagttgtatttttttatccttattcacgattctcaacagctttttaaaagtgatggctggcagccaggtacagtggctcatgcctgtaatcccagcactttgggaggctgaggcagaaagatcatgaggtc

SEQ ID NO: 58724 - DNA, 601 bp, Human
agtctataatctgagctgacctatatccatggcacatgtgttaaaggtggaaccatagtaggtcaggacagccatgtaaggtgtaggtgataatatcctgactttggaaatgaagaaatggatgcttaaatggctaagtaattatttaaggccacatgggtaagaaagggcagagctaggatttgaactctggtttatttgattccaaagcccttgctcttggatgctgtgacttagagtttttcaaatgccactttcttaaaaaggggtcttctagaaataaaaacttttaagaaaaggygaactttcaatggtggaaatgtgtgtattgtggcagtccagtcaggaaatggtgtgttatttttgagaagcaaaaccttttggtggttctcgactgttctccaaagacgcaatgtgcactgggcctccacgtagggaactccctttgctgagtctttaaaggaacctactggctgatgatgattattattaataaagtctaatatccagagagcaggattctttcccatgaacaggaccatggaaagcctggagttgggggaggcctagggagtcaacaatacaaaggaggcagtaggtt

SEQ ID NO: 58725 - DNA, 601 bp, Human
taattatttaaggccacatgggtaagaaagggcagagctaggatttgaactctggtttatttgattccaaagcccttgctcttggatgctgtgacttagagtttttcaaatgccactttcttaaaaaggggtcttctagaaataaaaacttttaagaaaaggtgaactttcaatggtggaaatgtgtgtattgtggcagtccagtcaggaaatggtgtgttatttttgagaagcaaaaccttttggtggttctcgactgttctccaaagacgcaatgtgcactgggcctccacgtagggarctccctttgctgagtctttaaaggaacctactggctgatgatgattattattaataaagtctaatatccagagagcaggattctttcccatgaacaggaccatggaaagcctggagttgggggaggcctagggagtcaacaatacaaaggaggcagtaggttcatggagagtgctgtgtgggggcacagtgaggaattgctacggggagcctaaagcagcattgtccagtggaaccacatacgtcatcttcagtttttaagagctacattttaaaaagtaaaaatgaatgaaagtaattt

SEQ ID NO: 58726 - DNA, 601 bp, Human
gctagttgaaggaaccagtaaaattcattgaaggctgctccccttagcctcacttagcctgcatttagttgactccaagcaggaattttctatctgattctctttgttttgtctgaacccgagatgttgaggctggaaatacagtcaagatccaatttgtgagctagcttatgagtcaggttaaggaatttacactgtatcctaaaaacagtaggagtcatcaatgcaatttaaccaggtggaactttcattaaaatgtaactatgtgatgtgaggatggggaagaaggaactaattggcsctttctcttcagacctcttgacttcagctttctggggactggcatttccactgttcttccatcatttctgagggtatcattggtttaccctctcaatccaaatgttcctctgtggttccccattttgatgtttaatctttgaggcatccacttatgtattcatcgatccttcagcagtcatgtactggaaacccttaggatgcatgctctgtaagacagggcgttctgccttgtccactgctgtggccccaagagtgggaggagtgggctgtcagtaggccaccaataaatatctgtgtt

SEQ ID NO: 58727 - DNA, 601 bp, Human
tacaggagtgtcttgctttcactaggagaaaacgtatgtcacctctcaccaaagatgtttatgtcttttcacaaacctgtctttttgcagtctaaaaacattccaactggaaatgactacaaagctgggagttgataggttaggggtgtttagtaaagcttcaaatactctcatggagtcagatacgattccgtactacgagccccacataacagcaacctgggcccagggattgtgaagccttttcatttctggttaatcagtgggagaggtggggagccatgagcctgccttggacccrccagccccgaaactaaaagactaaagttgcagggcttatggggagttcgcctagtgcacttaagaaatagggatggaacttgccttgttccacctttgggattgtattcaaatgagggcttgctaaaggctgaaggtgttggaatctgtaggaggtctgtgtagccatagcagagaaacatagagtgcgcttttataaacatttatttggtgccttctacaaaccaagttatatgtactagactctgctgggagtgagactggggttgcattactactacatggaaaagtaagaacagtt

SEQ ID NO: 58728 - DNA, 601 bp, Human
tacctattagctcatcattctatggcaacaggaaagatcaatttacaggccaagaatggaggtagagagaccagttaggagactcctgcagccatcttggtgggatattttgagagcttacactagagtaaccataaaaggttagaattggaaagaacatattatacagttcaacttccatattatacaaatggagtaagtgaggacaaagaaggtaagtgacctatccaaggttgtatggaaataaccttgttggcagccaaagtgggaccaagaccctggtcttctcatttccagtccrgtgacttttccactcagcaatgccaagttcagtcccagcatcatgcttcagttagggaatgccctagagaaacttgaaatgtacttggctggcatttttcctggccatatctaggaagtgagaacagtccttgttggatggagggaccttgaatccagccaggctgcctgggagggatctttttctgttcattatctttctggctttaggtacctcccacatcttccaccctcttcttctcctctaaaaatccttcttcagccattgcttacaaattctctcccttctgctgagtctagg

SEQ ID NO: 58729 - DNA, 601 bp, Human
gccaggctgcctgggagggatctttttctgttcattatctttctggctttaggtacctcccacatcttccaccctcttcttctcctctaaaaatccttcttcagccattgcttacaaattctctcccttctgctgagtctaggcagtgtagaacaaaacctagcaccttttttcaagtttgtttcctcaatattttaacctaactattgtatcactgttaagcacttgggcaattttgaggatgaataatccaataaaatcgaactgtttccatctaaactccttccacactttacatggyggtgttatttgtgcaaatactgttttgtgttgtctctttttcactaaatcatatatgtacacatttcaaagctcttggctttattatatatttcttataatggacactgcaagaaatttggagcaagacctaagcttttgggaaagagacttaatctctggacctaattcttcaactataaaatggagataatgctacctaccttgaggggttcctggtacaaggtaggtgtatagtaagctttcatctctctctctttctctgtctctctctgtctctctcctctttctctttcctctg

SEQ ID NO: 58730 - DNA, 601 bp, Human
tatatgtacacatttcaaagctcttggctttattatatatttcttataatggacactgcaagaaatttggagcaagacctaagcttttgggaaagagacttaatctctggacctaattcttcaactataaaatggagataatgctacctaccttgaggggttcctggtacaaggtaggtgtatagtaagctttcatctctctctctttctctgtctctctctgtctctctcctctttctctttcctctgtgtgtgtctgtctctttctctgtctcctctctctgtctctctctctctctgwctctctctctctctgtctctctctcctctttctctctttgtctttccgctgtgtgtgtctgtctctttctctgtctcctctctcttggttgcttctggtttggggcaatgtagtattttcataaacatgtatgatcacaaattatatccatgctgaaattcaaaggtaatttttttgatgtctacctcgaggcctagaatactgttgagcatagaataaaatctcaatagggcataatggtaggaagaagaaatgaagaggagaaaaagaataaaccatcttaacttgaaaaccaaatta

SEQ ID NO: 58731 - DNA, 601 bp, Human
tctctctgtctctctctctctctgtctctctctcctctttctctctttgtctttccgctgtgtgtgtctgtctctttctctgtctcctctctcttggttgcttctggtttggggcaatgtagtattttcataaacatgtatgatcacaaattatatccatgctgaaattcaaaggtaatttttttgatgtctacctcgaggcctagaatactgttgagcatagaataaaatctcaatagggcataatggtaggaagaagaaatgaagaggagaaaaagaataaaccatcttaacttgaaamccaaattagctgagatgctcgtgagcttccaatctcatacaggcattctaataacaagtattcacttactgtggacccaagaatggccagatggcttgtgaagaacatcagcctcagcaatcacacagatttccaccttagatggccttttgcagcctttggaggatggattggaagagtggaaggttggaggcagggctctcagtgaggggcagctgacaggtggtgggacctgagccatgagggaagaaagtggtcaaattcaagaattcctttggaagcaaatttagttttcaaggt

SEQ ID NO: 58732 - DNA, 601 bp, Human
ctgacaggtggtgggacctgagccatgagggaagaaagtggtcaaattcaagaattcctttggaagcaaatttagttttcaaggttgctactcttagaagctgcccctcttcctcttctcattatttcttccatttagcaaaactaaatgcatggggaggccaggtatggtggctcatgcctgtaatctcagcacttagggagatcaaggtgggaggattgcttgagtccaggagttcaagaccagcctgggcaacatagcaagaccctgtctctacaaaaaaaaaaaaaaaaaaaaagtraaaaaactagccaagcatggtggcacaagcctgtagttacagctactcaggaggctaaggcaggagaatcacttaagcctggaagtttgaggctgcagtgagctgtggtctcaccaccgcactccagcctaggtgacagagtgagatcctgtctcaaaaaataaagaaaaatgcatggagaggttgggtggctggggtggggaagtagagagattgactacacatttcagattgctagaggatccctctttgctgccaccacacagaaattaaaataaaaagtgggagagatttaattca

SEQ ID NO: 58733 - DNA, 601 bp, Human
aggttggaataggaggtaacttttcagaccacctccaattataatctgttcttaaagtttctatgtctctgatcttctgtctacattggaataattctgcatcttttacttggatccttaattttataatgtagccccgtttttattaaaagccagggctaattttaccttgagagatctgtttgcccctcccaagggagaagaacgctgcctctgaagtgggaagcttcacactcagctcgaggttactagagccattatgtggccatgcttttaaccagatctgctaataggtggcccrattcacaagttttaaaaagggatgttttccatttattcatggccatgatggtcttttgggaaagcattagtaagttgtgtttgcttgggtaaagagaaattgctatccacatgacagaaaataactcccactttaataaactgctcactgagcaaacctatggaccgtccatctctttgagctgtgtgatgactttccttcaagggttttaggggcagccatcttgatgtgatttcctctccatggctcaaaacagggtgtatgaaaggggctggggggataaattcagaggtcagaggt

SEQ ID NO: 58734 - DNA, 601 bp, Human
tggatccttaattttataatgtagccccgtttttattaaaagccagggctaattttaccttgagagatctgtttgcccctcccaagggagaagaacgctgcctctgaagtgggaagcttcacactcagctcgaggttactagagccattatgtggccatgcttttaaccagatctgctaataggtggcccaattcacaagttttaaaaagggatgttttccatttattcatggccatgatggtcttttgggaaagcattagtaagttgtgtttgcttgggtaaagagaaattgctatccayatgacagaaaataactcccactttaataaactgctcactgagcaaacctatggaccgtccatctctttgagctgtgtgatgactttccttcaagggttttaggggcagccatcttgatgtgatttcctctccatggctcaaaacagggtgtatgaaaggggctggggggataaattcagaggtcagaggtgttgggctatttatttcactgctctctgtccctatgaggctgccatgctgtgggattgccaagtcactgtccccggcattccatttgaagagccatgagaatcagaacaa

SEQ ID NO: 58735 - DNA, 601 bp, Human
ttatcttcaagaagcttcatgaagacaataattttaaaatattggagctggtttctcaataacttaaacatagaattactatatgacctagcaattctactcctgagtatgtaatcaaaagaactgaaaacagatgttcaaacaaaaactcatatgagaatgtttataacaacactatttacaatagccaaaaggtggaaatgacccaaatgccatcagtagaggagcggttaaacaaattgtggtatatccagacagtgaaacattatttatccataaaaaggaatgaaatacagatacrtgctacaaacctggatgaacctggaaaacattatactaagtaaaagaagccagacaccattgtatgatccatttatatgaaatttccagaatagataaatccatatagacagaattcagattagcggttaccaggggccaggctaggggtagtggagagtgattgtttaatagatatggggtttcctcttagggtaatataagtgttctagaacctatagtggtgaaggttgtacaatattgtgaaagaactaaataaatgcactaatggtacatgtaatggtaagtgtattatagcatg

SEQ ID NO: 58736 - DNA, 601 bp, Human
gtttaatagatatggggtttcctcttagggtaatataagtgttctagaacctatagtggtgaaggttgtacaatattgtgaaagaactaaataaatgcactaatggtacatgtaatggtaagtgtattatagcatgtatcagtacattctcacattgctataaagaaatacctgagacagggtaattgataaaaaaaggaagttcaattggctcacgtgtggttctgcaggctgtacagggagtatagcagcttctgcagaaggtgaacggagagcaagcttcttacatggcaggagcaaaagagtgagtggggaagtgccacatgcttttaaacggccatgagaatgagaacttactatcccaaggacagtaccacggggggtttgtgctaaaccattcacaagaaccctgcttccgtgatccagtcacctcccaccaggccccacctccaaccctggggattgcaattcaacatgagatttggtggggacacagacccaaaccatatcataccgccattttaaagatatagatgggtttgcctccatcccctaccccatcagcagcaccacgcaaaagactatttcagtgtacatttcc

SEQ ID NO: 58737 - DNA, 601 bp, Human
taagtgttctagaacctatagtggtgaaggttgtacaatattgtgaaagaactaaataaatgcactaatggtacatgtaatggtaagtgtattatagcatgtatcagtacattctcacattgctataaagaaatacctgagacagggtaattgataaaaaaaggaagttcaattggctcacgtgtggttctgcaggctgtacagggagtatagcagcttctgcagaaggtgaacggagagcaagcttcttacatggcaggagcaagagagtgagtggggaagtgccacatgcttttaaacrgccatgagaatgagaacttactatcccaaggacagtaccacggggggtttgtgctaaaccattcacaagaaccctgcttccgtgatccagtcacctcccaccaggccccacctccaaccctggggattgcaattcaacatgagatttggtggggacacagacccaaaccatatcataccgccattttaaagatatagatgggtttgcctccatcccctaccccatcagcagcaccacgcaaaagactatttcagtgtacatttccctttcatctagaattaatctcaccggcaatttttc

SEQ ID NO: 58738 - DNA, 601 bp, Human
gccgtttctacataaaacacctcgtaaggtaccaaaacacgttctcaagaagtcaactgcctttatacctgcagccattgcactcatggatgtaacagggacccagcccttcagaggcacagttgagacagtttatcacattgatttttatagaaaaagatgttacccagaatggtctgcgtccaagtggaccttttcagcaaaaaaaggaatattggaagcaggaagaaattgttttctgtatgccttaagaacaccacaaggcaggatgaatctacaaccattactcggtcatccaggrcaatctgtgggtaaactgtgtccttcgttatgtctgttaatactgcagaagaagcatataggtatctagtaagaaaatggaattcctgagtcagttaactgttcctttttctagaaaatgtttggagaaaataatgaaaatgggccaagcatggtggcttatacctgtaatcccaacactctaggaaggccgaggcaggaggatcatttgagcccaggggttcaagaccagcccaggcaacatagtgagactccatctctaccaaaaaaaagaaaaaaaaaaaaagaaaatgttggtgaa

SEQ ID NO: 58739 - DNA, 601 bp, Human
ctaactggcatctaggcacactgcctaggttcaccatttcactgtagccctttatcattgcttttctatgcagctctgggggtgtagctgtggaaactgtcaatacctctgagaactccttttgcaacaatctgtccattttactttggttgtattttattaataccacaagacttatgttctctctctctctttctctctgtctctcatttagatcccctatttgtttctttcttgatttgtatgggaaggcagaatctcaatcgtattggtatttttatatttaaaccatgggcctttrttttacccttgatcaaatcctgaggtcacatttcttctcctagccatgccagcatgtctgtttctcctctaagtaaaggtttctccctctaccaaataaaagttccaagcagcagtattgtttttactcctaaaccagcttcaccaaagagtatccatgataagaaaagtggtgaaccatttggctccatttggagttttcatacctggcctattgcttttgtatttccttttaagtcactggcttgcaacaatttgccaaagggcgcattgcccagttttgtgcctgaatagccttgac

SEQ ID NO: 58740 - DNA, 601 bp, Human
cagagattttcaagatgtgctttcatttccagtctctatacattttcaacaacaaagtaaagaacaatagtgacccaaaacttatagctaagtcatgttccatgaacatttttaaccataaaataatttctctcaaaggtttttttgttgttgttcctagtatatattgagtcatttacccagtgtgtaagctgctctagcaataagcttctgaaacctctgaactttttgggctcaccaccatgccagtaagaagtgcttgttggtgtcttaacctttgctgacagaaatctgatataayaccacaatgattgttgccactggctttgtaacaaactgttttttggttaagcttctggcaggaaacacatggcacaagccgatagactaagggaaatgttataatgtaattatttagggaggcattggcagaattaggagaaaccattaaggaaaggtgcgagacctggggctaacatgaatgggaggtattaccatcctagatcagttaccttaccttgcagaatatagctgagactgaagagagggctgtccagcacatgctgtggcctttggtagagggatatagtcaaccctcagc

SEQ ID NO: 58741 - DNA, 601 bp, Human
ttcaacccatactcttctcctgcctttcatctctggcaaatgactcccataggttcaacctaactggaagccacaggtcaaaggtatccattgacactatcagtagaggttggcctcagcaaggagctggtcagaaaggactgagactggatctggtgggctgaggatactcaggggaaatgtcatcactgactttaaatcgcttcataagagtcagctttaaataaattgtttcaagaaagaaatgggctgggctcggtggcttatgcctgtaatcctagcactttgggaggccgaggcrggcagatcatttaaggtcaggagttcaaaaccagcctggccaacatggtgaaaccccatctctactaaaaatacaaaaaaaaaaaaaattagccgggtgtggtggagggtgcctgtaatcccagctactcaggaggctgaggcaggagaattgcttgaaccccagaggggaggttacagcgagctgagattgcaccactgcactccagcctcggtgacagagcgacactccgtctcaaaaaaaaaaaaaaagttcagtaagggcctaaataagttatttcaactgaatttataaaatcag

SEQ ID NO: 58742 - DNA, 601 bp, Human
ccacaggtcaaaggtatccattgacactatcagtagaggttggcctcagcaaggagctggtcagaaaggactgagactggatctggtgggctgaggatactcaggggaaatgtcatcactgactttaaatcgcttcataagagtcagctttaaataaattgtttcaagaaagaaatgggctgggctcggtggcttatgcctgtaatcctagcactttgggaggccgaggcgggcagatcatttaaggtcaggagttcaaaaccagcctggccaacatggtgaaaccccatctctactaaamatacaaaaaaaaaaaaaattagccgggtgtggtggagggtgcctgtaatcccagctactcaggaggctgaggcaggagaattgcttgaaccccagaggggaggttacagcgagctgagattgcaccactgcactccagcctcggtgacagagcgacactccgtctcaaaaaaaaaaaaaaagttcagtaagggcctaaataagttatttcaactgaatttataaaatcagagaaccttgggagcaaccatagaaatcatccagcctctacttgaacattgccagacatctccagagacag

SEQ ID NO: 58743 - DNA, 601 bp, Human
gaaagaaatgggctgggctcggtggcttatgcctgtaatcctagcactttgggaggccgaggcgggcagatcatttaaggtcaggagttcaaaaccagcctggccaacatggtgaaaccccatctctactaaaaatacaaaaaaaaaaaaaattagccgggtgtggtggagggtgcctgtaatcccagctactcaggaggctgaggcaggagaattgcttgaaccccagaggggaggttacagcgagctgagattgcaccactgcactccagcctcggtgacagagcgacactccgtctcaaaaaaaaaaaaaaagttcagtaagggcctaaataagttatttcaactgaatttataaaatcagagaaccttgggagcaaccatagaaatcatccagcctctacttgaacattgccagacatctccagagacagagaaatccttccacttcaaagtgattatggaatgattccaactgctcaaaagttctgcctttgtaagctagaaaccaaaactcgtatgcaaaatctgattttttttaaatgttggccactgattccaattttttaaaaaacctaataaagaacaagtctatggactg

SEQ ID NO: 58744 - DNA, 601 bp, Human
tatggactggatccaaattttaacttctggataatttcttacacaaatttgaagacatatgtcacatccttcatttgattttctctttggcctaaagatcacatgggtcctcctacatttccttccccattcttctcctctaggtgtttcctagtcctttagagccctccttaaaaatgtggctcttagaagacacctttcagtgctttttaaccagagcaggtagaagaggaccacgatgttcttgatcattacccagtattgccaatgaatactactatgttgctataagtgccatatrtaaaattttttgagcaattgcatcatgctgttgctgggttcatctgagcctttaaatcttcagtaaaacttattagtaatcttttgtttgtttttagggtttggttacatcaacaattatttagtagatttgtctaatcatggattttataaacaagatctttaaccttaaagcaacttataatatttatttttaaaatttcagcttctggtttggattcattatattagcctgtcgagtacgatcctctaaaattttattccataattaaacagttaggtatctttcctagattctggc

SEQ ID NO: 58745 - DNA, 601 bp, Human
cctgctctaccaatcgtatttattccattgaataaatgaggaaatggagatcagagagattgtttcttgcttaagattatctagcccaaaacttttacctgtgaatccccctctagtctaagggtaaagggtaaacattgagtggtaactggtactagaatagatttgttgcttacagcaattctgtgaagtaggtattactcccattttacagatgagtttgcttggagtggcaaagggcctactgaaggtcacgtagataatgaaaaggcattattcagaggtttctgacttggtgccytgtggcagaccgtcttctactcaggtgattcctttctgtctatctataggcatgtagacacaatcattactggtgcaaccagcactgactacgacggcctccagtgatgcctgggttatatatttacctgtaacagtgtataaagcagggattttctgtaatcccagcactttgggaggccgaggcaggcggatcacgaggtcaagagatcgagaccatcctggccaacatggtgaaaccctgtctctactaaaaatacaaaaattagctgggcgtggtggcacgtgcctgtagtcccag

SEQ ID NO: 58746 - DNA, 601 bp, Human
tccagtgatgcctgggttatatatttacctgtaacagtgtataaagcagggattttctgtaatcccagcactttgggaggccgaggcaggcggatcacgaggtcaagagatcgagaccatcctggccaacatggtgaaaccctgtctctactaaaaatacaaaaattagctgggcgtggtggcacgtgcctgtagtcccagctactcagggggctgaggcaggtgaatcgcttgaacccgggaggcggacgttgcagtgagccgagatcgcaccattgcactccagcctggtgacagagcragactccgtctcaaaaaaaaaaaaaaaaaaagcagggatttcaaaagcatcacatttggcaaaacttcagtgttattcccttcctttcagatcaccctcatccttcctacctccatgaaacaagaggaaccctactatgagaaaataggggcaaaattctccaattattggcagtgaagtgtagtagctagaatggtgggcaaaaagcaagaccgacgatggaatcccagcttttgacttactagcagcatgtccttgggcaacttacttaaccactctgtcttccagcatcttcaccta

SEQ ID NO: 58747 - DNA, 601 bp, Human
ttattggcagtgaagtgtagtagctagaatggtgggcaaaaagcaagaccgacgatggaatcccagcttttgacttactagcagcatgtccttgggcaacttacttaaccactctgtcttccagcatcttcacctataaaaattaggataaggatgtcatctaccttatagagttggttgtgacataaaatgagtttatgaaaagcacctggtccatagtaataatagctaacatgattttgcaccagtagaaaatatttgataaatattaaaattgcgttttgttttgtttttttgagasaaggtctcactctgtcacccaggctggagtgcagtggcgcaatcacagctcactgcagcctcaaccttctgggctcaggtaatccttccgcctcagcctctcaagtagccaggactacagacatgcaccaccatgcctggctaatttttttaattttttgtagagatggggtttcgccatgttgcctaggctggtctcaaattcctaggctcaagcaacctgcctgcctcagcctcccaaagtgctgggattacaggcatgacccactgcacccagcctaaaattcgtattatttttatt

SEQ ID NO: 58748 - DNA, 601 bp, Human
gtagaccttaaagaaaattcctaaatgtaaacagaaaatctctaaaactgctttggaaggtcactgacacataaatattacatgtacctataaaatctaaaaggaaaggacacacataagaaagaaacaaagaaaagtcctgaaaacaaacactccaccagagcaaaatcaaaagaatatttggaggcgaggatgaaaaaggaatgaaggatagaagccagtctgccctagccttattcttttttccccttggccaattcaaaagtcagagactctagggttcttatttatccaaatgaaygtgcccttcagggtttaaactctctgcttccatctctcttcacttgctgagccgctaaaattctcctgagtgtttggattgagaagaagaggctcctgtgggagattagaaactgatacccttgagagaggacaatagggagctgccgacagactggctgacgaggcccggcttgggtccccagagaggtaggacagtgcagttggaagtaaaagcttttgatgagccatgagtttccttctgatctgtgggcaaaggaagccagtggaccagagaggcaccttaacgccgaacaatcag

SEQ ID NO: 58749 - DNA, 601 bp, Human
tagaccttaaagaaaattcctaaatgtaaacagaaaatctctaaaactgctttggaaggtcactgacacataaatattacatgtacctataaaatctaaaaggaaaggacacacataagaaagaaacaaagaaaagtcctgaaaacaaacactccaccagagcaaaatcaaaagaatatttggaggcgaggatgaaaaaggaatgaaggatagaagccagtctgccctagccttattcttttttccccttggccaattcaaaagtcagagactctagggttcttatttatccaaatgaacrtgcccttcagggtttaaactctctgcttccatctctcttcacttgctgagccgctaaaattctcctgagtgtttggattgagaagaagaggctcctgtgggagattagaaactgatacccttgagagaggacaatagggagctgccgacagactggctgacgaggcccggcttgggtccccagagaggtaggacagtgcagttggaagtaaaagcttttgatgagccatgagtttccttctgatctgtgggcaaaggaagccagtggaccagagaggcaccttaacgccgaacaatcagg

SEQ ID NO: 58750 - DNA, 601 bp, Human
ttacagttccacatggctggggaggcctcacaatcatggcagaaggcaaggaggaccaagtcacatcttatgtggatggcagcagacaaagagagagcttgtgcggggaaactcccccttatagaaccatcagctctcatgagacttattcactatcacgagaacagcatgggaaagacctgcccccatgattcaataacctcccactgggtccctcccacaccatatgggaattcaagatgagatttgggtggggacactgccaaaccatatcatttgacccctggtccctttcaaatcycatttccttacattttaaaaccaatcatcccctcccaaaagtcccccaaagtctcaactcatttcagcattaactcagaagtccacagtccaaagtctcatccaagacaacgcaagtcccttctgcctatgagcctgtaaaatcaaaagcaagttagttacttcccagatacagtgggggtacaggcattgggtaaatacagccattccaaatgggagaaattggccaaaaaacaaaggggctacaggccccatgcaagtccaaaatccagcagggcagtcaaatcttaaggctccaaaa

SEQ ID NO: 58751 - DNA, 601 bp, Human
cttatgtggatggcagcagacaaagagagagcttgtgcggggaaactcccccttatagaaccatcagctctcatgagacttattcactatcacgagaacagcatgggaaagacctgcccccatgattcaataacctcccactgggtccctcccacaccatatgggaattcaagatgagatttgggtggggacactgccaaaccatatcatttgacccctggtccctttcaaatcccatttccttacattttaaaaccaatcatcccctcccaaaagtcccccaaagtctcaactcatttcrgcattaactcagaagtccacagtccaaagtctcatccaagacaacgcaagtcccttctgcctatgagcctgtaaaatcaaaagcaagttagttacttcccagatacagtgggggtacaggcattgggtaaatacagccattccaaatgggagaaattggccaaaaaacaaaggggctacaggccccatgcaagtccaaaatccagcagggcagtcaaatcttaaggctccaaaatgatctcctttgactccatgtctcacatccaggtgactctgatgcaagcagtgcatcagacacctc

SEQ ID NO: 58752 - DNA, 601 bp, Human
caccgcatatcctatggtaatcacttccttaaagtaagcaggaaataggttagtagtaggctgcttcaccaggagtcatttcaaatgtattgtcacctaaggtataacttcccaaagatggaaagagataaagccactgagtctgccctctttatccatctacagccaccaaggtaattacagtttttaaaaacgctactcatagttcattgctttcatatctaaagttaagagatctaaaagttcccccacatccccacttagcagtcatgactaaggtgaaaaaagccaccagtatcakcctggtctctcttatcagcagtttagaaagtactacaattttcccatctgactcacatctaaatgactcgcatctaaaatgtttttccttaattttccttccgtaaagagttcatttaaactctaatactgttgcttttcaaaaatttctaaagaaagaagcatcttggaacaatgtattaacttctgcatcaacttttatttcatataataattttatataattttttaaaggcagatgtgtgtttactttgagaagtaaaaatgttaacattgaaactgaaagcctgtttcagtttta

SEQ ID NO: 58753 - DNA, 601 bp, Human
atataacattatagacatttacttgccaagatcaaatgtcatgattcaatacttattttcattgtgagctaatgccttcacctgtctgtcttaaggtcaattaataaacaacccacttgcgaagacctagggatatacgttggtatgaagggcagtgcttccaataagatttcccttgaaatctcgttgtgaggacaaaatacatgcataaaaagaacagaaacatcaagttgataataataacaaaaagttaaatagtacttaccatgggccagacataggtctgagtgctttacaaacwttaactcataggtctgagtgctttacaaacattaactcattaaaagtttgcaataacatggtaagtacaattattatcatcccattttatagatgaaggaattgaggcacaaagttaaatgttgtatctggggtcacacagctggtaagtggagaaggcaggattccaactcagactggctatggaggccacttgtgtaaccagccaccacactgctttgtgtatgtggtggcattcacagtaaaggcaaaagagtctagcaaagaaatgaccatagtggtcagggaaggttttgcggga

SEQ ID NO: 58754 - DNA, 601 bp, Human
tatgcctcaatgctacaaactgagaggtattcaattttaactgtttaatttccaaataaatctgaagaccagaatcttctggaaaccagcctgaaacagttagttcataattaaccttgaaattcagatcaacaagcaagaccacttgaaaacccagcactgaacccctaaccccatcccacattgaaaaactgtgatggaaaacagagtagctaaaagcctgcttcataatgtaagataaacctttgtccttgagagtctttatagacgtgacaggggaagaatccaaagacagtgttgyaccctctaactctaaggaaataaacaggcaaatgcatgtaattatatatttacaggatgtcacattgtttgaaatatgaaaaaatcggctgggtgtggtggctcatgcctgtaatcccagcactttgggaggccaaggcgggcggatcacgaggtcacgagattgagaccagcctgaccaacatggtgaaacccctgtctccactaaaaatagaaaaattagctgggcgtggtggcatgcgcctgtaatcccacctactcgggaggctgagacaggagaattgcttgaacctgggaaagc

SEQ ID NO: 58755 - DNA, 601 bp, Human
gagagattctgaaaagagggacattaaccagatatgcctcaatgctacaaactgagaggtattcaattttaactgtttaatttccaaataaatctgaagaccagaatcttctggaaaccagcctgaaacagttagttcataattaaccttgaaattcagatcaacaagcaagaccacttgaaaacccagcactgaacccctaaccccatcccacattgaaaaactgtgatggaaaacagagtagctaaaagcctgcttcataatgtaagataaacctttgtccttgagagtctttatagaygtgacaggggaagaatccaaagacagtgttgcaccctctaactctaaggaaataaacaggcaaatgcatgtaattatatatttacaggatgtcacattgtttgaaatatgaaaaaatcggctgggtgtggtggctcatgcctgtaatcccagcactttgggaggccaaggcgggcggatcacgaggtcacgagattgagaccagcctgaccaacatggtgaaacccctgtctccactaaaaatagaaaaattagctgggcgtggtggcatgcgcctgtaatcccacctactcgggaggct

SEQ ID NO: 58756 - DNA, 601 bp, Human
agggcaggaggaggccttactttggaacagttagaaaaccctggtgaaaagtgcgtaagtaagtaattcacataagcaccctccaaagggagagcacctagggccaaagaaccaacctcagcaacttagccttgggcaaggccagaaaggaggaaagaaatgagggaaagccctacacattctttcttcttcttgcccaataccaatgggctacaaactaattcgctgaccccacactcctactactttcttcctgtctgccaagccaaccttcacttaaacccctaaagtaatttctccrtaacacataccagatcctccaagggcttcccattaatctacagagcaattctgagactctgaaacagagccctgctccatcatctggccggccagccttcctcaccttatcttctatcactctgagcttcttgcttcatgcttgaaacccacaaggctgtcagtgttactgtatcctcccctacccaatgctacttctcaccctcctgccttcactcacactgattcctctataggaatatctttctaccttatcccttgcatggcaaacttcaactttctttagaattcagctcagata

SEQ ID NO: 58757 - DNA, 601 bp, Human
aacaattaatgaatggagcctggttcctaccaccccaggaggagcggcaggactttgacgcagcaccaggagggcaggaggaggccttactttggaacagttagaaaaccctggtgaaaagtgcgtaagtaagtaattcacataagcaccctccaaagggagagcacctagggccaaagaaccaacctcagcaacttagccttgggcaaggccagaaaggaggaaagaaatgagggaaagccctacacattctttcttcttcttgcccaataccaatgggctacaaactaattcgctgacyccacactcctactactttcttcctgtctgccaagccaaccttcacttaaacccctaaagtaatttctccataacacataccagatcctccaagggcttcccattaatctacagagcaattctgagactctgaaacagagccctgctccatcatctggccggccagccttcctcaccttatcttctatcactctgagcttcttgcttcatgcttgaaacccacaaggctgtcagtgttactgtatcctcccctacccaatgctacttctcaccctcctgccttcactcacactgattcctc

SEQ ID NO: 58758 - DNA, 601 bp, Human
aatgttaaaggactgattattagttacaaattctgctgctgtttctactggaatcacataagctttgaacagacttatggcaagaatcagcattttaatttcatgtccatctcccactaaaaagcaagcatggtgagggcatgaaccgtatcttatctctcttcacatccccacctgagacactgcacacaaaatgatgaccaattcatgttcataagtcacatggaagggccataacaattaatgaatggagcctggttcctaccaccccaggaggagcggcaggactttgacgcagcascaggagggcaggaggaggccttactttggaacagttagaaaaccctggtgaaaagtgcgtaagtaagtaattcacataagcaccctccaaagggagagcacctagggccaaagaaccaacctcagcaacttagccttgggcaaggccagaaaggaggaaagaaatgagggaaagccctacacattctttcttcttcttgcccaataccaatgggctacaaactaattcgctgaccccacactcctactactttcttcctgtctgccaagccaaccttcacttaaacccctaaagtaattt

SEQ ID NO: 58759 - DNA, 601 bp, Human
gtatttctgaaattgatgagtttctgcaatattctgttgagccagttacagaagagacaccactcattttctataaggtaggctagaaaccgacaccccaaactggctgaccctaagcccagagttataggaggtccagcgactgtgtccatcctcagactcacaggctctctcctctcatctctttcccagcagctccttggtccctcattaacagcagcccaatgactctgcaacaatgacctttgcttacaaactgagtgaggtttatacctgctgtgctgatggcaagaagcttggygaagagaataaacaatataaaccaaatctcaaggggaaagggagaaaacaaaaaaacaaagccttaaaaaaaactttagaaccactgatttacatctaggtgttctgataattacaaacacacttaaagctgctgtctaaagatggttatttgtacacattgcggcctagtcaaaataacttgacaatattactggatttttcccactaataatctatacacctcagcccattttattctgtgtcaggtttagtcagtaagagcctactacgctcttccccataccataagcctctcccc

SEQ ID NO: 58760 - DNA, 601 bp, Human
caagagttcgacaccagcctgggcaacatatcaagacctccataaataataaaaatgagccaggcatggtggcacatgcctgtagtcatagttacttgggaggctaagactggaggaccttttgagcccaggaggtcacagttatagtgagctatgatggaaccactgcactccagtctaggggacagagcaagaccccatctctaaaaaatattaaaattttaaatttaaaaaaaagtattaccctttaatcctcctaatatctaatgaggtaaatactattttgaccatcttgcagacraagaatctgtggtctcctgagatttagtatgattcaaggttactcatctagtaaaatgcagagctgagaatcaaaccaagacacagctactgagggggtgaatcaatgagaactaaacaaaactttaccccacagaggtgaaaaacaggaaagaaaacaatactgccctcaaacatcactttctgtagtaacagtgagagctacaagaacctgtggcattcagtatgtatttctgaaattgatgagtttctgcaatattctgttgagccagttacagaagagacaccactcattttctat

SEQ ID NO: 58761 - DNA, 601 bp, Human
tcttggccgggcaaagtggctcaggcctataatattctcagcactgtgggaggcccaggcaggcagatcgcttgaagtcaggagttcaagaccagcctggccaacatggtgaaaccccacagccaggcgtggtggtgtgcacctgtaatcccagctattcgggaggctaaggcaggagaatcgcttgaacctgggaggtggaggtagtagtgagccaagatcatgccactgcactcctaggtgacagagaaagactctgtctcaaacaaacaaacaaacaaataaataaataaataaataattttttggctgagtttggtggctcacacctgtaatcccaaaacttcaggaggctaaagcaggaggatcacttgaggtcaagagttcgacaccagcctgggcaacatatcaagacctccataaataataaaaatgagccaggcatggtggcacatgcctgtagtcatagttacttgggaggctaagactggaggaccttttgagcccaggaggtcacagttatagtgagctatgatggaaccactgcactccagtctaggggacagagcaagaccccatctctaaaaaatattaaaatttt

SEQ ID NO: 58762 - DNA, 601 bp, Human
cagactctaaatttattatcttggccgggcaaagtggctcaggcctataatattctcagcactgtgggaggcccaggcaggcagatcgcttgaagtcaggagttcaagaccagcctggccaacatggtgaaaccccacagccaggcgtggtggtgtgcacctgtaatcccagctattcgggaggctaaggcaggagaatcgcttgaacctgggaggtggaggtagtagtgagccaagatcatgccactgcactcctaggtgacagagaaagactctgtctcaaacaaacaaacaaacaaayaaataaataaataaataattttttggctgagtttggtggctcacacctgtaatcccaaaacttcaggaggctaaagcaggaggatcacttgaggtcaagagttcgacaccagcctgggcaacatatcaagacctccataaataataaaaatgagccaggcatggtggcacatgcctgtagtcatagttacttgggaggctaagactggaggaccttttgagcccaggaggtcacagttatagtgagctatgatggaaccactgcactccagtctaggggacagagcaagaccccatctct

SEQ ID NO: 58763 - DNA, 601 bp, Human
tactgagggctaagtgtcaggcatcaggcaaacagactctaaatttattatcttggccgggcaaagtggctcaggcctataatattctcagcactgtgggaggcccaggcaggcagatcgcttgaagtcaggagttcaagaccagcctggccaacatggtgaaaccccacagccaggcgtggtggtgtgcacctgtaatcccagctattcgggaggctaaggcaggagaatcgcttgaacctgggaggtggaggtagtagtgagccaagatcatgccactgcactcctaggtgacagagaragactctgtctcaaacaaacaaacaaacaaataaataaataaataaataattttttggctgagtttggtggctcacacctgtaatcccaaaacttcaggaggctaaagcaggaggatcacttgaggtcaagagttcgacaccagcctgggcaacatatcaagacctccataaataataaaaatgagccaggcatggtggcacatgcctgtagtcatagttacttgggaggctaagactggaggaccttttgagcccaggaggtcacagttatagtgagctatgatggaaccactgcactc

SEQ ID NO: 58764 - DNA, 601 bp, Human
gttggggggagaatgactgccaataatcagctattactgatattttcataagcagccaggcctcaaactaagatgaggtaaacttaaatgacaaaaaacctgggagaatatgaggtaataggcacttgtttcccaaatcggacatctgcagtgagactgacactgacagggccccctccctggcccagcacacccaggcggggactctctccaacgcagacactgagttaagaagctacagataccttggcagctatctagtgctctcctgaacacctcaatccatgcttctcaagcaatrtgaacagttacccttcagaagttatagtctttcttataaaccgagaatatggagttaaactgtaaagggaagttttccttgggaacataggcaaatggcttttggattcagtattattaggacaaataattcaaatatgctatagattttcattcataaagtggcttttgtggactgggctggaaacccagcctttctttatgcatatccacatttgaatgtgcaccaacacttacatatctgaagtgtaacttattttaatcatggaactgtctgtaattctaacacaggtctgattct

SEQ ID NO: 58765 - DNA, 601 bp, Human
agtatgcaaaatgcatattagaataaataataaccaaagtgatttttgtcagtgattaaaatctattaccattaataataaatatacttcttaagtactctgtatgattatcacaaatattttttatttagtaaccaactagcaagaagatatatggcttcacaaagctggcccaacagtgctcccctgcctctccactccaccagttgcctccgtcaataagagaatgatgggaaagaccagggagattatgaagtcactcacttctacgcccatgattaaaattttatgaacctgaaamataggcaggttggggggagaatgactgccaataatcagctattactgatattttcataagcagccaggcctcaaactaagatgaggtaaacttaaatgacaaaaaacctgggagaatatgaggtaataggcacttgtttcccaaatcggacatctgcagtgagactgacactgacagggccccctccctggcccagcacacccaggcggggactctctccaacgcagacactgagttaagaagctacagataccttggcagctatctagtgctctcctgaacacctcaatccatgcttct

SEQ ID NO: 58766 - DNA, 601 bp, Human
gatacctgaggaaaagtaaaaaaacacatcagaaaatcaaggcggatacatttggccatctgtttctaaacccaatatatgcaaagataaggaactctctcatccacaaagaatctgggtcactcatatcctcttagggcaaacagacttccgaccaggttcggtcaggctgttttgatcataatcatcaagaactatgactccccagaaatatgcactgtagctcctggcaaaccaaatttagatcatttaaaaataaaactctgatgatatttctcattacaggtatccgtcacagagycttatcaaatccagcttcaaaaaaacccctatctgagaggttcacagatcctgcctgatgtgcactttgctaatcggaaacactctgggagttggggaaatcttccatctgtttcctacagaaagcacttaaacaattctaacacgctcgtgattatacatcagacatgcaaacaaattcctggcagtagtatgcaaaatgcatattagaataaataataaccaaagtgatttttgtcagtgattaaaatctattaccattaataataaatatacttcttaagtactctgtatgattatc

SEQ ID NO: 58767 - DNA, 601 bp, Human
cctccataaaaaatattacaagttatatttctcaactatgttttctgattttaagtgaaattagacattttatgggcccctaacaagtgtgtgctctaggcactgtgcttaaaggataagttgtccttggacatatgacagtctctggcgaggtgccgaggagacaggtcgccctccattgccaggggaggtggcaggaggggaaaaagcaccaaggaagggaagctggaacagaataattaaatgccaggctacagagcctggaccatgcaaagcaggcagagcaaagaacgaaagccargcacatatgaggcacgctctcctgggagggaagccccatggaagatagaaacggaagcggcagagagaagcagatgcctgtggcatcattcgagcaatgccgtgagctgtgcacggaagcaaaggctgcagctgtcctgctcaccactgaatcccagtgcctggtacctaacagctactgaacacatgcttgatagataaacaaaagatgaataaactcagggagtagcaattaacatggaaaggataaacaaagaagttactttaaaggtaaaaaccaacatttttataatcttcaatg

SEQ ID NO: 58768 - DNA, 601 bp, Human
gccaggccctgagttagggcctgagatgtggagggctctcaggcatgtttctcgtactctgtgagttcctgtctctgggagcaaccggtcaggtccagcagcaactatccagcaacacacaatggggcacgtatcacaagcaggactacactgtgacttccataggccctaaacacttttcccttcctccataaaaaatattacaagttatatttctcaactatgttttctgattttaagtgaaattagacattttatgggcccctaacaagtgtgtgctctaggcactgtgcttaaaggrtaagttgtccttggacatatgacagtctctggcgaggtgccgaggagacaggtcgccctccattgccaggggaggtggcaggaggggaaaaagcaccaaggaagggaagctggaacagaataattaaatgccaggctacagagcctggaccatgcaaagcaggcagagcaaagaacgaaagccaggcacatatgaggcacgctctcctgggagggaagccccatggaagatagaaacggaagcggcagagagaagcagatgcctgtggcatcattcgagcaatgccgtgagctgtgcacg

SEQ ID NO: 58769 - DNA, 601 bp, Human
cagctactcaggaggctgaggcaggagaatcgcttgaacctgggaggccaaagttgcggtgagccaagatcatgccattgtacttcagcctgggcaacaacagcaaaactccgtccccccaagcacccccacaaaaaagagagagagagagagagtgagagagagagagagaaagacatactaaagctaattaatacaaaagacttagtgtttgccatgtgaatatgaatcagatatattatttaaaagatcaacaggtaagctgaaagattagttacctatccaggtgctagtgggcgastatctacaacaaacagaatctaaacaagctgatatactgctagaacgggagtcaatgttaagaagaacgttgagtacccctgaaacaaagaacaagtccactgggggccaaatgcggagactgatctgcttgttactcccaggactgagacagcacctggccccgggtcatccctgccgcatggagtggcttcagaacagtagaaaattgtgaagtttgggattcatcctcaacaaatgttatttttcttttagattaatgtaatataacagaattagagaagaactgtcatttttcaat

SEQ ID NO: 58770 - DNA, 601 bp, Human
cacatcctgctaattttggtatattttgtaaagatagggtttcaccatgttgcccaggctaggctcaaactcctcggctcaagtgatctgcctgcctcagcctcccaaagtgctggggttacaggtgtgagccactgcacccacccacatttactttaatattattaattacagtaataataattgtaacggctataataatttattcaacatttattgtattgccaggctttgtgctaaatgccgtttagtttcttcacaaccttatgagttagacagtaggtacctccatttaacagakgagtaatttttagctgctgataaaggtgaaataactctcctaaggccatataagtcatgaagctaggatctgaaccccgtcgacgtgggtctaaaacccatgctcttaagccactctgctctatttcttcatccaataaatatctcataaagaagctcccataaagcaaaatcaattagtcaatttcacggagccagaggcctaagttcaattcttggcacaaatgcttattagttatgaccttgggcaaatttcttaacttctctgtgcctctttgtattcatccgtaaaatggagata

SEQ ID NO: 58771 - DNA, 601 bp, Human
tctgaaaatcatgtgctgcagaacggaactcagcaattctccctctcatcaccagatccagacttaagagcttctgggacaaacttaccattttcttgttgtcctgcttgttaatgctgaccacagactcctttattacaatgtgagtgatttcagggaagtaagaaaaattgttccactcttcccggatcttgtttttctcctcatccttcttgtgtttattttccagttttttccgcttcagtttatttttttccttttcaacagaaacaacctgataagatacataaaagggacaggrttaagttgctttcttcattttctattggtaaaaggtcagtgctgctgggaaacctatgcagggcctaggtccaaggaagagaaagccagctcttctggacttgcaggattgggggagttggcacctgcagggttaggaccaaagaactgggttgtatcagggaatcctgggctttcatatctggaagagaccttaatgagcacactgtctaaactatataatacgcaatgtgcacggaaactcagaaagggaaatcactgctcactagacatgcatctacattcaggtctcctcacttcc

SEQ ID NO: 58772 - DNA, 601 bp, Human
catccatctgagctcttctacttctcccccttcactttgtttttactatatttttctaataaaattaatgtaagttttttgtttaaaaaaaaggaggggagaataagaaaattaaaaccactcataatgccaccataaataagtagctgttaatatttatttttctaagagcatgtgtatatacatgcatacctattgatattttgaacaaaactggtcccattctataggtaaagttttatatcctgctttttcccctgaccttttttccaggtcattaaaaaattcagcaacctgattktctaatattctgcttctcaggcaaattgtgatttattttcctattctcctattattgtatatttaagttattttcagaattttgacactttaattactactggaatgaatattcttattcataaaccataacctgcctctcacattgtttctggaagatagattcattctctagattcctgaacagagggatatataaatattttcaaggcttttaacaggttaccaaactgttttccaaaaggttatatcagaaagacaagttattctgaatacaagagagtgactgtctgccctaaac

SEQ ID NO: 58773 - DNA, 601 bp, Human
ggggcctaatacccaggatgcagcatataacacggggcctaatatccaggatgcagcatatgacacggggcctaatatccaggatgcagcatatgacagggggcctaatatccaggatgcagcatatgacacggggcctaaaatccaggatgcagcatatgacacggggcctaatatccaggatgcagcatataacacggggcctaatatccaggatgcagcatatgacacggggcctaatatccaggatgcagcatataacacggggcctgatatccaggatgtgctccatcaacagcayttcttcttttctccctccatttcgcatctttccattaacatccatctgagctcttctacttctcccccttcactttgtttttactatatttttctaataaaattaatgtaagttttttgtttaaaaaaaaggaggggagaataagaaaattaaaaccactcataatgccaccataaataagtagctgttaatatttatttttctaagagcatgtgtatatacatgcatacctattgatattttgaacaaaactggtcccattctataggtaaagttttatatcctgctttttcccctgac

SEQ ID NO: 58774 - DNA, 601 bp, Human
tgtgacacggggcctaatatccaggatgcagcatataacagggggcctaatacccaggatgcagcatataacacagggcctaatacccacgatgcagcatataacacggggcctaatacccaggatgcagcatataacacggggcctaatatccaggatgcagcatatgacacggggcctaatatccaggatgcagcatatgacagggggcctaatatccaggatgcagcatatgacacggggcctaaaatccaggatgcagcatatgacacggggcctaatatccaggatgcagcatatracacggggcctaatatccaggatgcagcatatgacacggggcctaatatccaggatgcagcatataacacggggcctgatatccaggatgtgctccatcaacagcatttcttcttttctccctccatttcgcatctttccattaacatccatctgagctcttctacttctcccccttcactttgtttttactatatttttctaataaaattaatgtaagttttttgtttaaaaaaaaggaggggagaataagaaaattaaaaccactcataatgccaccataaataagtagctgttaata

SEQ ID NO: 58775 - DNA, 601 bp, Human
agcaacacaggcaaaatgcacaggcaggaaccagacagagctgggcaagtgcctgccactttctcactgagtgaccctgtgcaagatcccatgcctcttgattagtctcagattcctcatttcaagtagagctgatgctcagtcccctaaggttcttacaaggactaagacagaccaagatacaggcacagcatataacacggggcctaatatccaggatgcagcatgtgacacggggcctaatatccaggatgcagcatataacagggggcctaatacccaggatgcagcatataacacrgggcctaatacccacgatgcagcatataacacggggcctaatacccaggatgcagcatataacacggggcctaatatccaggatgcagcatatgacacggggcctaatatccaggatgcagcatatgacagggggcctaatatccaggatgcagcatatgacacggggcctaaaatccaggatgcagcatatgacacggggcctaatatccaggatgcagcatataacacggggcctaatatccaggatgcagcatatgacacggggcctaatatccaggatgcagcatataacacgggg

SEQ ID NO: 58776 - DNA, 601 bp, Human
aagcaacacaggcaaaatgcacaggcaggaaccagacagagctgggcaagtgcctgccactttctcactgagtgaccctgtgcaagatcccatgcctcttgattagtctcagattcctcatttcaagtagagctgatgctcagtcccctaaggttcttacaaggactaagacagaccaagatacaggcacagcatataacacggggcctaatatccaggatgcagcatgtgacacggggcctaatatccaggatgcagcatataacagggggcctaatacccaggatgcagcatataacasagggcctaatacccacgatgcagcatataacacggggcctaatacccaggatgcagcatataacacggggcctaatatccaggatgcagcatatgacacggggcctaatatccaggatgcagcatatgacagggggcctaatatccaggatgcagcatatgacacggggcctaaaatccaggatgcagcatatgacacggggcctaatatccaggatgcagcatataacacggggcctaatatccaggatgcagcatatgacacggggcctaatatccaggatgcagcatataacacggg

SEQ ID NO: 58777 - DNA, 601 bp, Human
ggcagcatggagcagtggtcaaccctcagctcaggctctagagccagctgctctgggttcaaatcgcagcctctccacctgctagtagggttatgcatatggaatcatcatttttataggtcaaaatggtcaaatattggcaatttcaaatgctttaacctaacagctctgtgaccttggacaggttacttaacctcttcgtgcctcagtttccccttatcatactcacccatagggttgacatgaaaattaaaataggtggtatttgtgaagtgctcagaataggaagtacctgacacayagtaagggctagcgtggtaaagaaaaacaaactaatggaggaatcaagtatttctttcttcctgccctcctcctgctccctccacagcactgtggcttggcatagagtcattggcccatgtggccagggtgagctctgacttagatgatgggtgcaccaacttgtgttggtgctagacttgactgtgtcaaccaggacaggacaggatggggcaggctcataaaatgtgcaccaggcatacaccacgttgaagagccagatcatggacatgtcagcctctccctcactcccttcggggtc

SEQ ID NO: 58778 - DNA, 601 bp, Human
cagcttaagtggctgactctgtagggaggtgcacagtgagaagatttttataacccaatgggaaccccaaagggaaaaccttttcatcaatactaaatataccccttgcatgcatttatttatttatttatttatttatttatttatttatttatttatttatttgagatggagtttcactctgtcgcccaggctggagtgcagtggtgagatctcggctcactgcaacctccgcctcctgggtccaagcgattcttctgcctcagcctcccaagtagctgggattacaggcacctgccaycacacctggctaatttttgtatttttagtagatacggggtttcaccatgttggccaggctggtcttgaactcctgacctcgagtgatctcccaccttggcctcccaaagtgctgggattacagccgtgagccactgtgcccgatcccccttgcatttatataggactttcactgttcaacacattttcccatctattatctcaaactatcagatgactctgtgtgtgtgtgtgtgtgtgtgtgtgtgtgtgtgtgttgggggtgacgcggtgggggaggctgtggcaggcagggagacat

SEQ ID NO: 58779 - DNA, 601 bp, Human
aggtaatgatgggcatctgctgtgagccggaagtagccatctaccagggacacaaaggacaaggcctcctcgtgggaagagagcttcagttcctgttgagagagaagaaattcccatggttacatcatgtctctatcagcttaagtggctgactctgtagggaggtgcacagtgagaagatttttataacccaatgggaaccccaaagggaaaaccttttcatcaatactaaatataccccttgcatgcatttatttatttatttatttatttatttatttatttatttatttatttattagagatggagtttcactctgtcgcccaggctggagtgcagtggtgagatctcggctcactgcaacctccgcctcctgggtccaagcgattcttctgcctcagcctcccaagtagctgggattacaggcacctgccatcacacctggctaatttttgtatttttagtagatacggggtttcaccatgttggccaggctggtcttgaactcctgacctcgagtgatctcccaccttggcctcccaaagtgctgggattacagccgtgagccactgtgcccgatcccccttgcatttatatagg

SEQ ID NO: 58780 - DNA, 601 bp, Human
acagccattctgtatgttgtggacgatcaacgggggggccacgtcggtgcagaggtaatgatgggcatctgctgtgagccggaagtagccatctaccagggacacaaaggacaaggcctcctcgtgggaagagagcttcagttcctgttgagagagaagaaattcccatggttacatcatgtctctatcagcttaagtggctgactctgtagggaggtgcacagtgagaagatttttataacccaatgggaaccccaaagggaaaaccttttcatcaatactaaatataccccttgcatgyatttatttatttatttatttatttatttatttatttatttatttatttatttgagatggagtttcactctgtcgcccaggctggagtgcagtggtgagatctcggctcactgcaacctccgcctcctgggtccaagcgattcttctgcctcagcctcccaagtagctgggattacaggcacctgccatcacacctggctaatttttgtatttttagtagatacggggtttcaccatgttggccaggctggtcttgaactcctgacctcgagtgatctcccaccttggcctcccaaagtgc

SEQ ID NO: 58781 - DNA, 601 bp, Human
gacagccattctgtatgttgtggacgatcaacgggggggccacgtcggtgcagaggtaatgatgggcatctgctgtgagccggaagtagccatctaccagggacacaaaggacaaggcctcctcgtgggaagagagcttcagttcctgttgagagagaagaaattcccatggttacatcatgtctctatcagcttaagtggctgactctgtagggaggtgcacagtgagaagatttttataacccaatgggaaccccaaagggaaaaccttttcatcaatactaaatataccccttgcatkcatttatttatttatttatttatttatttatttatttatttatttatttatttgagatggagtttcactctgtcgcccaggctggagtgcagtggtgagatctcggctcactgcaacctccgcctcctgggtccaagcgattcttctgcctcagcctcccaagtagctgggattacaggcacctgccatcacacctggctaatttttgtatttttagtagatacggggtttcaccatgttggccaggctggtcttgaactcctgacctcgagtgatctcccaccttggcctcccaaagtg

SEQ ID NO: 58782 - DNA, 601 bp, Human
ccaacaagtaccaggcagcatggtcaactggcctgacctaaacaatgatgacatgccccatcactaaaacacgggctctctgcacaccaaaggcaactgataaggttctaggaccaaccagattggaccatgacagccattctgtatgttgtggacgatcaacgggggggccacgtcggtgcagaggtaatgatgggcatctgctgtgagccggaagtagccatctaccagggacacaaaggacaaggcctcctcgtgggaagagagcttcagttcctgttgagagagaagaaattcccayggttacatcatgtctctatcagcttaagtggctgactctgtagggaggtgcacagtgagaagatttttataacccaatgggaaccccaaagggaaaaccttttcatcaatactaaatataccccttgcatgcatttatttatttatttatttatttatttatttatttatttatttatttatttgagatggagtttcactctgtcgcccaggctggagtgcagtggtgagatctcggctcactgcaacctccgcctcctgggtccaagcgattcttctgcctcagcctcccaagtagctg

SEQ ID NO: 58783 - DNA, 601 bp, Human
agcatctgccacgcctcccctccacccctagccagcccagtggaagcacaaacctcatgggggtgggaactggaggccatgttgtttattgttgtatcaccatgggctcacactgagagaatacatcagtgaggactggacagatgttagtaggaacaggcctgtcttacatttctttgtatccccaggaccagtgagtcctggcatgtagagagcagtgaatactgactgaatacatccctgcatgaggtgagtgctgcttgctaagtgctggtgagagagggccgccatggttcgtgtgttttagagagacagggacattgtgtactttctaactgcgccatgcctttgcatgtgctgacctctcatctaggtaccctttccgtgctttaaggcctggcaagccatcattgattctttggtttaatcagatttgaatgccacctactctgagcaggctctttaggcaaggaatgtcagcatcccatcaaacatgaaatatccattcattcaacaaatactcactgagggcctacaatgtgtcagaccctgtgtgtgctaagaaagcagtgagcaatgcagccccagcctttgggaagct

SEQ ID NO: 58784 - DNA, 601 bp, Human
taagcagttttccctcatgggctctttttgtacaaactaaactattttagtggtaaacaatgagggccagaaagacttacataagctgtaaactaggagatgatattcaaaatctcagttacttcatctgtacaatgggataatatcacctacctaatatggctattacaaggcttaaaaaagcacaagtaggtacaacgcttggcacagggtctggtgggccacagtgtgcggtggaagtaatcatttctatgactgctgttttccccgggtgatgtgacattgttagggagtcacggamactcttggtactgcacaggccaattccacttcaggaggaggctgggctgtctcatgcacccctccatcgtaaacacattaaacttcctccaatgactgatgaatagacggcaagcattctgggaaggcaatgaacctgacaggctctgagccacggagccccgaggcccagctgttcagcaagagcctgggcaggtggtggtgttcctgcattgcatcacccaggacacttggcagcgctggttccttctgccgtttcctcctcccactcttgactgagtccagccccaggggttcgcca

SEQ ID NO: 58785 - DNA, 601 bp, Human
cgtgttttggtcgatctgggtctcagcacattactgatgggatacagcctggctctggcacagggagacgaacctcggggcttgggctggcagcagcgttttagcatgaagctgatgttatccgtgcgcaggatctgcttcttgaggtggctcatgaggtctcccaagctggggaagctgcggtccgaaccgtgcagactgtagcggcccttctgcacctcgatctgaaagttcttgaactgcttctgggcaccctgcacctgctattcgggaaatgaccagaaattacatgtttaaaatrgggtcaggcatgggtatgtaagatattaacattaggggaagctgcatgaagagtaattttgcaccatctctgtaacatttctgtaaatctaaaattattcaaaaataaagtttattatcaataaataatccaaccaacaactaactaaataataaaacaaggtccaggagaaggcattgataaaagggagttaatactacagcagacacagtagctatttctacaaaagcgtcacttggtttttcacctgtaagataaagttcatgaaaatccaacctcataggattgttgctacaatta

SEQ ID NO: 58786 - DNA, 601 bp, Human
ggggagggtccactttgtttaagtcagtcagcgtgttttggtcgatctgggtctcagcacattactgatgggatacagcctggctctggcacagggagacgaacctcggggcttgggctggcagcagcgttttagcatgaagctgatgttatccgtgcgcaggatctgcttcttgaggtggctcatgaggtctcccaagctggggaagctgcggtccgaaccgtgcagactgtagcggcccttctgcacctcgatctgaaagttcttgaactgcttctgggcaccctgcacctgctattcrggaaatgaccagaaattacatgtttaaaatggggtcaggcatgggtatgtaagatattaacattaggggaagctgcatgaagagtaattttgcaccatctctgtaacatttctgtaaatctaaaattattcaaaaataaagtttattatcaataaataatccaaccaacaactaactaaataataaaacaaggtccaggagaaggcattgataaaagggagttaatactacagcagacacagtagctatttctacaaaagcgtcacttggtttttcacctgtaagataaagttcatgaaa

SEQ ID NO: 58787 - DNA, 601 bp, Human
catgcctctttctgcagcctaatgagatgctgagaaaggtatatgcctcttctacagaaaatgctcacactcaagggattggatgtgagttgggcacagaagtgtaattaaactcaataaaaaacacctagaaactgtggggagggtccactttgtttaagtcagtcagcgtgttttggtcgatctgggtctcagcacattactgatgggatacagcctggctctggcacagggagacgaacctcggggcttgggctggcagcagcgttttagcatgaagctgatgttatccgtgcgcagratctgcttcttgaggtggctcatgaggtctcccaagctggggaagctgcggtccgaaccgtgcagactgtagcggcccttctgcacctcgatctgaaagttcttgaactgcttctgggcaccctgcacctgctattcgggaaatgaccagaaattacatgtttaaaatggggtcaggcatgggtatgtaagatattaacattaggggaagctgcatgaagagtaattttgcaccatctctgtaacatttctgtaaatctaaaattattcaaaaataaagtttattatcaataaataatcc

SEQ ID NO: 58788 - DNA, 601 bp, Human
ggggttcgttccagtgtgttgctgtgaataaatagggctgttgggctttaaggtttgaacttactctgaggtctcacagccaagtggcagatgtgtttttacctttgcggaaaatcctcaagcatgaaaacaaaggctgcagttattctctgagcctggcaggaacccctatctgatcaagaacacaagtccctcctctttcaccaagttcagtgacaagccccttgctgagaccaaaaactgattcaaacatcaagaacccaggtccctttctatcctggtgctgcttcctctgcccacycctggtggtgtgagggtttatggacacgttcgcttggaagaacaagatgtgtcccagataaagactcctcagagggtcttcctctgacactcatggggcctcagtggcaatcgtgctgctccttctttgaggccttcctccttctaagggaagaacctgacgcatgaagggcagcatcttgaggtgaggagcagcaaaataaaccgttctcaagagctagggcactcaggttaggcctggcactcaagcccctctttgacgctgacctttgatgagacccacttcgctcttctgggcctc

SEQ ID NO: 58789 - DNA, 601 bp, Human
tctgggttattttgaggactaaatgacttaaaacatgaaagatctccaaacaacgcctggcaaactgtaagccctgctcacatgatagcagccgttcttattaattattactactgttctacctactaccgatactactagctacatggccttgagcaagtcacttaccatctcaagtctcaatttcatcacctttgtaatatctacaaaaagctactgtgtagatgaaataaatgaggtaggtacataaactgactgggccacagtaggcacccaccatccagcagctcctgctacctggttcacttgacaggcattattcacgctgactccgtgctgggcactgtcctccccacgagcccatagagtggtgagtgagactcaggtcctgtcttaagagttcacagtcaggtgggaaaggcaacaggaaacacattcagcactgagtttcaggagcctcaactggggttcgttccagtgtgttgctgtgaataaatagggctgttgggctttaaggtttgaacttactctgaggtctcacagccaagtggcagatgtgtttttacctttgcggaaaatcctcaagcatgaaaacaaaggc

SEQ ID NO: 58790 - DNA, 601 bp, Human
tctacctaagtgatcttgggcatgtataattgggataacaacatattctgggttattttgaggactaaatgacttaaaacatgaaagatctccaaacaacgcctggcaaactgtaagccctgctcacatgatagcagccgttcttattaattattactactgttctacctactaccgatactactagctacatggccttgagcaagtcacttaccatctcaagtctcaatttcatcacctttgtaatatctacaaaaagctactgtgtagatgaaataaatgaggtaggtacataaactgmctgggccacagtaggcacccaccatccagcagctcctgctacctggttcacttgacaggcattattcacgctgactccgtgctgggcactgtcctccccacgagcccatagagtggtgagtgagactcaggtcctgtcttaagagttcacagtcaggtgggaaaggcaacaggaaacacattcagcactgagtttcaggagcctcaactggggttcgttccagtgtgttgctgtgaataaatagggctgttgggctttaaggtttgaacttactctgaggtctcacagccaagtggcaga

SEQ ID NO: 58791 - DNA, 601 bp, Human
cttgggaaatgagaggcggatggaaccgaagccatttatggactattctttgcatgggcacttcagggaacatggcaccagggttaacaatgtgaatgggggaagccacagtgcctccatgaaggtgtttcctcactagaaaaatgggggccacagttgtgtccttcataggttaccgtgtggaagaatgggatgacgcaagggaacggctgccttcagtgcccggtatgtagtaaaacgctccctgactggttgccgccgtgattatgactggcattacatcttagtcactgtcatcatycttcctgtatcatcagggttctggagtgggagatgggtagtggagctggacacaggacacaggactagagatgtgggacctgctgagccgtcacgcccactctgaatggcctcctgctttttcactttgctttttatttatcccatgaagagtttcttagttgcattttcaagtgagaaacccagatcagggtctggctatcaaaaccccgtggttaggagagcagaggagctgaagaacccaacacaatattctcatgtctaattttcacgatttccccacttctctaatttgcacatg

SEQ ID NO: 58792 - DNA, 601 bp, Human
caggagaaaaggcatcaagaaggggccccgtggctggtgtccacaggcaagaggccaggcagcagagccacttgggaaatgagaggcggatggaaccgaagccatttatggactattctttgcatgggcacttcagggaacatggcaccagggttaacaatgtgaatgggggaagccacagtgcctccatgaaggtgtttcctcactagaaaaatgggggccacagttgtgtccttcataggttaccgtgtggaagaatgggatgacgcaagggaacggctgccttcagtgcccggtatgkagtaaaacgctccctgactggttgccgccgtgattatgactggcattacatcttagtcactgtcatcatccttcctgtatcatcagggttctggagtgggagatgggtagtggagctggacacaggacacaggactagagatgtgggacctgctgagccgtcacgcccactctgaatggcctcctgctttttcactttgctttttatttatcccatgaagagtttcttagttgcattttcaagtgagaaacccagatcagggtctggctatcaaaaccccgtggttaggagagcagagga

SEQ ID NO: 58793 - DNA, 601 bp, Human
aacaaatgtgggtgccagaaacagggctcagggagaggctccccttgttctcacaacctgggcactctttttccagaggctgctccctccataccattttcctgactccactctgttacctggggaaaatccgattcagaggcaactcaggctcaactcaactcaggagaaaaggcatcaagaaggggccccgtggctggtgtccacaggcaagaggccaggcagcagagccacttgggaaatgagaggcggatggaaccgaagccatttatggactattctttgcatgggcacttcaggsaacatggcaccagggttaacaatgtgaatgggggaagccacagtgcctccatgaaggtgtttcctcactagaaaaatgggggccacagttgtgtccttcataggttaccgtgtggaagaatgggatgacgcaagggaacggctgccttcagtgcccggtatgtagtaaaacgctccctgactggttgccgccgtgattatgactggcattacatcttagtcactgtcatcatccttcctgtatcatcagggttctggagtgggagatgggtagtggagctggacacaggacacaggacta

SEQ ID NO: 58794 - DNA, 601 bp, Human
ctcaattattatttgttaaatgagtgaatgaatgactggcgtctttctaaaggatgagagctatggaaggaagaagcagtacccgggcccagggcatgatgggaaccagaggaggaggtgaacaaacgctggttttgagccagaagatcagggcaggagacccataacagtgccctgtctgaagctcgtggtaccagcagtgcctgacatggagaggcgcttaccaaatgccccctcaatatgcaggtttaagtagactatcccccagattctactgattcaaacagcaaacccaacacaytacaaaatcctcgaggccaggaaatctacaatccatagaaatcacctttcccgctatggagctactgcaaggaacgaggttatcataaggcaagaaaggaccttccagattctgactagcagggaaagtattctgggaatctctgaagacttgtatgttttcatcaattttattaactgaagcaggaatattagcaaaatgacaacgaacatgcatttcccttcacttcctctttcctgcactagaagacaataacaagttaggggagaaaatgtagccattccagtcctgattcctgga

SEQ ID NO: 58795 - DNA, 601 bp, Human
gcgggcgcttgctgcttcagtcattcgacaagtgcttattcaataggcatatggctcctaccctccaggagctcagagggtaacgacagagccaaaactcccaaataaacaattaaatggaaagctacaatttgttcagctcctctaaagaacaggtgtgtggtgctccaaggttggcatggcaagatctgttctggtaagaaaggtcagaaacagtttccctaatgaaattaaaatttaaaatgtaagactggaaactgaaagaagtcagagactgtctatcttattttcttctccaccyccacagcccggtacatagtaggcactcaattattatttgttaaatgagtgaatgaatgactggcgtctttctaaaggatgagagctatggaaggaagaagcagtacccgggcccagggcatgatgggaaccagaggaggaggtgaacaaacgctggttttgagccagaagatcagggcaggagacccataacagtgccctgtctgaagctcgtggtaccagcagtgcctgacatggagaggcgcttaccaaatgccccctcaatatgcaggtttaagtagactatcccccagattctact

SEQ ID NO: 58796 - DNA, 601 bp, Human
cggcggcagaacagaaagtgggctttccctgggcctcacaccaccagcaacagctccagggcagcccctggggagatcctgggctccccgctcagcctgtagattctgggcaaaaaggcctccaaagactgggatctgtttctcaagatagttctccttcaggcccagagtgtgcatgtcctcttgttccctccctgtgttctctcctcctgagctctgctccttctggaagcatcatcagaaagtgcaggactgaactctggaggtgctccatcacacagcctgctgcaggcagcgaggkgtgatggccatgctcccctgtggagagccacctcctgccctgccaccccttcagctcaccacagaaggtccctgctgttctaggtaaccccacaaagcctgaccaaaccacttacctcaaaacatgtctctgaggagcatcagcaagggtgaagaggatggaggcaatggttgtacggcttttgccatcaaaggaaagtctccctgttctttttctactaagatttccccaaacacagccttccttcccccagatccccaagctgctccatcgtggggaggcaggaccacagctggccca

SEQ ID NO: 58797 - DNA, 601 bp, Human
cctttggtgaagaaatgtaccacgagggaagtgaggcagtttagctgtggatttccactccctcaagccccatccaacaatctcggggactcactgaaaaaggtaaagtaacaaacccccgagtgccactctccccaggctccttcacagcaggcagcttccgcctcaccctccaacacctccaaggcgctgccatctcccgaggtggtgagtggccccgtgcttgcttctctccaaggctgccgcaccatctccctgataccccaacgcgtggccctatgcaacagggctggggagcggyggcagaacagaaagtgggctttccctgggcctcacaccaccagcaacagctccagggcagcccctggggagatcctgggctccccgctcagcctgtagattctgggcaaaaaggcctccaaagactgggatctgtttctcaagatagttctccttcaggcccagagtgtgcatgtcctcttgttccctccctgtgttctctcctcctgagctctgctccttctggaagcatcatcagaaagtgcaggactgaactctggaggtgctccatcacacagcctgctgcaggcagcgaggtgtg

SEQ ID NO: 58798 - DNA, 601 bp, Human
gagtagctgggactacagctgcttaccactacacgcagctcattttttcatttgtatttttagtagagatgggatctcattgtgttgcccaggctggtcttgaactcctaggctcaagcgatcctcccgccttggcctctcaaagcgctgggacgacaggtgtgagccactgtgtgagccgctgtgcctggtctgggactctgctttgataccgcttcccccaggaagctatctccgtcctctcaagattaggtccacatcctgctgtacttccctactttggaacttgactcttgctaaygtgattaccccctcaaaatagacaggagcctgctgaagcagcaatcgtgcctcgcacgtgtaatgcttgatctctgttggctaagtggatgtggaaggcatggaggatggtggttacctgcttggaggctcgaggcaagggaaaagaggcaggccccacagactatgtcaagttctacacagaaaagaggctatgaaactgtggctctggtgactgtaatctcaggacacagctctcacaccacgagaggaatagagaacaatgatgggcctttggtgaagaaatgtaccacgagggaag

SEQ ID NO: 58799 - DNA, 601 bp, Human
ctagccataccatgatctatttctgaggacccttccagttcaagttgcaataattctgcttttaaaattcttaatatttggaaatcgaaatgggattcacgaaacttaggcaatgtcaagttgttgacattagcaccacaaaacttgtaaactgaagatccattattctattatttgaggaccccctggaaatgcagaaaagggactgtcgctgatacctagggaatcagtcttatcccccataggaacatacaccattgttaatcaggtatattaatttgcacaaatgccaccatttgtyatctgtcagagccgaatggcgatgcatccaccctgtctgctgtatcctggcaaggtctttggctattcattaaagctgcatctgtcatgaagtgatccatcaaggttatgggaagctgtattcccagaacatcccgtaaaagccatatgctttcagaataattgctcttcccgtggccaagtcatgacaccatgctgtcaggattctgcagggacccacaaaggcccatatggcccacttcatcctcctctgatgctgttccctccaccttgcctagctacttgagttcatcctccagga

SEQ ID NO: 58800 - DNA, 601 bp, Human
tgatgtgtcctggatttcctgacatgtgaaagggaacaatacccccagatgagtggcaggaggactgaatgagatgatccgtgcaaagccctagccataccatgatctatttctgaggacccttccagttcaagttgcaataattctgcttttaaaattcttaatatttggaaatcgaaatgggattcacgaaacttaggcaatgtcaagttgttgacattagcaccacaaaacttgtaaactgaagatccattattctattatttgaggaccccctggaaatgcagaaaagggactgtcrctgatacctagggaatcagtcttatcccccataggaacatacaccattgttaatcaggtatattaatttgcacaaatgccaccatttgttatctgtcagagccgaatggcgatgcatccaccctgtctgctgtatcctggcaaggtctttggctattcattaaagctgcatctgtcatgaagtgatccatcaaggttatgggaagctgtattcccagaacatcccgtaaaagccatatgctttcagaataattgctcttcccgtggccaagtcatgacaccatgctgtcaggattctgca

SEQ ID NO: 58801 - DNA, 601 bp, Human
gcaaatcccagctctactacccgctggccatgtgacatgggggcaatctctgcccactttctgcaaatggaggtaataatggtactgacctcatagggctgtggtaagaatcaaaccaggaaacagggatggaggctcctggtacagactcaggcacacgggggggtgcgtagaaacccatctggtggatccatgtgttatctgaagccctctggcacaggtaggcacagtttctcacactggaaccatctgtttcccatccatttatccagtgtgtgtgctcatgtgtgtgcatgcacgytaggatttaaaattagtggtgcaaagtacacctgcatttgccctggcaacctcacagaggagatggcaatgtgaagatgaaggtggagcctggggtgatgtgtcctggatttcctgacatgtgaaagggaacaatacccccagatgagtggcaggaggactgaatgagatgatccgtgcaaagccctagccataccatgatctatttctgaggacccttccagttcaagttgcaataattctgcttttaaaattcttaatatttggaaatcgaaatgggattcacgaaacttaggcaatg

SEQ ID NO: 58802 - DNA, 601 bp, Human
atgtcaggacactgcaaacagggccatcaacagccagccacatgggtcccaccccaggcctccagagaagactcaagagaggagcccccaggcagctcctctactcacaggctgtgctaccctgtgaagaggcttgcaaatcccagctctactacccgctggccatgtgacatgggggcaatctctgcccactttctgcaaatggaggtaataatggtactgacctcatagggctgtggtaagaatcaaaccaggaaacagggatggaggctcctggtacagactcaggcacacggggggrtgcgtagaaacccatctggtggatccatgtgttatctgaagccctctggcacaggtaggcacagtttctcacactggaaccatctgtttcccatccatttatccagtgtgtgtgctcatgtgtgtgcatgcacgttaggatttaaaattagtggtgcaaagtacacctgcatttgccctggcaacctcacagaggagatggcaatgtgaagatgaaggtggagcctggggtgatgtgtcctggatttcctgacatgtgaaagggaacaatacccccagatgagtggcaggaggactgaat

SEQ ID NO: 58803 - DNA, 601 bp, Human
ggtgacctctctgtgccctgaagtgatggaccgtctgggaatgggtcctcaatgggaacatggactatcaatgggatggggcaaaggcaagagggctccctgccccagctcgtggtccccaggcctccagagaaaacaacaagctatttggccaaacacagtggtgacatttgctgggccccaggagacagtcctcctactccctaaacggctccttgctttctacccctaggaacagcctttggccaaaacacagtcctaacatgtcaggacactgcaaacagggccatcaacagccagmcacatgggtcccaccccaggcctccagagaagactcaagagaggagcccccaggcagctcctctactcacaggctgtgctaccctgtgaagaggcttgcaaatcccagctctactacccgctggccatgtgacatgggggcaatctctgcccactttctgcaaatggaggtaataatggtactgacctcatagggctgtggtaagaatcaaaccaggaaacagggatggaggctcctggtacagactcaggcacacgggggggtgcgtagaaacccatctggtggatccatgtgttatct

SEQ ID NO: 58804 - DNA, 601 bp, Human
actgggccacaagaagggcaagggttcttctcaacccattgtgttccactggctccagaaacgggagaggggaggggaggagttcagaggaagacacttgccagggaaatatccctgtggctggggtctaagactttgaggatcacttttatcttcttctcttcagaagttccttcgtcatccttgtaatccatcagggtcccagaatagatgtgtgttctcgtgcctctcccaaggtgctcgccctgagggaagaagcagaaggctgggtgacctctctgtgccctgaagtgatggaccrtctgggaatgggtcctcaatgggaacatggactatcaatgggatggggcaaaggcaagagggctccctgccccagctcgtggtccccaggcctccagagaaaacaacaagctatttggccaaacacagtggtgacatttgctgggccccaggagacagtcctcctactccctaaacggctccttgctttctacccctaggaacagcctttggccaaaacacagtcctaacatgtcaggacactgcaaacagggccatcaacagccagccacatgggtcccaccccaggcctccagagaag

SEQ ID NO: 58805 - DNA, 601 bp, Human
gatactcatgcccacctctctctcttcctttcagctctgggaaatacccatatttagcactatgctggaacaaaggggaaatgaaggcagccgatctctgctcaagatttgactgtgtcactctaatagtctgtagaatcctgggtgagtccttttactcctctgggctttcgttttccagactgtgtggtgagagccatggactgtatcaggaactttgaaccatttggccagagtcctagggctccacagcacggccacctggacctgtccttaggaaaggtgggggttgggggtggargggagggcacaggctgagtgtgaggagctgttcaacccacctcacttactctacatgcagggtccactaagatcatatgtggagaaaaaaattctgagtaaaaggcaagtttgaaaaccactgggccacaagaagggcaagggttcttctcaacccattgtgttccactggctccagaaacgggagaggggaggggaggagttcagaggaagacacttgccagggaaatatccctgtggctggggtctaagactttgaggatcacttttatcttcttctcttcagaagttccttcgtcat

SEQ ID NO: 58806 - DNA, 601 bp, Human
aaagctcaccactgtcgccaccccaggccctgaacatcaatcctctggccttggctgtccagaggcactgccaagccttgttctctgggccaacctggcagggatgtgaggtttatttagaaaacctaacaggatgcagagcagggctggtgggagaagctggctaagaattttcccactggatactcatgcccacctctctctcttcctttcagctctgggaaatacccatatttagcactatgctggaacaaaggggaaatgaaggcagccgatctctgctcaagatttgactgtgtcrctctaatagtctgtagaatcctgggtgagtccttttactcctctgggctttcgttttccagactgtgtggtgagagccatggactgtatcaggaactttgaaccatttggccagagtcctagggctccacagcacggccacctggacctgtccttaggaaaggtgggggttgggggtggaagggagggcacaggctgagtgtgaggagctgttcaacccacctcacttactctacatgcagggtccactaagatcatatgtggagaaaaaaattctgagtaaaaggcaagtttgaaaacc

SEQ ID NO: 58807 - DNA, 601 bp, Human
caagctccccagccaggccacccacccctttgaaagagaacacacttactctccacgtcgcggacacagacgccatagaggtacacgatgtgtttgtgggagacctgtctcatcatgctggctgcctcgaagaaggcctgtgggcgagcaggacataggaatgtctcaggccagcctccagggggctgctccccaggggctctgttgaggggaaagccagtggacccaggaaagctcaccactgtcgccaccccaggccctgaacatcaatcctctggccttggctgtccagaggcactgycaagccttgttctctgggccaacctggcagggatgtgaggtttatttagaaaacctaacaggatgcagagcagggctggtgggagaagctggctaagaattttcccactggatactcatgcccacctctctctcttcctttcagctctgggaaatacccatatttagcactatgctggaacaaaggggaaatgaaggcagccgatctctgctcaagatttgactgtgtcactctaatagtctgtagaatcctgggtgagtccttttactcctctgggctttcgttttccagactgtgtgg

SEQ ID NO: 58808 - DNA, 601 bp, Human
aaaaatcgctcttcttccaaacttacatgtcaggaactcagaggccaaggccacccctccatctcagtgtgcagcagcagcccaagggcccaccggctcagtggcttgacaaccaagaaagggccaagcctgcctgtggttaaaatggaagccagtccattcgaggagccagcgtcttgctgcttgtggggtgcgctcacctcgctcacctgcccagagctccttgggcctgactcttgtggccttgacctcatttcactcacctcagcctcccaggtctagcacagtgtagggttcttggccagcgttgacaagaaaacattacacaaatgaatgaaaagcaattggttttagttccacctccactattaacttaagcaaatgacctgctcagtccctcaatctcctcaactgcaaaaagaaaggcaagaagcctgggcaacgtgagggtgggaagagcctccaccatctccacagcacccaagctccccagccaggccacccacccctttgaaagagaacacacttactctccacgtcgcggacacagacgccatagaggtacacgatgtgtttgtgggagacctgtctcatcatgctg

SEQ ID NO: 58809 - DNA, 601 bp, Human
ccccttacgacagtccacttcagtggacactactcggcctcagagtacacagatatccttggggggtgcaatggtgcaggggcttcagagctggaaaggccaagttcaaccccaagctcttcttctaaacggtggcactgagcaagtgacacttctctgagcctcaattccctcatctgtaataacagatggcggctaaatgtcacaaggcctggaaagccttggcggagggcctgacacagagaacaagggctctgggaacaaccgccaccactgctgctgttctacaacacactgtgaygcagaggtcaggccgctcacacggcaaaacttccctctcaacaggactcctgtgtgagtacacggaacagctcacattgttggattccacagggaagaagtcacttggggttaaaaaaaaaatcgctcttcttccaaacttacatgtcaggaactcagaggccaaggccacccctccatctcagtgtgcagcagcagcccaagggcccaccggctcagtggcttgacaaccaagaaagggccaagcctgcctgtggttaaaatggaagccagtccattcgaggagccagcgtcttgctgc

SEQ ID NO: 58810 - DNA, 601 bp, Human
cctctgacgtgctaacatttcccactaaacagaactcatgtgagcacagggaacggccccaaacgaccatcttcagtaagcaccaggcacacctttgttcaaccacagagccctggccccatggaacccaaggacaggcccctctagctgcttggctagcacctccttcctgccacccctcccaggacactctggtttctggtgggaccattatggacatcaggacattctcaccaagtagctcagggcactggccagctgtttggcaactttgaatttccatggtgtggtaaggacatcrcttttccggtgcatgaagagatccagaggacccccttccacaaactcttccaccatgatatctgtaggcataaaaatagccatgtctggaacctggtctgtggcacggtcctctccttcatccccttacgacagtccacttcagtggacactactcggcctcagagtacacagatatccttggggggtgcaatggtgcaggggcttcagagctggaaaggccaagttcaaccccaagctcttcttctaaacggtggcactgagcaagtgacacttctctgagcctcaattccctcatctg

SEQ ID NO: 58811 - DNA, 601 bp, Human
tgctccttcccgcattctatttccaaccctggtccctcaggtcatctcttcctacccccagctacagccagatctggacagcctggccctgctgccaatcatctgtgtgacttaggcacatcacaggtgccccttggctccagctccctcatcactgaatgtggctaaatagtggcacgtatctcattgggcttcgtgagcatgatactgattagaatctgtgaaacgcctgaacagctgacccatggtgagcactccacacgtcagctactagatgctggcagttcactcattcactcaacacgtactgcactgctttcagccttgccatccatatgctgcagtatgcaagtcggccctctgacgtgctaacatttcccactaaacagaactcatgtgagcacagggaacggccccaaacgaccatcttcagtaagcaccaggcacacctttgttcaaccacagagccctggccccatggaacccaaggacaggcccctctagctgcttggctagcacctccttcctgccacccctcccaggacactctggtttctggtgggaccattatggacatcaggacattctcaccaagtagctc

SEQ ID NO: 58812 - DNA, 601 bp, Human
cgcctgttttgcattctagctgaggaacccaggtaagtggggctacctgagtctcagttacctgatctgtcaaatgagggtaatgacaccatcctacctaatttgcagggctcttagggtgacactttcaggtattctttctggaattcttaccgttgttattttagcctaactccctaccataccctaaggccctcaagggaaggcaaggcctgtatcttattttatagtgaacctccagcttttcccaagcttgatgcttgatacacaataggaactccatatgtatttgtgtggtaatgctgaataacaggcacttaaaatctcagataaataatactataacatctatcgagcttgtactgcatgcctgtcactctatatgcattatttaatcttcacaacaaccctacaagtagttactgattatccccattttatagatgatgaaactgaggctcacggaagttcagttacatttgtgaggtcacacacccagtaggcccgtgaagagattcaaacccatgcccatctcttcccacagtgccaggcttccgacaactcctgggaagcccacgagcacctgaaagccctcacttgc

SEQ ID NO: 58813 - DNA, 601 bp, Human
gaggaggtccacacctcgcctgttttgcattctagctgaggaacccaggtaagtggggctacctgagtctcagttacctgatctgtcaaatgagggtaatgacaccatcctacctaatttgcagggctcttagggtgacactttcaggtattctttctggaattcttaccgttgttattttagcctaactccctaccataccctaaggccctcaagggaaggcaaggcctgtatcttattttatagtgaacctccagcttttcccaagcttgatgcttgatacacaataggaactccataygtatttgtgtggtaatgctgaataacaggcacttaaaatctcagataaataatactataacatctatcgagcttgtactgcatgcctgtcactctatatgcattatttaatcttcacaacaaccctacaagtagttactgattatccccattttatagatgatgaaactgaggctcacggaagttcagttacatttgtgaggtcacacacccagtaggcccgtgaagagattcaaacccatgcccatctcttcccacagtgccaggcttccgacaactcctgggaagcccacgagcacct

SEQ ID NO: 58814 - DNA, 601 bp, Human
ccactttttccacaggtagatttggaggaggtccacacctcgcctgttttgcattctagctgaggaacccaggtaagtggggctacctgagtctcagttacctgatctgtcaaatgagggtaatgacaccatcctacctaatttgcagggctcttagggtgacactttcaggtattctttctggaattcttaccgttgttattttagcctaactccctaccataccctaaggccctcaagggaaggcaaggcctgtatcttattttatagtgaacctccagcttttcccaagcttgatgcytgatacacaataggaactccatatgtatttgtgtggtaatgctgaataacaggcacttaaaatctcagataaataatactataacatctatcgagcttgtactgcatgcctgtcactctatatgcattatttaatcttcacaacaaccctacaagtagttactgattatccccattttatagatgatgaaactgaggctcacggaagttcagttacatttgtgaggtcacacacccagtaggcccgtgaagagattcaaacccatgcccatctcttcccacagtgccaggcttccgacaa

SEQ ID NO: 58815 - DNA, 601 bp, Human
actggaaatttgaaaacttaaatgccaaatataaaattagtcaagtaaattaaacaaaacaattaactcttacattaaatttgtaaaaattatgatttaatctcacaggaaagcattctcagtattaaatgaaaaaactcagaattttatataactctatctagcatggccccaattttgtttaaaaaagagagatacaaacaggctggaagacaaaatgccaaagtgttaacagtggtcagggatgacaagaatgcagtgattgctattttctttttttaatagtttcattttaaaaatkttcttcaactgtttattactttaaattttagaaacaagaacttatgctacttttggaagatgaagtgaaaccactgcattccagtttctacttcatagctggactccaagggtactaagttcctctctggtccccgtgggccctggggtggggtggggtgggcaggccccagaggacagggaggagggaggactggaattaaggagctgagaattgctcttgtccttgagtgtcactcacacatccctgcgtcagtgcagcctgcagaaaagccatctaacccaaggggacttaggtgga

SEQ ID NO: 58816 - DNA, 601 bp, Human
tacaaggatgtttcctgcagaattagacagaacactggaaatttgaaaacttaaatgccaaatataaaattagtcaagtaaattaaacaaaacaattaactcttacattaaatttgtaaaaattatgatttaatctcacaggaaagcattctcagtattaaatgaaaaaactcagaattttatataactctatctagcatggccccaattttgtttaaaaaagagagatacaaacaggctggaagacaaaatgccaaagtgttaacagtggtcagggatgacaagaatgcagtgattgctrttttctttttttaatagtttcattttaaaaatgttcttcaactgtttattactttaaattttagaaacaagaacttatgctacttttggaagatgaagtgaaaccactgcattccagtttctacttcatagctggactccaagggtactaagttcctctctggtccccgtgggccctggggtggggtggggtgggcaggccccagaggacagggaggagggaggactggaattaaggagctgagaattgctcttgtccttgagtgtcactcacacatccctgcgtcagtgcagcctgcag

SEQ ID NO: 58817 - DNA, 601 bp, Human
caggttccagccaagccacctgacagcgacagtggtggccaagtccccaaatcggagctggctcctgatgcactcgctgcatacagaaactggcctcggggacggtggggggaactaaggatgccatgcttctgacaatgcctggcacagtggctggcacacagcagatcctggagatgtatcaagtctgtttcattaaccagactacagaaaatctgtataaagacacaaatctcagtagcttctctagtcacaattaactgtttggaaactcccatttaaggtccaaagaaacgctgayactctattttgggattctgtgcaataaacctatccctgctctaaagagccttacagggctgggtatggtggcttatgcctataatcccagcactttgggaggcctccttgcttgaggccaggagtctgagagcagcctagtcaacatagcaagaccccatttctacaataaaaaataaaaaatattagccagcatgggggcgtgtgcctgtagttccagctactcaggaggctgaggcaggaagattgcttgagcctgggaagttgaggctgcagtgagctatgatcacaccactcactc

SEQ ID NO: 58818 - DNA, 601 bp, Human
aggggttctcgctgtctggccttgcaggcagaagcctctcacctggactgtacttgctcactacagccccctcgctctcttggcctcacaaactgtcccctcagttactgagccaagacaaagtagcaggtgacgatgaaccaactcatcaatcccaatttctatgaccacaggaaatgaaggttatttctgggcctgcaggacaactgccgttctctaaaagccctgggctcacgttacaggacaggccccacagcatggctgaaaagagcaaatgcatgaggagtctttagaagacgtragatcaggttccagccaagccacctgacagcgacagtggtggccaagtccccaaatcggagctggctcctgatgcactcgctgcatacagaaactggcctcggggacggtggggggaactaaggatgccatgcttctgacaatgcctggcacagtggctggcacacagcagatcctggagatgtatcaagtctgtttcattaaccagactacagaaaatctgtataaagacacaaatctcagtagcttctctagtcacaattaactgtttggaaactcccatttaaggtccaaagaaacg

SEQ ID NO: 58819 - DNA, 601 bp, Human
cccgtctctactaaaaatacaaaaaaattagccgggcgtgatggcgggcgcctgtagtcccagctactcgggaggctgaggcaggagaatggcgtgaacccgggaggcggagcttgcagtgagccgagattgcgccactgcactcccgcctgggccacagagcgagactccgtctcaaaaaaaaaaaaaaaaaaaaaaaaattatcatcagctgtcaatttcactaccatgagtagatgctggcttgcaaataagatacaattattagtaaatattacttgccactttgatttagacaacyagaaaatgaaataccctggctagtattggatcagaacaggaagtgggtggaggtagagtaggaatcagtttcataaggcataagtgcaagtgacgtggagagacagtgctggaaccagcccctggatggaggggcctgggtggcctcctggagccctgcagctgctgagggatttgacatatgacttggaagccttgagagtgtgtgggaaccaccagctagcatgtcagacgcccaggtaaggccacggagtgcctgttttgcactggcctttatgaccctagacagtcaccaaatctt

SEQ ID NO: 58820 - DNA, 601 bp, Human
gcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattgcgccactgcactcccgcctgggccacagagcgagactccgtctcaaaaaaaaaaaaaaaaaaaaaaaaattatcatcagctgtcaatttcactaccatgagtagatgctggcttgcaaataagatacaattattagtaaatattacttgccactttgatttagacaactagaaaatgaaataccctggctagtattggatcagaacaggaagtgggtggaggtagagtaggaatcagtttcataaggcataagtgcaagtgacgtggagagacagtgctggaaccagcccctggatggaggggcctgggtggcctcctggagccctgcagctgctgagggatttgacatatgacttggaagccttgaga

SEQ ID NO: 58821 - DNA, 601 bp, Human
ctcacaggcataagcactcactgagataacagtcagagtgctctgtaaaccacaggcaaatgactgttttcaaaaattatcgggccgggcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagyttgcagtgagccgagattgcgccactgcactcccgcctgggccacagagcgagactccgtctcaaaaaaaaaaaaaaaaaaaaaaaaattatcatcagctgtcaatttcactaccatgagtagatgctggcttgcaaataagatacaattattagtaaatattacttgccactttgatttagacaactagaaaatgaaataccctggctagtattggatcagaacaggaagtgggtggaggtagagtaggaatcagtttcataaggcataagtgcaagtgacgtggagagacagtgctgg

SEQ ID NO: 58822 - DNA, 601 bp, Human
ggtgtacctacctcacaggcataagcactcactgagataacagtcagagtgctctgtaaaccacaggcaaatgactgttttcaaaaattatcgggccgggcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccrggaggcggagcttgcagtgagccgagattgcgccactgcactcccgcctgggccacagagcgagactccgtctcaaaaaaaaaaaaaaaaaaaaaaaaattatcatcagctgtcaatttcactaccatgagtagatgctggcttgcaaataagatacaattattagtaaatattacttgccactttgatttagacaactagaaaatgaaataccctggctagtattggatcagaacaggaagtgggtggaggtagagtaggaatcagtttcataaggcataagtgcaagtgacgtggaga

SEQ ID NO: 58823 - DNA, 601 bp, Human
tttagctgctgtttgaggtttattttgttcttattctttggaagatattccttaaggcttcccgaaggcagaaattccatgatgagcttaataccatttcctcctgtttagaaaaaacatccatcagtctgaggctgccaaatgagggaaccatgggagaggcaagggcacaggatatgagacagaggccctgaggtgacgccagcttcgccccttcattacaggcatgttacttgacctcttatgcctcaagatcctcagcagtgaatggagatggtaacaatggtgtacctacctcacmggcataagcactcactgagataacagtcagagtgctctgtaaaccacaggcaaatgactgttttcaaaaattatcgggccgggcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgca

SEQ ID NO: 58824 - DNA, 601 bp, Human
gtggttagatttctttcattccttggaagacggtgtcatatgaagctcagtcatttatataggctgctttcaatgaaacaggctgaaaggtgtgtttcttgaagataaatatcaatcaattccaaatgttctaaaccttctctaaccttgagtcaggccagaggaatgagacacattaatatagccagaaagggcctattaaaacagtgtaaactctatgaagcattgataaaacctagtggtttgattcagttaccaaaacacagggctgtcccggtcatccttgacggtgtaatactcyttatcggtttcaattgctttggttaaaccgaagtctccaattttcacttggtgttcactctcaacaaggacatttcttgctgccaagtcccggtgaacgtattgccgagaacccaaatagtccatcccctgagagagagaagtaaaagtcaagcacattgctaaagtcactttagattgtattatctatcacttcatcagaaaaaatagaaatgtcatttcattcacatatcactgacaatttttttggttctgacttttatgcaagaatattaagaacaaactgattcaaataaataca

SEQ ID NO: 58825 - DNA, 601 bp, Human
ttatgtggttacgtggcagggtgcggtagagatgtaagcagcctctcccctggacagtgttcctggctgagacatggttgtagccagtgtgtggccttctaacctgggaacctctggtgattcatgagacagccaggtctcccgtaggttttgctctgctctgtccaggagttccctgaatctgcaatgcccactctgtcctacagcctccctctgcaggaatgtgtttaagaaaggaactagattctctccacctgctcacagttttaagaactgcatcagatgaatgccctctcctggraagctaggaatgttgagctggtggttagatttctttcattccttggaagacggtgtcatatgaagctcagtcatttatataggctgctttcaatgaaacaggctgaaaggtgtgtttcttgaagataaatatcaatcaattccaaatgttctaaaccttctctaaccttgagtcaggccagaggaatgagacacattaatatagccagaaagggcctattaaaacagtgtaaactctatgaagcattgataaaacctagtggtttgattcagttaccaaaacacagggctgtcccggtca

SEQ ID NO: 58826 - DNA, 601 bp, Human
cagaaaaccaagcccgaacccttctgtatgtttcctgctccatgccgttggctgcctagcctgttaaactctaaactcggcctacttgttcaccatatctccagtactggcacaaagcaggaccttgatgcattttcttaaatgaatgaatgagtaagtttaggctccataagtgggagaggtctatgtttgtgtccatgtaggatgcacctaggggagtgctgattggttatgtcgttatgtggttacgtggcagggtgcggtagagatgtaagcagcctctcccctggacagtgttccyggctgagacatggttgtagccagtgtgtggccttctaacctgggaacctctggtgattcatgagacagccaggtctcccgtaggttttgctctgctctgtccaggagttccctgaatctgcaatgcccactctgtcctacagcctccctctgcaggaatgtgtttaagaaaggaactagattctctccacctgctcacagttttaagaactgcatcagatgaatgccctctcctggaaagctaggaatgttgagctggtggttagatttctttcattccttggaagacggtgtcatatga

SEQ ID NO: 58827 - DNA, 601 bp, Human
ggctccagactccctggctccagactccctggctccaatcttgttcccttcattcagtggtggtctttttaaaacaaagtctccctccttaaactctccagcagcatcccattgttcttgagatgaagtcccagctccatgactcaagcttcctcctgcaaacctcctattccatgatctgacctcactgaggttcagttcctgggaaatcgactgctcttgtctcattcttcctagtcacgcatgctgtctagcaaccgtctgtctaaacccgcatgaatctttcaggtttcttctgaayactcacgacttccagaaaaccaagcccgaacccttctgtatgtttcctgctccatgccgttggctgcctagcctgttaaactctaaactcggcctacttgttcaccatatctccagtactggcacaaagcaggaccttgatgcattttcttaaatgaatgaatgagtaagtttaggctccataagtgggagaggtctatgtttgtgtccatgtaggatgcacctaggggagtgctgattggttatgtcgttatgtggttacgtggcagggtgcggtagagatgtaagcagcctctcccct

SEQ ID NO: 58828 - DNA, 601 bp, Human
ctgtgctcttcatttcactgagaacatgctctcagggtatgggaggaggtggccgtgtaatgatgagccccaggtctgatttgcctgcaggctctaaatgagacagcagtggcctcactgcacaatgtggcatcgctgtccaatcctcttccagcattgcctactttgctgaatgacacccacttgcccaagccaaaaatgaaggcattccaccgcacccaatctccttatatactccttgaacctactcacttctctcaaaccctactgtcactctcccagtccctgtcctaattcatgctgtcactagctctggcctgagctgttgaagcagccaaatcagactccctggctccagactccctggctccagactccctggctccaatcttgttcccttcattcagtggtggtctttttaaaacaaagtctccctccttaaactctccagcagcatcccattgttcttgagatgaagtcccagctccatgactcaagcttcctcctgcaaacctcctattccatgatctgacctcactgaggttcagttcctgggaaatcgactgctcttgtctcattcttcctagtcacgcatgctgtc

SEQ ID NO: 58829 - DNA, 601 bp, Human
tctgccctaaaataacacgccaagtctgtgctcttcatttcactgagaacatgctctcagggtatgggaggaggtggccgtgtaatgatgagccccaggtctgatttgcctgcaggctctaaatgagacagcagtggcctcactgcacaatgtggcatcgctgtccaatcctcttccagcattgcctactttgctgaatgacacccacttgcccaagccaaaaatgaaggcattccaccgcacccaatctccttatatactccttgaacctactcacttctctcaaaccctactgtcactmtcccagtccctgtcctaattcatgctgtcactagctctggcctgagctgttgaagcagccaaatcagactccctggctccagactccctggctccagactccctggctccaatcttgttcccttcattcagtggtggtctttttaaaacaaagtctccctccttaaactctccagcagcatcccattgttcttgagatgaagtcccagctccatgactcaagcttcctcctgcaaacctcctattccatgatctgacctcactgaggttcagttcctgggaaatcgactgctcttgtctc

SEQ ID NO: 58830 - DNA, 601 bp, Human
taaccagtgtcttagactctaccaaccactccttgtgcttgtgctggtcaaggagtctgttcccaagaaaatgatctgatttaggaatgaaggaggcacagacaaggctggtccctacccagtgctaccccacttaacttgctcattttcccataaaactgcccttcatctctacacagataagatccttgagagtcaaggtcatcctatagaactccgggctcgttgtgaaagcaagacttgagagattcacaaataactgtcaagtagcaaaccaagttaatgggaaagtgacattttmcattataatacattcattggattccatttaaaaacaaaagttaaccaagcagagggatggacacattttaaatgggtactggattcaaatgaagagaaaagtaggacttacagccatgggactagaatctgaatcacagtaagtcagcagctcatgcagagtgactccaaaagaccagacgtcagaggcaatataaaatttagattgcattaaacattctggagcataccttgaaaggaagcagaacacaaaacttcatttcctgggaggcacactccatccgacattacaggataactg

SEQ ID NO: 58831 - DNA, 601 bp, Human
tccttagtaactttaaataaaaatccaaaatccttattagctttcaatgatctgtctctaaccagtgtcttagactctaccaaccactccttgtgcttgtgctggtcaaggagtctgttcccaagaaaatgatctgatttaggaatgaaggaggcacagacaaggctggtccctacccagtgctaccccacttaacttgctcattttcccataaaactgcccttcatctctacacagataagatccttgagagtcaaggtcatcctatagaactccgggctcgttgtgaaagcaagacttkagagattcacaaataactgtcaagtagcaaaccaagttaatgggaaagtgacattttacattataatacattcattggattccatttaaaaacaaaagttaaccaagcagagggatggacacattttaaatgggtactggattcaaatgaagagaaaagtaggacttacagccatgggactagaatctgaatcacagtaagtcagcagctcatgcagagtgactccaaaagaccagacgtcagaggcaatataaaatttagattgcattaaacattctggagcataccttgaaaggaagc

SEQ ID NO: 58832 - DNA, 601 bp, Human
ctatataaaataaaatcaaacaaaacgtttaactttgcaagtatttacataaatgccaaacagattaaggtgaaatttctacaatcaactggaaatttaagtagcaataaaaaggcttttctccttagtaactttaaataaaaatccaaaatccttattagctttcaatgatctgtctctaaccagtgtcttagactctaccaaccactccttgtgcttgtgctggtcaaggagtctgttcccaagaaaatgatctgatttaggaatgaaggaggcacagacaaggctggtccctacccartgctaccccacttaacttgctcattttcccataaaactgcccttcatctctacacagataagatccttgagagtcaaggtcatcctatagaactccgggctcgttgtgaaagcaagacttgagagattcacaaataactgtcaagtagcaaaccaagttaatgggaaagtgacattttacattataatacattcattggattccatttaaaaacaaaagttaaccaagcagagggatggacacattttaaatgggtactggattcaaatgaagagaaaagtaggacttacagccatggga

SEQ ID NO: 58833 - DNA, 601 bp, Human
tttgaatagtttaaaacacagaaaatgggatacaactctagttcataaataatattttaacatttgagaagctcaagggttgactggctgcaataaaatccaggtcattcctgtaaaccagttagagggtgaagcagaatctcagttcagacttgaactttccagactggctgcctcactctctgactcatactgttcagtgtgtcttacacagtctcaagagtttagtattaaaggctcaattcacttagaaaactgaattataaatgctaataagtgggataaacttacacacaaaaaatgcaattatatgtatttgtcacactaaggctacaccaaaacctgtccctctggggcaagcaagtggataaagaggggctggcttttggagggaatccttgctctgaacctaactggtggctatcatctagccccaaaggcgatttctcagttatcttatgtgaaattcagcttcagaaaactattttacaaggacttcactgcatcatttcctcgctctcccctctacccattgctggacaactcaagctgcgaaaacataatagaaatggagtgttattactgtgacgtggcccataga

SEQ ID NO: 58834 - DNA, 601 bp, Human
tcctcataagttgataaacctgtaaaaagaaagaagtaacaacagtaaaaatgttagatctgggaactttaaaaaataacagaaatatcaagagtaagaaaataattttggaaatgcaatgacttttccttaaagactagaaaaacaagagtatttgaatagtttaaaacacagaaaatgggatacaactctagttcataaataatattttaacatttgagaagctcaagggttgactggctgcaataaaatccaggtcattcctgtaaaccagttagagggtgaagcagaatctcagttmagacttgaactttccagactggctgcctcactctctgactcatactgttcagtgtgtcttacacagtctcaagagtttagtattaaaggctcaattcacttagaaaactgaattataaatgctaataagtgggataaacttacacacaaaaaatgcaattatatgtatttgtcacactaaggctacaccaaaacctgtccctctggggcaagcaagtggataaagaggggctggcttttggagggaatccttgctctgaacctaactggtggctatcatctagccccaaaggcgatttct

SEQ ID NO: 58835 - DNA, 601 bp, Human
gttagtagtaaggaccgtaacccaccccttcctccccccaaaactatactgttatttttctatgtaagcaaattgtttgaaatgctttgaaaatgaaatcttaatattaaaaggcatatgcatgtaaagtctttagtatatttatttgtataaagagtaaacaaagtgcatatagagtggccacaggtttgacacagagaccttggtgatgtaggctatgaacaaatttaaatggcaacttcattgctgccactgaaccaatcctgaatttgggctcaacaggtgaaaagtaacaatatcmaacgaatactaaacagcataacaaaaagattttcagactcttggtcataaagaccgtaatcgttcacattgaatcaatgactaaacatttttgattacccagctacctccaagcaaactgaaaactgtctagtggatcctgaagtccatagtgcctctagccgggtctttcaagtgttgcaccacagggtgatgattgatggtaaaaacagggatcaacccttgtagatcggtggtaagtatggaaaccctctaagaacagtgcagcgtatgtggtattcagactggttgcatacagcat

SEQ ID NO: 58836 - DNA, 601 bp, Human
aacaaaggtgtctggactacagcacagtggacatgccatccatactggcctgtgccccgttatcaatcactgggcacaacagtgaagaagtgcaaatcaagtggtgtttgtttgtttgttagtagtaaggaccgtaacccaccccttcctccccccaaaactatactgttatttttctatgtaagcaaattgtttgaaatgctttgaaaatgaaatcttaatattaaaaggcatatgcatgtaaagtctttagtatatttatttgtataaagagtaaacaaagtgcatatagagtggccayaggtttgacacagagaccttggtgatgtaggctatgaacaaatttaaatggcaacttcattgctgccactgaaccaatcctgaatttgggctcaacaggtgaaaagtaacaatatcaaacgaatactaaacagcataacaaaaagattttcagactcttggtcataaagaccgtaatcgttcacattgaatcaatgactaaacatttttgattacccagctacctccaagcaaactgaaaactgtctagtggatcctgaagtccatagtgcctctagccgggtctttcaagtgttgcacc

SEQ ID NO: 58837 - DNA, 601 bp, Human
gggtgatggcaccattgatgctattgtagatggccaagtctagctcctcaaggcgggccaggaggcgatactcatgctcctttaaggagtgatacagctgctcaaactcccaaacaatcttctccctctccatctgggttaggctctatgcagacgacagggaaaggcagtaaagagaaaaacggctcatttctagggccttcatagttctcctgtgaccatgtagcccaagacctcattatggattaaaacaagcacagtgctaactcattatttccagtctttactgactggatatatratgcccaggaactgaattaccccagtgattattaagacatagtccctgttctcaagcaactcagagaagtgagtcaggttcatatgatatacatagtcatggatgggtaattaaagatagggtgacagcctgcaatgaaagaaactggtaccatcttcacagaagcaatttcacacaatgttcatgtgatgaacaagaattcaccacataggcaatgagcgggaagcctttccaggcagaagaaatggcacaggcaaaagagtggggagagaaagcaaatggtgctatctggctggagca

SEQ ID NO: 58838 - DNA, 601 bp, Human
ttaggttacgtatattttacaattaaaaaaatgaagaaggctggaaggctggatgtggtggctcacacctgtaatcctagcactttgggaggctgaggcggatggattgcttgagcccaggagttcaagaccagccgaggcaacatggcaaaactccatctctacaaaaattacacaaattagccaagcatggtggtttacgcctgtagtcccagctacttgggaggctgaggtgggaggatcatctgagcctgggaggtcaaggctgcggtgagccatgatcatgtcactgcactccggmctgggtttcagagtgagaccctgtctcaaacaacaacaataaaaactaaggaaaaaaaaacactcaagtccatcttgcaaaaccccaatcctggatgagactgaccatctgcttactcagtgcccacgccagagcagtcaagatttgagaaagcaaagctgataagaaagttacacgacaggggctgggcacggtggctcgcacctgtaatcccagcactttgggaggccgaggcagaaggatcacctgaggtcaggagttcaggaccagcctggccaacatggtgaaactccgtctcta

SEQ ID NO: 58839 - DNA, 601 bp, Human
atttaggttacgtatattttacaattaaaaaaatgaagaaggctggaaggctggatgtggtggctcacacctgtaatcctagcactttgggaggctgaggcggatggattgcttgagcccaggagttcaagaccagccgaggcaacatggcaaaactccatctctacaaaaattacacaaattagccaagcatggtggtttacgcctgtagtcccagctacttgggaggctgaggtgggaggatcatctgagcctgggaggtcaaggctgcggtgagccatgatcatgtcactgcactccggcctgggtttcagagtgagaccctgtctcaaacaacaacaataaaaactaaggaaaaaaaaacactcaagtccatcttgcaaaaccccaatcctggatgagactgaccatctgcttactcagtgcccacgccagagcagtcaagatttgagaaagcaaagctgataagaaagttacacgacaggggctgggcacggtggctcgcacctgtaatcccagcactttgggaggccgaggcagaaggatcacctgaggtcaggagttcaggaccagcctggccaacatggtgaaactccgtctc

SEQ ID NO: 58840 - DNA, 601 bp, Human
attttatttaactgaactggttagaacctttaatgcagtgttaaatagagataaatgatactgggcatccggcctgtttctgacctcaatgggaatgcctccagtattgccccattaagtaatatttatcctgcttttccagtgacttccaacataaacactttttgatattcatggagcccctcctcccttactgagtccatgacttctttctttctctcctttcctcatcatccaccttcagtttcatgctccatctgtttaaaaaaatattcttaaaaaaaaaaaaaaaaaaaaaaaagaagctttagaccaggcgcagtagctcacgtctattataccagcactttgggaggccaaggtaggcggatcacctgaggtcaggagttgaagaccagcctggccaacatggtgaaaccccatctctaccaaaaatacaaaaattagctaggtgtggtggtgtgtgcctgtaatcccagctactcgggaggctgaggcaggagactcactcaggaggtggaagctgcagtgagctgagattgtgccactgcactccagcctgggcaacagagtgagactttgtctaaaaaaaatttaaaaa

SEQ ID NO: 58841 - DNA, 601 bp, Human
tatatactgaaaaccactccgtatcagttcataggtatcattcttttcctttttttaacttggatagtattccatagtgtatatgtgcataattaactaaaacaatcttgtaggtttctaagtcagactatttccagtattttgcaattataaaaatgttgcagcaggttatcttgtgcatatgtattttcaaatatattttaatagttatatcttcaaagtaaattcttagatttttaaaattttttattgatacgtaacagacatatatattttgggggtgcatgcgataatttaacaygttcataatttgtaaagaaatcagtgtattgggatatccatcacatcgttaaatatttgccttttctttatgcaagaagcattgcaattattctcctctagtcactttggactataaaataggccaggcgcagtggctcacgcctgtaatcccagcactttgggaggtccaggcgggcggatcacctgaggtcgggagtttgggaccagactggccaacatggagaaaccccgtctctactaaaaatacaaaattagccgggcatggtggcgtatgcctgtaatcccagctactcgggag

SEQ ID NO: 58842 - DNA, 601 bp, Human
ttcaaatacacggaaaagctgttagtacaaagaactccagtatactttttttttttttttttttgagacggagtctcgctctgtgtagcccaggctggagtgcaatggcgcgatcttggctcactgcaacctctgccacccgggttcgagcaattctcctgcctcagcctcctgagtagctgggactacgggtgtctgccatcacgcccagctaatttttgtgtttttagcacagacagcattttgccatgttggccaggatggtcttgaactcctgacctcaggtgatccacccacctcrgcctctcaaagtgctgggattacaagtgtgagccagcggtggcctctcccttctttcatacacaaaaagtagcatactcttgtcaggcgcggtggctcacgcctgggcaacaagagtgaaactctgtctcaggaaaaaaaaaaaaagtagcatactctctatttcacatttttattttccacaaagcaatatatactgaaaaccactccgtatcagttcataggtatcattcttttcctttttttaacttggatagtattccatagtgtatatgtgcataattaactaaaacaatcttgt

SEQ ID NO: 58843 - DNA, 601 bp, Human
gccccatctataaggacctccccaatctccttaaatgctcccacatagtcaagctgcattttgctttagaaggttttcaccattcaggatcttaatcaccttcacagtacagcttcctcaaagtcagtttccacccctgaaggcattcttacaccaaacatgagcttcccaaggcccatcccacttgcctcgtcatccatcctgcaaaacaactttgccctggcttactgccccctccaagctctccctctttgatcgtgttccagctgccagggagttcttcctcactttttttttttttgatggaacatagagaaatagcaagagtaagaataagagccagaatccaggtggctcatcagtaattatgtaaatgcaggccagtcacacctttcttaggctttatttcccccattacagaaaaaaaaaaaatgagataatgaagggggaaaggattctgaaatgtataggaagcaatagacataaactacccttatattcagcccaggtccctgtaaggccacaccctctccatggaagtgtcctcatacccctaatccaccggcagcctcccacatgaaccccctacttcctgaatttt

SEQ ID NO: 58844 - DNA, 601 bp, Human
tatttatggtgggcaattaacccgaattctcaggttcccaaatatggaaagaatgacatgttcagatagaaaggcactgtgggggacattacccaattccctagccctgcaaggatgtctatagcaaagactgccagttgcctatccaataccccttctgccatcttctgccttttatggctcacagctgcccagtccctcatagctagatgtgaccttgtgactaagttctggcctatgagaagtaagacgtatctcatggtgttttgagaaatctacttaaaaatgtaacatgaccggraacagtggctcatgcctgcaatcccaacacttttggaggccaaggtgggataattactttgaggctaggagttcaagaccagcctgggcaacatggtaagaccctgcctctacaaaaaagaaaaatgaaaaaaaaaaaaaaaaaaaaacgaagaaaaaaaggtaatgtgatgcgacttatctccttcttcttggttggcattctaccagctattgtggactatatgaggaccataccttagggatggtagaacagtgaatgggaagaaacctgagtctctgaggatcactggagttacca

SEQ ID NO: 58845 - DNA, 601 bp, Human
tgatatttatggtgggcaattaacccgaattctcaggttcccaaatatggaaagaatgacatgttcagatagaaaggcactgtgggggacattacccaattccctagccctgcaaggatgtctatagcaaagactgccagttgcctatccaataccccttctgccatcttctgccttttatggctcacagctgcccagtccctcatagctagatgtgaccttgtgactaagttctggcctatgagaagtaagacgtatctcatggtgttttgagaaatctacttaaaaatgtaacatgacmgggaacagtggctcatgcctgcaatcccaacacttttggaggccaaggtgggataattactttgaggctaggagttcaagaccagcctgggcaacatggtaagaccctgcctctacaaaaaagaaaaatgaaaaaaaaaaaaaaaaaaaaacgaagaaaaaaaggtaatgtgatgcgacttatctccttcttcttggttggcattctaccagctattgtggactatatgaggaccataccttagggatggtagaacagtgaatgggaagaaacctgagtctctgaggatcactggagtta

SEQ ID NO: 58846 - DNA, 601 bp, Human
ccatctcggcccaccgcaacctctgcctcccaggttcaagcgattctcctgcctcagcctcctgagtagctgggattacaggcatgcgccaccatacccagctaattttgtgtttttagtagagatggggtttctccatactggtcaggctggtctcgaactcctgacctcaggtgatcctcccgcctcggcctcccaaagtgctgggattacaggcgtgagccaccacgtccggcccaagtaaattctttttcccaattccatgaccttccaggaactaggacaggggctaagttaaacygtctagcgtacacggacagtctttaaaatcagccactacagcttttcccaccttctcttcctgagctatgatcctctagaccaaaataggatactgtactcattctcataccccccaaagcacctagctcacagcttttcaaatactaagtactcaaaaaggtttactgaattacatatgaggctgactttgccagaaagcactagattccatgacagtccttgatatttatggtgggcaattaacccgaattctcaggttcccaaatatggaaagaatgacatgttcagatagaaaggc

SEQ ID NO: 58847 - DNA, 601 bp, Human
atgagtaaattttttttttttttgagatggagtttcgcttgttgcccaggctggagtgcaatggcgccatctcggcccaccgcaacctctgcctcccaggttcaagcgattctcctgcctcagcctcctgagtagctgggattacaggcatgcgccaccatacccagctaattttgtgtttttagtagagatggggtttctccatactggtcaggctggtctcgaactcctgacctcaggtgatcctcccgcctcggcctcccaaagtgctgggattacaggcgtgagccaccacgtccggcccaagtaaattctttttcccaattccatgaccttccaggaactaggacaggggctaagttaaactgtctagcgtacacggacagtctttaaaatcagccactacagcttttcccaccttctcttcctgagctatgatcctctagaccaaaataggatactgtactcattctcataccccccaaagcacctagctcacagcttttcaaatactaagtactcaaaaaggtttactgaattacatatgaggctgactttgccagaaagcactagattccatgacagtccttgatatttatgg

SEQ ID NO: 58848 - DNA, 601 bp, Human
aggaggtaagaactattactgttctgttacagatgaggaaattacttgttgaatccttactaagtggtagaggcaggcccagaacccaggcagcctgactcctgactgcccgctcctaaccatgtccctggcggtgctgcctgtcagtgctgctggattcctccagcccgagctggcacctgtgcccacaagcagtaggaactcagtaaattacaatgataaacactggctcaagtgaaacgtatccaaggtagtttttgttcattctttccgaagtaaacaatcaaattaattctggattaatttttggattgcttatttttctcctccatcaatgcagactgcgaattgactaaatacagttaacaaacttcaaattagaacaagaagctgttaattgagaaaattaattaagaccaaagggaagatgtaaaatatcagggaaggctggccaatgggtatcacccttatcccacgtttcccactttcagtgcagatgttcttttttccaagcaactttacatcaaaagcccagtaggtagataaatttaccttggattttctccatatctgactgcattttttctaagaaaagaaaaca

SEQ ID NO: 58849 - DNA, 601 bp, Human
attatccactgtattgagtggagtttctccccatttgtcttgcttgtagaggacatgtatctgctagctctatgttgctagatgccccaaaaagtatatatctgaatagatgcaatgcatatatgaacccagcatatacaaaatagaaaattatcaaagattgtgggggtttgtaatttctaataattaagagaagggtttacctacatataaggatttcagaatccaccagactgcccaggaattttagtattcctgggtggaataatatatggccaactctttactgaatgtggctcgkgagcagaaaaattttaatttggaaaagcttctccaaatgcctagaacgatttaataaacataaatataggacttattatgtgtcaggttctattctagaagtgttagaaatggtaactaaccttaattcttatacctcaggaggtaagaactattactgttctgttacagatgaggaaattacttgttgaatccttactaagtggtagaggcaggcccagaacccaggcagcctgactcctgactgcccgctcctaaccatgtccctggcggtgctgcctgtcagtgctgctggattcct

SEQ ID NO: 58850 - DNA, 601 bp, Human
atcatccaaccaaaagctttaaggggagagggattgggaatcttaagtacagggataaccacatgcctgagactggtagaatatgggataaaactgagccaagatcaagaattccaccttccagtgagtcagctgattctgcagagggaaacgcggttccaaccccacgtcatacataacttttgagttgcataagtcatctgtgtacaagagctgaatggctcaagtgacactcactgacactctggggtaaacatgaccattcatttataaggcactttatagttgaaacagaatttctcacacattatcccactaagacttttaagtggcaagaaaagaagagccagatcaaggaaagtcatgcctgaactaaccacttctggtattatccactgtattgagtggagtttctccccatttgtcttgcttgtagaggacatgtatctgctagctctatgttgctagatgccccaaaaagtatatatctgaatagatgcaatgcatatatgaacccagcatatacaaaatagaaaattatcaaagattgtgggggtttgtaatttctaataattaagagaagggtttacctacatataag

SEQ ID NO: 58851 - DNA, 601 bp, Human
tatcatccaaccaaaagctttaaggggagagggattgggaatcttaagtacagggataaccacatgcctgagactggtagaatatgggataaaactgagccaagatcaagaattccaccttccagtgagtcagctgattctgcagagggaaacgcggttccaaccccacgtcatacataacttttgagttgcataagtcatctgtgtacaagagctgaatggctcaagtgacactcactgacactctggggtaaacatgaccattcatttataaggcactttatagttgaaacagaatttytcacacattatcccactaagacttttaagtggcaagaaaagaagagccagatcaaggaaagtcatgcctgaactaaccacttctggtattatccactgtattgagtggagtttctccccatttgtcttgcttgtagaggacatgtatctgctagctctatgttgctagatgccccaaaaagtatatatctgaatagatgcaatgcatatatgaacccagcatatacaaaatagaaaattatcaaagattgtgggggtttgtaatttctaataattaagagaagggtttacctacatataa

SEQ ID NO: 58852 - DNA, 601 bp, Human
ctatcatccaaccaaaagctttaaggggagagggattgggaatcttaagtacagggataaccacatgcctgagactggtagaatatgggataaaactgagccaagatcaagaattccaccttccagtgagtcagctgattctgcagagggaaacgcggttccaaccccacgtcatacataacttttgagttgcataagtcatctgtgtacaagagctgaatggctcaagtgacactcactgacactctggggtaaacatgaccattcatttataaggcactttatagttgaaacagaatttctcacacattatcccactaagacttttaagtggcaagaaaagaagagccagatcaaggaaagtcatgcctgaactaaccacttctggtattatccactgtattgagtggagtttctccccatttgtcttgcttgtagaggacatgtatctgctagctctatgttgctagatgccccaaaaagtatatatctgaatagatgcaatgcatatatgaacccagcatatacaaaatagaaaattatcaaagattgtgggggtttgtaatttctaataattaagagaagggtttacctacatata

SEQ ID NO: 58853 - DNA, 601 bp, Human
tcgaggccacccactcccagacccagggaacctgccccgaggtgaggggatcccgcggcgctgggggaccccgcctcagctaggcgggccagctgtcccttgcggggtccctgactgggccgcctccaccctagagcataagggtccacaacgccacctgcctctccgacgccgactgcgtggctggggagctggacatgctgggaaacggtcggtgtgcgccagctggggctgggcgggtggggcagggctgcgtccccgctaatgcctcagtgacctctgcctcccaggcctgaggacygggcgctgtgtgccctattaccaggggccctccaagacctgcgaggtgttcggctggtgcccggtggaagatggggcctctgtcaggtgcacctgcgccccggcctggggcccagcctcccctctgatccttttcctctgaccagaggccaaacgggcggggcaggagtgacaagagctggggaggggtgggggccaatgccaggcgggggctttgcgggaagaggggactaaacaacccttctgtgcctcctcagccaatttctgggtacgatggccccaaatttcaccatcctcatca

SEQ ID NO: 58854 - DNA, 601 bp, Human
ataagggtccacaacgccacctgcctctccgacgccgactgcgtggctggggagctggacatgctgggaaacggtcggtgtgcgccagctggggctgggcgggtggggcagggctgcgtccccgctaatgcctcagtgacctctgcctcccaggcctgaggaccgggcgctgtgtgccctattaccaggggccctccaagacctgcgaggtgttcggctggtgcccggtggaagatggggcctctgtcaggtgcacctgcgccccggcctggggcccagcctcccctctgatccttttccyctgaccagaggccaaacgggcggggcaggagtgacaagagctggggaggggtgggggccaatgccaggcgggggctttgcgggaagaggggactaaacaacccttctgtgcctcctcagccaatttctgggtacgatggccccaaatttcaccatcctcatcaagaacagcatccactaccccaaattccacttctccaagtaagagccgcggggtgtggtgacggcccagcctgagggctgccttctgggaatggggtatttggggtgcaggtctcgcctcctaccgcctcctcagggg

SEQ ID NO: 58855 - DNA, 601 bp, Human
ctgtacttgggacaccgctgtccacactggcatagctgtggtggggtcccgagaggcccaatgcctgtggggcagccctggagtgcagaggacgagtgggcactggcgttcccattgcaggtttgccaaatactacaagatcaatggcaccaccacccgcacgctcatcaaggcctacgggatccgcattgacgtcattgtgcatggacaggtgcctgcacctgctgggggtgggtggccagccctgctagcctgggtctgagctcctcacgccccacccctcccttaagccccatcagaygccgtcagacattctgaccacgacccccattctccccaggccggggaagttcagcctgattcccaccattattaatctggccacagctctgacttccgtcggggtggtaaggaaccctctctggggtcccagcgggtgcggggggtccaccaggcccttacacaccggtctctgctggccccagggctccttcctgtgcgactggatcttgctaacattcatgaacaaaaacaaggtctacagccataagaaatttgacaaggtgtgtacgccgagccacccctcaggtagctggcctgt

SEQ ID NO: 58856 - DNA, 601 bp, Human; identical to SEQ ID NO: 58853

SEQ ID NO: 58857 - DNA, 601 bp, Human; identical to SEQ ID NO: 58854

SEQ ID NO: 58858 - DNA, 601 bp, Human; identical to SEQ ID NO: 58855

SEQ ID NO: 58859 - DNA, 601 bp, Human
ttatgaatgctaaagttctgccatacttttcttggataagtaaatgctcaatattaaatcttgtagcaaactgactttgcaattatattaatattaccttgaattaatagtatttcattctacaaaccttttaaagaatacttgataatgtaaccatgtgggatattttagtaacaatggtagggttaatgatctgggtttaacagatcaggaaacagactcagaaagtaccactgctgaaggcttttcttctgtcttcatttctcccaagaactccagatacgaatatttgtttgtctgyttgacatgtctgttcacttgatcgtttaatagtcatttcgtactgcatgtgaaagtagagctctgggttttctcctcaccttgccattttgcatctactacagtcttcagctcagtgaatggtcatatgaaaaaatctgttattcatctttaattcctttttttactttactcccagaaccaacgctttagcaagtttatttttttatttttattttgtttgagacggagtcttgctctgttgccaggctggagtgcagtggcacgatcttggctcactgcaacctgtgcctcccaggtt

SEQ ID NO: 58860 - DNA, 601 bp, Human
ggtgcgcaccaccacgcccagctaatttttgtatttttcgtagagatgaggtttcaccatgttggccaggatggtctccatctcttgaccttgtgatcagcccgcctcaccctcccaaagtgctgggattacaggcatgagccatcacgcctggcctagcaagtttatttttattatttttatattttactctactctcaaaaaatattcccttctacctcttctctcgtctaagctactaccgctatctttggaacaccttatctttgcttctgttgttctctctacagcttattttccrcataaagccagaatgatgtttttaaaaatatagatgataccactccccctgcttaaatttctcattgcatttagaataaaatacagagtcctttttccatcctggaagacacaacataatctggccctcagctacctcactaacacagtttactcttctttctgctgcttacagtgcttgggacacagtgaccttatttctgtttcttgactgtgctagccttatttctaccctaagatctttgtgccaaatgtcaagaagacttttccttcatatcttaaatggctagctccttgtcat

SEQ ID NO: 58861 - DNA, 601 bp, Human
aatggctagctccttgtcatttaggtttgactcagcctaaatataactgcccagaaggccttccctgatgatgtagtctgtagtagttcattgctttactcttttattttcatcttagtgccttttctgatttactgctgtacctctagcacctagattcatgtctgatgtgaaactgaaggacttaatgaatgagtatacctttgtattccgtatagtaacataatagatactcattaactgcttggtgaatgccgaatgatttgtttgaagtcttttagtttgttaatggcagagttaycgttacaaatttaaatgttcgaactccagtgctggttctactgccccatattaatctttttcaaaaatgagttttgtagtctgggtgaaaagtgttctgacttcacctgggacctgtatccattactcttcaatagctgaaatcgaaggtatatagctttatcttagctactgttgctgctctgacaagtttccctttcctctcttgaaagcaaggtctttgttgggatataacaggttcctgatgtttcagccatttagaggggaagaaactgtatggtcattactgccaaagatacaa

SEQ ID NO: 58862 - DNA, 601 bp, Human
gctttctgtatctcttgtggggatcactgtcaaagtaaagatgccatcagatagcgaacacctttatataaggtggaacatcaggaaaggatgtttaatgaaaaggaaaagtgaacacatccataatagtttcatagggcatcactgaaattaagttattcatgcagctggtatctaagttatgagtgactaaattgcaagccaagccatagatacatgactggtatatactaaagttaccctacatagatggcagacttggcttagtgagaaccactactgaaagaaaaaaaaaaaaaaagaatcaaatgattctaaccctgccacctgaaaaggaaaggaagaaaggagaatatctctatattaggttttatgctgggagctctttacataaattaccttgtttaatcttgacaacccagtgaaggttatatcaatgtcattttcttttttttttttttttggtttgagacagagtctggctctgtcacccaggccggagtgcagtggcgccatctcagcttattgcagcctctgcctcctgggttcaagcgattctcctacctcagcctcccaagtagctgggactacaggtgcccac

SEQ ID NO: 58863 - DNA, 601 bp, Human
gtctcactctgtcatccaggaaggagtgcaatggcgcgatctcagctcactgcaacctctgcctcccgggttcaagcaattctcctgcctcagactctcaagtagctgggattacagacatacgccgccacacccagctaatttttgtatttttagtagagacggggtttcaccatgttggtcaggctggtctcggactcctgaactccagtgatctacccgccttggcctcccaaagtgctgggattataggcgtgagccagcgtgcccagcctagcattttattctttttaaaggatgmatagtattccattgtgtatatatacattttctttttactgtttttttgttgttgttgttgtacagatttttctcgtcacccaggtactaagcctaggacccaatagttattttttctgatcctcttcctcctcccaccctccaccctcaagtaggccccattgtctgttgttcctgtctttgtatccatgaattctcatcatttagcttccacttataagagagaacatgtggtttttggttttctcttcttgtattagtttgctaagaataatgctgaacagatttattattgccagtg

SEQ ID NO: 58864 - DNA, 601 bp, Human
acggggtttcaccatgttggtcaggctggtctcggactcctgaactccagtgatctacccgccttggcctcccaaagtgctgggattataggcgtgagccagcgtgcccagcctagcattttattctttttaaaggatgaatagtattccattgtgtatatatacattttctttttactgtttttttgttgttgttgttgtacagatttttctcgtcacccaggtactaagcctaggacccaatagttattttttctgatcctcttcctcctcccaccctccaccctcaagtaggccccawtgtctgttgttcctgtctttgtatccatgaattctcatcatttagcttccacttataagagagaacatgtggtttttggttttctcttcttgtattagtttgctaagaataatgctgaacagatttattattgccagtgaaactgatatgttttgatgaaacttgctagattgtaacctagctagtaggaggtgatcttgtattcttttatgtactagcaaaagttaatattttgaaaaaaattatgcatgcatatatatatgtatgtacacacacacagaggtcttgctctgttgccca

SEQ ID NO: 58865 - DNA, 601 bp, Human
ttgggagtaggtaggattataggtgcccgccaccaaacctgactaatttttgtatttttagtaggggtttcaccatgttgtccaggctggtttcaaactcctgacctcaggtgatccccctgcctcggcctcccaaagtgctgggatcacaggcatgagccaccgtgcccggcctagtaactgcagttctaagccgcaaatcttgaaagaggaatggtttatcattgtagtttattcagccaataggctgaaaaaagatttgcgattgtgccttttagaacaaaacagttacaggttgagyatctctcgtctaaaatgcttgggaccagcagtatatcggatatttttcgattttggaatatctgcattatatactcatcagctgagcatccttaatctgaaaattcaaaatccaaaaagctctactgagcatttccttttttttttttttttgagatggagtctcgctctgttgcccaggatggagtgcagtggcgcgatctcggctcactgcaacttccgcctcccaggttcaagcaattctctgcctcggcctcccaagtaactgggattacaggtgcctgcaaccacgcctggctaa

SEQ ID NO: 58866 - DNA, 601 bp, Human
agcatcttagccttttacatacttaaaaatagaaactcttgtcgataagtattagggcaatgattaaataaaacagtgtacatagaaactacttgaggctgggtgccatggctcaagcctgtaatcccagtactttgggaggttgaggtgggaggatccctcgcgcccaggagtatgagaccagcctggccaacgcagtgagaacctatctctacaaaaaaaatttaaaatttagccaggtgcagtatcacatgcctgtagtcacagctacttaggagctgcttgagaggatcatttgagyccaggagttgaaggctggaatgagctgtggccataccactgtactctagctggcgcaatagagactctgcctctttaaaaaaaaaaaaaaaaaaaaaaaaaaggtttcaatagtgaaaaggactatatagatctgaagtgattataaaacaaggaactgataacaatgactttaatctgattataataagctctcggtgttagtccctgatattcttaggtaattttaaaaattacgtctcacaattcccattaggcacggtttctctttctgttgaagtgctgatattttattgtgggg

SEQ ID NO: 58867 - DNA, 601 bp, Human
gtgccatggctcaagcctgtaatcccagtactttgggaggttgaggtgggaggatccctcgcgcccaggagtatgagaccagcctggccaacgcagtgagaacctatctctacaaaaaaaatttaaaatttagccaggtgcagtatcacatgcctgtagtcacagctacttaggagctgcttgagaggatcatttgagcccaggagttgaaggctggaatgagctgtggccataccactgtactctagctggcgcaatagagactctgcctctttaaaaaaaaaaaaaaaaaaaaaaaaaaggtttcaatagtgaaaaggactatatagatctgaagtgattataaaacaaggaactgataacaatgactttaatctgattataataagctctcggtgttagtccctgatattcttaggtaattttaaaaattacgtctcacaattcccattaggcacggtttctctttctgttgaagtgctgatattttattgtggggtaaagtggagattcagctgcataaagacctggaataggtataaatattcaaatttggcttcacagagaagacttgtgactagatttttctaaaatgaaaaga

SEQ ID NO: 58868 - DNA, 601 bp, Human
acaaatacttttatgttattgccatggtttaagctgtttgtatactttcatgcagtttcatgttagggtcttacagtgtgaatgacggtgcgcaactctacatgattgacccatcaggtgtttcatacgtgagtaattttgaatcatttgaaattctattttagtttaatggtatttcattagcatttaagtctcattataagattatatgaaattaaaaaaaaactcattcaaggaaagtaatttttcttttttttttttttacaacaacctcttgtccaacagaattttttttttttttcctttttgggggaacagggtctcactgtggcccaggctggagcacagtggtgtgatcacagctcactgcaacctctgcctcccaggttcaaacagttcttctgcctcagcctcccgggtagctgggattacaggtgtgcaccacctggctaattttttttatttttagtagaaacaggcctttgccatgttggccagactggtcttgaattccagtcctcaagagatctacccacctgggtctcccaaagtgcgagtattacaggtgtgagccaccaggcccagccatgttttcttatca

SEQ ID NO: 58869 - DNA, 601 bp, Human
cagtgacacaatcatagctcacttcagcctctcaactcctgggctcaggcgatcctcctacctaagcctcccaagtagctgggactacaggctcatgccaccatgcctagctaatttttgtatttttttggtgtctatagagacaaggtctttccacgttcccagggctggtctcaaactcctggccttaagcagtcctcctgccttggactcccaaaatgctgggactacaggcgtgagcatcgatgtccagccatgtcatcccttttattttatttatttataagatggagtgtcactytgtctcccaggctggagtgcagtggctcgatcttggttcactgcaacctcttccgcctcctaggttcaagcaattctcctgtctcagcctcctgattagctgggattacaggcatgtactaccatgcctggttaatttttgtatttttagtacagatggggttttgccatgttggccagctggtctccaactcctgacctcaggtggtctgcccaccccggcctgccaaagtgcaaggattacaggcgtgagccacagtgccggacctaattttgtttcagacagcgtctcgctctgtca

SEQ ID NO: 58870 - DNA, 601 bp, Human
ggcgccaaacctccacctccccagttcaagcaattctgcctcagcctcccgagtaggctgggattagaagcatgcatcaccacacccggctaatttttgtattttcagtagagacgaggtttcaccatgttagccaggctggtctcgaactcctgatctcaagtaatccgcccaccttggtctcccaaaatgctgggattataggtgtgagccaccttgccctgccttcccttttaaagagaaggtttaaatgtgatttctaagagctttccctaaattattaccatttttttttttttttgagacagagtcttgctctgttgcccaggctggactgcagtggtgcaatcttggctcactgtaacctctgcctcccggattcaagggattcttgtgcctcagcctctcaagtagctgggattacaggcctgtaccatcacacctggctaatttttgtatttttagtagagacagactttcaccatgttgcccaggctggtctggaactcctggcctcaagtgatccacgtgcctcagattcccaaagtgctgggattacaagcactttgtgtgagccactgcacccggcctgttaccgttt

SEQ ID NO: 58871 - DNA, 601 bp, Human
ccccagttcaagcaattctgcctcagcctcccgagtaggctgggattagaagcatgcatcaccacacccggctaatttttgtattttcagtagagacgaggtttcaccatgttagccaggctggtctcgaactcctgatctcaagtaatccgcccaccttggtctcccaaaatgctgggattataggtgtgagccaccttgccctgccttcccttttaaagagaaggtttaaatgtgatttctaagagctttccctaaattattaccatttttttttttttttgagacagagtcttgctcwgttgcccaggctggactgcagtggtgcaatcttggctcactgtaacctctgcctcccggattcaagggattcttgtgcctcagcctctcaagtagctgggattacaggcctgtaccatcacacctggctaatttttgtatttttagtagagacagactttcaccatgttgcccaggctggtctggaactcctggcctcaagtgatccacgtgcctcagattcccaaagtgctgggattacaagcactttgtgtgagccactgcacccggcctgttaccgtttcttaactgttttcttatc

SEQ ID NO: 58872 - DNA, 601 bp, Human
tacatttttgtcgtttttactaattgaagaaaatgaagattcttaaatatattttgctgtaacagaagtatatatgtgtacatcctttttttttttttttttgatggagtctcactctgttgcccaggctggagtgcagtggcgcggtctcagctcactgcaacctctgcctcccagattcaagcgattctcctgcctcagcctctggagtagctggcattacaggcacctgccaccacacctagctaatttttttgtatttttagtagagacagggttttacaatgttggccaggccggwctccaactcctgacctgaggtgatctgcccaccttggccttccatagtgctgggattacaggcatgacccaccacacccagctgtgcatccttatctttaaaaaaatttacaaaataataaaattgggggtttagagtactgaactcataggaattaactttatttctgtctctcaggaatatataatttcatttttcattgtcatagtgctaaaatcttttccgttcctgttccccaaaatgtcttaaagtgtatatgattacataatttacatatttttggatatacctttattaaaa

SEQ ID NO: 58873 - DNA, 601 bp, Human
ttagcatcctttcactaggttatagaaacattagtagtcattaattacatatgatagtgtactaattcagtgattatatatatttttttctaaatagggttattggggctgtgccatcggcaaagccaggcaagctgcaaagacggaaatagagaagcttcaggtaataattaatgcttgaatttttactatgtcgtcatcctaatgcagtgaaattttatcaccacagacatttcagtctaaggcagggatgtccaatcatttggcttccctgggccacacataaaatacaccaacactratgatagctgatgagcttaaaaaaaaatctcatcatgtgttaagaaagtttacgaatttgtgtttggccccatgtggcctgtggctggggaagctcggtgtaaggatatagtgtggtttgatgttgagagtttatgaagctgctaagtcactgaatgggaaagctggtaacatattatctgtagagttgtgttatacatccctttatagattctgaataactgctataaagcctcaatctagaaaaacacaacttttgatatgatttcacaaaatccttgaaacctatttatgaatctct

SEQ ID NO: 58874 - DNA, 601 bp, Human
gtttgactttttaggatgcaattaattcactaaatacagaacttaactaaggacaaaaatttaaagatcagcattctttcccttcccatcacgctcaacttaacatgaagaactgtaaacatcctaagcttacaacaaacctatctagttagacttcagttaaccacttacacatccccctcccccatgaactatttggaaaaagctgcaggcgtaatattggatccctaaatactttattctccttataccattatcagacccaagtatcatctaatagtccataatcaaactgcctaarcagtttctacactgtctttttaactatttcaaactatcaaggttcgcattttcttccttagaacttttagtctttttcttccccaaaatatttgagtccatgccagttgcctttagttgtacccaaataatggtttgtctatttcctaaaagtagtactcttaaatttaaatttagtgttatttttgttgtcattgttccttcttcctcatgtggttgtgcaggcagagcttgagcatccagatttcaaaattaaaaaataaaagataatctagtttaatatatagtagttgaatcacct

SEQ ID NO: 58875 - DNA, 601 bp, Human
tttgttatcctaacttggctataaagaaaatcagatgtcttcaccagtcgttcaaacttcaggtctgcctacagattcatagatggctgtggatttttataattttgtcacaaagttagtggtaactacaggttatctcagaatatcttttttggcgtataaatttttttcttttccttttttagacagtctctctctctgtcgcccaggctagagtgcagtggcgtgatcccggctcactacaacctctgcctcctgggttcaagagattcttaggcctcagcctcccgagtagctaggrttacaggcgcgcaccacctccatgcccagctcttttgtatttttaagtagagacagggtttcaccatgttggtcaggctggtctcgaacttctgacttcaggcaatccggccgcctcggcctcccaaagtgctgggattacaggcacaagccactgcacccagcctggagtataaatttcaaaacattaaaatatgaatcaggaaacttcgattctggtctttttcagactttaggttattttccttggttttatatctgagtataaaagtgaaaatagttattacacaagtggaaaatg

SEQ ID NO: 58876 - DNA, 601 bp, Human
agtgctgggattacaggcacaagccactgcacccagcctggagtataaatttcaaaacattaaaatatgaatcaggaaacttcgattctggtctttttcagactttaggttattttccttggttttatatctgagtataaaagtgaaaatagttattacacaagtggaaaatgttcttctgatgaacagtatacattttattttctatagatgaaagaaatgacctgccgtgatatcgttaaagaagttgcaaaaatgtaagttgaaatttttcttaccatccacaaaaatatttcatttsacctttgcatatatatattacattaatcctaagaagctgttttcctgtaaaataacttagtgtataatttttagaaggtaaatttaacattctaagaagcctcacgaaggaagaaaatgtttttaagcaatattttttagtagtaatgaataggatgggaaaaatagcttgacaaaataaactcctgttacaggttaaggacatataccattagggtcttaatttgttagctcccaacttctcaaatctcttaagtcctaataatagtaatcttaagattgcctctattgtaagaatgct

SEQ ID NO: 58877 - DNA, 601 bp, Human
gatatcttccttgaattgtatagtatgttatcatgatatactctgtttccttcaccgaaccaatcctttgaagtccttctggaaatcagttcttaccatcttttatatttaggtataatggtagtcatctgttaagtgttccatgttaggaaagccatcccttcatcatttaagaaaatggagcagcatgttatcttttacttagttgtagaaaatcaagatcctctcatattatagcaaggttttagaagaccctccaaaaagtaaggtatgtaactcagtgcatagtattagataaagytatactctgctactgtacttaatttgatacttttttttttttgagatggagtctcactctgtcgtccagactggagggcagtggcacgatcttggctcactgcaacctccgcctcccgtgttcaagcaattctcctgcatcagcctctcaagtagctgggattacaggcgcccaccaccacacctggctaatttttgtatttttagtagagacaggctttaccatcttggccaggctggtcttgaactcctgaccttgtgatccacccaccttggcctcccaaagtgctgggattacaga

SEQ ID NO: 58878 - DNA, 601 bp, Human
ccttaggaatgatctgtaccacagctaatttacaactgagtgtcctttctaatataatgaaagctaaagcaaatttactaggttgtctaatgaagggaaagttctgcttaataattgacttaagttgtgaacacgttattttttgaaacatccatttcatggttttaagatattatgctataaattaatgctcaggatttataaatagcataatttactttcatttccataagaacttaatatgtaggcacatataatctcatgtagaagcagcacacaaaaatattcgagtattactcawagtacaactttgcaaccttaggtgagtcagatatgtggattgggtagatcctatggtatactgcaagttacaatatggtactcaatttaaaattcatttacacatgtggcttaatttacagtaactaatggaagacatgaaattgttccaaaagatataagagaagaagcagagaaatatgctaaggtaagccacagcacaaaaacttctcttggccaggtacagtcagggaatctcttagcccaggagtttgagaccagcctgagcagcacagcaagacccccatccctaatttaaaaa

SEQ ID NO: 58879 - DNA, 601 bp, Human
ctttgcaaccttaggtgagtcagatatgtggattgggtagatcctatggtatactgcaagttacaatatggtactcaatttaaaattcatttacacatgtggcttaatttacagtaactaatggaagacatgaaattgttccaaaagatataagagaagaagcagagaaatatgctaaggtaagccacagcacaaaaacttctcttggccaggtacagtcagggaatctcttagcccaggagtttgagaccagcctgagcagcacagcaagacccccatccctaatttaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttttgagacggagtcttgctctgtcacccaggctggagggcagtggcaccatctctgctcactgcaacctctgcctc

SEQ ID NO: 58880 - DNA, 601 bp, Human
ctcttagcccaggagtttgagaccagcctgagcagcacagcaagacccccatccctaatttaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatat

SEQ ID NO: 58881 - DNA, 601 bp, Human
gttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaacygttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatat

SEQ ID NO: 58882 - DNA, 601 bp, Human; identical to SEQ ID NO: 35193

SEQ ID NO: 58883 - DNA, 601 bp, Human; identical to SEQ ID NO: 35194

SEQ ID NO: 58884 - DNA, 601 bp, Human
tcatctgcatggcgttcttacagagagaaatagttgtattctttttcatttgtagtcggagtacttcagaatattaaaatagtgaactttgaccttgaagcatctaaattgtctcagttaagattgtgatgtataccagaaaaaatttacaccttaaattcaatttagcattcttgttttgcacattttgaatggtttttttaatttaagagcaaagtccatagaatgattgtactattgaaaaatcttaaatctcaaaagctaagaaaggtaatttagattttaagtttcaagaattacrtaaatttgggtcttaaggaaaaactgaaattcctgaatgcttacagaggtttttgtttaattttttttcgtgattacagaaatcataagtgtttgtagaaaactcagaaaattccacagatagaaggaaataaaagttactcatacttctacccagagatatcactattaacattttatgtatatccccccagctgcttatagagttctccaataaaatatactttgaaatgcatgcttagaagtaagggtagaagagtggtagaaatgggtacatagtgtgaaccaaattttgttaatc

SEQ ID NO: 58885 - DNA, 601 bp, Human
gaaggacgggcagagttcaggatgacatgggtttctgtcacctagaaactaataggaatggcaagctgttatcactgctagatctgagggagcaaagagaagaaatagtgttactggagtctagtgagagctggtgccatagtggatgggctgttaagacaggagctatagtactagaggcattcagccactgccagaaaagggagcccagagcagggagggaacaaggagggaatattctcctctctgacttttttctttgctctttgatctttttccagtgccttctattggccagacycacctggaagctggccagcaggtgaatctatgatgctgcccatagaggtcagcctcttgggactcagcagggcccagtatggtggaaagttggtctgggggtggaaagtggatcagacaaaattataccataccctatagcatattcttaatttcactttcatcattttatctcatcatcctcatctcctgaaatcccaaaataaaccttaaagcatgtgaactattgattatgactcagttctatcttttaatataaatagcccaaagagttaccctactcttatcagagaaattaaat

SEQ ID NO: 58886 - DNA, 601 bp, Human
gatctcggctcactgcaacctctgcctcctgggttcaagcgattctcctgcctcagcctcccgagtagctgggattacaggcgtgtgccaccatacccagctaatgtttgtatttttagtagagacggggtttcactatgttggccaagctagtctcgaactccggacctcaggtgatctttataaggcagagtgaattagcaaaaagattcttattccaccgatctagaaatacaagaacagatgtggccagtcgcggtggctcatgtctgtaatcctagcactttgggaggccgaggcrggtggatcacgaggtcaggagatcaagaccatcctggataacatggtgaaaccccatctctactaaaaaaaatacaaaaaattagccgggtgtggtggcacgtgcctgtaatccctgctactcgggaggctgaggcaagagaattgcttgaacccgggaagcaaaggttgcggtgagctgagatcgcgccactgcactctatcctgggcaacagagcaagactccgtatcaaaaaagaaaaaaagaacagatttttagcttatcaaaagagagtctgttttagtccataactttattgag

SEQ ID NO: 58887 - DNA, 601 bp, Human
ttggagcattttttttttttttttttttttgagacggagtctcgctctgtcgcctgggctggtgtgcagtggtgcaatctcagctcactgcgacctctgcctcctgggttcaaatgattctcctgcctcagcctcctgagaagctgggattataggtgcccaccactatgcccagctaattttttgtatttttagtagagacagggtttcaccatgttggtcgggctggtcttgaactcctgacttcgtgatttgcccgccttggcgtcccagagtgttgggattacaggcgtgagccacygcacccagccgcttgattggagcattctacagggctaagaactataaggttgggccagagagtaaagtaaagggacttaccggctgctgggccaggctaggccagggagttactttctgctaaacactgtggggagtccttgatggattttatttgttgaaaatactttggaagcaggaagtcccaatttggagtccatcttgggggcagaagtatccaaagcccttctctcagtttgcatctctagcaaagaacacattttaactaataatttcattctgctgcacccagtgtgacagt

SEQ ID NO: 58888 - DNA, 601 bp, Human
aatctcagctcactgcgacctctgcctcctgggttcaaatgattctcctgcctcagcctcctgagaagctgggattataggtgcccaccactatgcccagctaattttttgtatttttagtagagacagggtttcaccatgttggtcgggctggtcttgaactcctgacttcgtgatttgcccgccttggcgtcccagagtgttgggattacaggcgtgagccaccgcacccagccgcttgattggagcattctacagggctaagaactataaggttgggccagagagtaaagtaaagggrcttaccggctgctgggccaggctaggccagggagttactttctgctaaacactgtggggagtccttgatggattttatttgttgaaaatactttggaagcaggaagtcccaatttggagtccatcttgggggcagaagtatccaaagcccttctctcagtttgcatctctagcaaagaacacattttaactaataatttcattctgctgcacccagtgtgacagtgtttgaaaaggaaccagcattgtgaggtgaggaatggatttttatgtttagttgcagcagtataattttgctgct

SEQ ID NO: 58889 - DNA, 601 bp, Human
ttagctgtttatccaaatgagggaaacaagttttgagttaaaggaaaatatcaactaactacaggacttaaactgcttaacccatcaatgtaacatgtataacagggcattacataattatttttgaaatctttcagattgtaaatgctttaatattcagaagaggaaatgattactgatctctgacccttgattttgttatctgtatgattttgctacctcgtagaagtaaataaaataatgtatataaaagacttaatataatgcctactacttagtataccttcaataaattgtagcrgttgctgttggtaatgaaaattatgacgatagtaagaatactttataagagtaggctaactgctataatgacccaaaaccccagtgccttaacacaatataatgtttatttcttgtttaagctcagagtgtgttggcaaggaggctcagagtgtgttgattcccccagtcattcaggagtgaaattgtgtggctctgccctcctgtaagtacttggagccctttccatttgaccaacagagggtaggagagactgaagctcaagccagagaggtttgtatgggcctagcccagaagtgtg

SEQ ID NO: 58890 - DNA, 601 bp, Human
gtaaataaaataatgtatataaaagacttaatataatgcctactacttagtataccttcaataaattgtagcggttgctgttggtaatgaaaattatgacgatagtaagaatactttataagagtaggctaactgctataatgacccaaaaccccagtgccttaacacaatataatgtttatttcttgtttaagctcagagtgtgttggcaaggaggctcagagtgtgttgattcccccagtcattcaggagtgaaattgtgtggctctgccctcctgtaagtacttggagccctttccakttgaccaacagagggtaggagagactgaagctcaagccagagaggtttgtatgggcctagcccagaagtgtggcacccaacatttctttttttattttattttattttattttatttatttgtttattttgagacagagtcttgctctgtcacccaggctggagtgcagtggcaccatctcggctcactgcaacctccacctcccgggttcaagtgattcttgtgcctcagcctcctgagaagctgggactacaggcacgcagcaccacgcctggctaatttttgtattttgagtagaga

SEQ ID NO: 58891 - DNA, 601 bp, Human
caaagaatgacttgactgaggacacatatatgaattttagaattttgtaaccccaggccagtcataggagattaacgttcccctggtagactattggggaacaaactctctctgttccccaggctttcctcctcccagtcaactttaaagacacctctaccacacacacacacacacacacacacacacacacacacacccgccaactcctgtcaacaggagtactggactttaatttgcctcttatcgctccttcacacacacacacacacacacacacacccacacacacacacacacaccccaactcctgtcaaccggagtactggactttaatttgcctcttatccctccttctcccttccttagcattgatgtctataggtgagtttgcctggtgagagtgaaggtaaatgccagagcagctctttattccactggcctaattgcgagttcttagcaaggcaatagcatcccactccaggcacatattaacctgagtggctgggtagccgtcaggacctgtggttccattttatccaattcaattcatcaggcatttattaacacttaacaacattgggccctagggatacaagaa

SEQ ID NO: 58892 - DNA, 601 bp, Human
gaatgacttgactgaggacacatatatgaattttagaattttgtaaccccaggccagtcataggagattaacgttcccctggtagactattggggaacaaactctctctgttccccaggctttcctcctcccagtcaactttaaagacacctctaccacacacacacacacacacacacacacacacacacacacccgccaactcctgtcaacaggagtactggactttaatttgcctcttatcgctccttcacacacacacacacacacacacacacccacacacacacacacacaccccaactcctgtcaaccggagtactggactttaatttgcctcttatccctccttctcccttccttagcattgatgtctataggtgagtttgcctggtgagagtgaaggtaaatgccagagcagctctttattccactggcctaattgcgagttcttagcaaggcaatagcatcccactccaggcacatattaacctgagtggctgggtagccgtcaggacctgtggttccattttatccaattcaattcatcaggcatttattaacacttaacaacattgggccctagggatacaagaatgaa

SEQ ID NO: 58893 - DNA, 601 bp, Human
acacctctaccacacacacacacacacacacacacacacacacacacacccgccaactcctgtcaacaggagtactggactttaatttgcctcttatcgctccttcacacacacacacacacacacacacacccacacacacacacacacaccccaactcctgtcaaccggagtactggactttaatttgcctcttatccctccttctcccttccttagcattgatgtctataggtgagtttgcctggtgagagtgaaggtaaatgccagagcagctctttattccactggcctaattgcragttcttagcaaggcaatagcatcccactccaggcacatattaacctgagtggctgggtagccgtcaggacctgtggttccattttatccaattcaattcatcaggcatttattaacacttaacaacattgggccctagggatacaagaatgaaatgttgcagacccagcctccaggaagcccacctagggcagtaggcatgatgacctgatgaggtttcatctgagctgggttttgaagtctagatgtgagttacttggaaagtaagaaaggagttcaaggaggcatgaacaacaggtg

SEQ ID NO: 58894 - DNA, 601 bp, Human
ccctagatgccaggggattcttagaaccctagggaacctagggaaggaagtgctttgggccactcaggggctatggcagtaacaggaaagcccaagaacactcccaggcagagattctctctctctttctttctttcttccttcctttcttcctttctccttttctctctctctctctttctctcttttctgtctctctcttgtttctctgtctctctctctctctctgtgtctctctctctctttcttgttttttctcctgggggaaacgggagataagtggcctcttgggtcagattcmctctgagcagcacattcattctttcattctctctttgctgactgtctttttcctatagactgagagagcacttagaggtagcttgcagcctccaccaaactagaccctcttcatctcaatttctcgttctaagaagaacacattgactgtctcagtttgtgtcgtgtgtccagctttgacaaagatgggagtaagtagtttgtagccccatagtacaagtatgacttggcatggagttgagaattacttagtgcttagaaaaaagggtcaacataggctagggagctcctgtaggataaa

SEQ ID NO: 58895 - DNA, 601 bp, Human
gctgtgtcattgcccatatttgtcgctttttctcttctgctgcatgtgagatttgaagaccagcttattttctaactttggtttgttaatctgtaatttattgactccttaactcattgctcctccacaaattaattaaaaagttaccacattttacctgaaatatatgcacacaactatgaagataatggagcacatagtttccttgtgctttttaataagatggtttaattgaattgttacctgttgaagtattaaaaattgcttttataaactgctgaaatgataaagaacgacagcktgagctctccagataataatctcattcaatctgtgtttttaaaatctgtgatttgacaagtttcataggagcaggctttctgaatcgccattttaaaaattaagtggaaactcattagtgcaaattatatacaatgattttaagccccaggaggctaactctgtgtacatattgaatagtcatttgttcttggtttattgtaactatagccaattaagttcattgtaaaaaaaaaaaaaatcacatttgtagtaaaattggtaaaatgtcttgaaatttaacagtttgacatctcaaagc

SEQ ID NO: 58896 - DNA, 601 bp, Human
tacctgttgaagtattaaaaattgcttttataaactgctgaaatgataaagaacgacagcgtgagctctccagataataatctcattcaatctgtgtttttaaaatctgtgatttgacaagtttcataggagcaggctttctgaatcgccattttaaaaattaagtggaaactcattagtgcaaattatatacaatgattttaagccccaggaggctaactctgtgtacatattgaatagtcatttgttcttggtttattgtaactatagccaattaagttcattgtaaaaaaaaaaaaaatcacatttgtagtaaaattggtaaaatgtcttgaaatttaacagtttgacatctcaaagcacatataattttggaatatctggcaaccaatgagattgtatgtttctgattagctttgtccatccactgtttcatccatttgccttttttctgtttttgcagatctgaacagaattaagacgaacgagctttcacaattgcagcagatgaagatccattggtaaattgatcaggatttttggcctaccctccaaagaaaaggtaactggctgttctgatatcgcaaacacagttgaataa

SEQ ID NO: 58897 - DNA, 601 bp, Human
ctggcaaccaatgagattgtatgtttctgattagctttgtccatccactgtttcatccatttgccttttttctgtttttgcagatctgaacagaattaagacgaacgagctttcacaattgcagcagatgaagatccattggtaaattgatcaggatttttggcctaccctccaaagaaaaggtaactggctgttctgatatcgcaaacacagttgaataaatataatgcttccagttataatagagtttgagttttaccaaaggatgatagtttattttaaggcatctgtgtaagatctyaaatgttaaatgtaatcctgaatatgatcttagaaaaataaaatgacaatgagtttaggagtatgatattattaggtatttgtttctcaacacaaaaactactaaataacatcccctccaaatttgttaaaattgcaggaagactttagttatagaatcctccttctttcccagtctatacccacttttttctggaagttatccaaaagtgtgctcttgtttctttccagcaccattcccccagctcctgttttcttgtctttccatgtaatgtagacccagctgcttagggcagggaag

SEQ ID NO: 58898 - DNA, 601 bp, Human
aaaagtgttttagtactgttgagatgtttgaaagaacaagagtttggggagctatgaagtctccaccttaaaaacagcctcttaaaatgttctggactaaagctgaagggccataatgcagagatgtctttcagtgatcgttgaagtcatcacgttgaatgttgttcattgtatcatgtctgcaaggtgccagagaagagagaaacaggctttcctgtgtggtgtccaatcactgacaatggaggggtatggggagaagttaagaggaaacatgtttggcagaatgccagaggagctcttkagtgcctgtttatggagtttctactgtgtgcatggggattgtccctgggaggaaaaggagaagaataggaggtgatttacatggactgcagtgatgacctaatgcttttttgaatattataccaatgaaaagattaatatgatgccaggaagtaagtgaccaagaagcagagaaagaagaggaggcacaagttcaaaagtctgtagaggccagagagaccagagaggggaataaagtgagccaggtggaactgtgagaaaccatccggtccatgatccatctaatgtggcaatcccttct

SEQ ID NO: 58899 - DNA, 601 bp, Human
gtgagctaccatatctggctggattgccttctttttaaagattgaatagtattccattgtgtgtgtgtataacacagtggaatattatttagccataaaaaagaaggaagtattgataacatgttccaacatggataaaccttgaaaatgttttattaaatgaaggaaaccaaacacaaagaccacatattatgtggtttcatttaatattcagaataggcaaatccatagagacagaaagcagatgtggttttcgggggttggggagggaatgtgggcagtgattgcttgatgaatacarggtttccttttggagtgatgaaaatgttctggaactagatagtaatgttggttgtactacactgtgaatgtactaaatgtcatcaaattgcacacttaaaatggttaaaggccagttgcagtggctcatacctgtaaatccagcacttagggagggcgaagcagaaagactacttgagtccaggagtttgagaccagcctgggcaacatttgaaaccccgtctctataaaaaaagtacaaaaattagctagccgtggtggcatgcgcttgtagtctcagctacttgggagctgaggtgag

SEQ ID NO: 58900 - DNA, 601 bp, Human
gcatcctttgaagcacagaagtttaattttgatgaagttcaatttacccatttggctctgttttcattcttttttaatttaatttaatttaatttttttttgagacggagtcttattctgtcgccagactggagtgcagtggcacaatctgggctcactgcaacctctgactccctagttcaagagattctcctgcctcagccgcctgagtagctgggattacaggcacgtgccaccacgcccagctaattattgtatttacagtaaagacggggtttcaccatgttggccaggatggtcycgatctcctgacctcgtgatctgcctgcctcggcctcccaaagtgctgggattacaagtgtgagccaccgcacccggccttggctctgtttttaaaaagaaatacctggtaagtcagattccaacccactaattgcccgcttgtgattgctgctttgctgccactgccccagaaaccatttggaaaaatcctcatgctttttgaaaataccggttttctgaagagatggagcaagctctggaaggcaggaaaggcagatttctcaccaggagcaattttgttttggttccccttttctac

SEQ ID NO: 58901 - DNA, 601 bp, Human
catcctttgaagcacagaagtttaattttgatgaagttcaatttacccatttggctctgttttcattcttttttaatttaatttaatttaatttttttttgagacggagtcttattctgtcgccagactggagtgcagtggcacaatctgggctcactgcaacctctgactccctagttcaagagattctcctgcctcagccgcctgagtagctgggattacaggcacgtgccaccacgcccagctaattattgtatttacagtaaagacggggtttcaccatgttggccaggatggtctygatctcctgacctcgtgatctgcctgcctcggcctcccaaagtgctgggattacaagtgtgagccaccgcacccggccttggctctgtttttaaaaagaaatacctggtaagtcagattccaacccactaattgcccgcttgtgattgctgctttgctgccactgccccagaaaccatttggaaaaatcctcatgctttttgaaaataccggttttctgaagagatggagcaagctctggaaggcaggaaaggcagatttctcaccaggagcaattttgttttggttccccttttctact

SEQ ID NO: 58902 - DNA, 601 bp, Human
gagataagaccacattttaaatatgtccttggaagggatgaaatgcacagaattagcagtacttcacctctgacagcccagttcttaagccatagacaatctagttggtggtgacagttttgatgaattgtttcccctacttactacttttctcacatactcagtgaaattactatcttgtgttcaccctggtgcctagtagagtgcctagtctgtagcaggcaatcaggaattgttggataaattgaatactcattattcaagccatataaaatgaattattacttaagttttcagacastgaagttcctcagagttacaaggcatcatcagaaatgcactggcagaagcactgattgatattatacaggcataatactatattaaaataacatattaagtgaatgtaaattgtattggcctggtgtggtggctcatgcctataatcccaacacttttggaggccaaggcaggaggactgcttgggctcaggagtttgagaccagcctgggcaacatagtgagaccttgtcatctccacacacacatacacacaaaaaaaatttatacacagttatattctttttataatttggtggtat

SEQ ID NO: 58903 - DNA, 601 bp, Human
tctttattaatttttatgcttatgtaaacttcctgtgtttctgcaagttggaccaacaaagaagttggctacctctgtcacatcagatgtttgaggtacaaaaaaaaaaagaattccacttcctccccatctagtcagagaaagcacttgtgagcaagcatctctgacacacattacaggagttgatactactgcagtgtgaaacatgcgtgaaacatgctgataagaatcactgtttttgtctcaggcttcaaattttcacatcaatttgagaaaatagtaatatcaacaattattgaaagtggtgtggtctgctactgtttcaagtatttttaatgctttaggtcattaagtagccttttattttgccatctgtagcctatcgctaagcaaatgttgtgtatgttggggaggggtgctaagttttgcgggccaatgcttaatttagtgaacaaaatttgaccgaaaacagtattttctaaacatgttttgtaggaattccttatattctcctaatccctagggtctcgtcctgcccaagaaaagacaaccataaagagggaaggactaacaactcaagttaaaaatgaatcagattttt

SEQ ID NO: 58904 - DNA, 601 bp, Human
aaacagtatttgtaatgtaagacgctgggtcacttctgtaagagctgaatttttaagttacttgtttactcttccctagagatgaaacatagtaggacccttagtaaatatgtgttggaggaaggaatgaagctttgtaaccagtgacgtatcattgcatgctggttagggactgggatcaggagtcaactagttttaacctttaacactagccccacctcttgtcagctgtgtgatcttgggcaagttacttaatcttgcggtgcctgcctgtttcctcatttgtaaactggggttaagratggtacctatactacagggttgcaaggattacgtaacataaagcatggaaagtacttagcacactgtttggcccattaagttctcaataaatgtttgacatggtagctgttgttaggttgtattttaaacatttgcctgaccttttacttcagaagcactcgaaacaaatctgggaagaaataggtgttttaggttgagacatcaatctgaattgtagctggtcagggtgttagctgccaaccacatttgtttgcatatggttgtggtaaagtgagctttgagtaccttgttcaggtat

SEQ ID NO: 58905 - DNA, 601 bp, Human
ctgattggtctctcgttggttccatcatttgacatcttttggtcaaagggaaatccagttatctttaattattggagtagacaatatgaatctgggagttgtgcttatggaaggtggaaataaaattctacctttttcctttcctacttgagactaaagctcacttaacagcaatttaaaactttaaaaatatcattgatgctacttttgattaccgactattgagagtcacctgttgaaataaatttggaactgactgtagtaaaacctgttacgtggagaccagccttcctcttctctytggtttcttagaaatatatccaacaatggagccgagagtcctagcatctcaggaaacctatgagcagcggtgagagcagacagtacagaggtacccgcaggagtctgctggcagataggaacagcttgattgacttttcatgaaatgagacagaagagcagggatttcctgggagaggtggagagtaattcaagaagggcactgagtagtggaggagctcatctaataagatggtaaagagcatgtactttggagtagcctaccttcacatcccagctcctctgcttactgactttgtga

SEQ ID NO: 58906 - DNA, 601 bp, Human
catgagccaccgcgcctggcccagggagctcagtttcatagggtagaatgaactgggtttaagtataccatgtttcttcccacagagggggtgtgtgtgtgcatgctttttagagagattcagtgtgctcatgagaaattaagaaccgagttttccggtcacacaaaccagagtcctggttatgccgctttcttgctgagtgatattaaataagtttgtttctccataagtaaaatggggattattatgtagggttattattagaaataaatgggaaaaaccatgtaagaactgcttggcrtaggacctggcacatagtagtctctcagtaaatgtcagctggttatcattatagtcatcatcagttgcaattgatcttaagttattgaggaaatagaaatttttacagaagtatagattcttggttccttacaggataacccctatctttttagttttactagtcctaagtctcagaaaaggatcaaaggaaccagggcaaaaaagaataattttgtacatgataaacatcatgtgacaaattgaatccttattatttgaaaggatcagtttaggtttttatttctcttaattgctttat

SEQ ID NO: 58907 - DNA, 601 bp, Human
gagccaaccagaatggcaggaagggaggcccctactttttaaagtatgtgtattatgtgctgcaaatgtcacattaattgccagagaacttttaagtaggaagcagcgttgagatggtgacgttccgaaagtcagaagccccattcttttgaggtgggaatcttaagttcttcagttagtttagtgataagtgtgttggtcctatactggctactgaatagcataaactgtgtagtactacttacatgcatttactctggatctgaatggtgggattagcacagggttagcagatgacttrtggggtgtttttgaggctgtatactgagagcttcccaggaattcctattttgtgctctgcagcttcactgagtttgcttatgaagaataccttaatgtttctcttttatgcagacacaggggtgatattacctaggagaaatagatgaatgatgtttattcagcttggacaagtaccacatttagaatctctgtgattaattgaaaccctactcagatgttggctgtttaagtatttgcttcagattagttaggctgatccatttgttcacctttgggctcagcttgagtctctaagcag

SEQ ID NO: 58908 - DNA, 601 bp, Human
ccagagaacttttaagtaggaagcagcgttgagatggtgacgttccgaaagtcagaagccccattcttttgaggtgggaatcttaagttcttcagttagtttagtgataagtgtgttggtcctatactggctactgaatagcataaactgtgtagtactacttacatgcatttactctggatctgaatggtgggattagcacagggttagcagatgacttgtggggtgtttttgaggctgtatactgagagcttcccaggaattcctattttgtgctctgcagcttcactgagtttgcttrtgaagaataccttaatgtttctcttttatgcagacacaggggtgatattacctaggagaaatagatgaatgatgtttattcagcttggacaagtaccacatttagaatctctgtgattaattgaaaccctactcagatgttggctgtttaagtatttgcttcagattagttaggctgatccatttgttcacctttgggctcagcttgagtctctaagcaggttggagcagccactttttcccaaccttaatcaagtgctggttttatcatctgctgacttaattccacttagtatttttc

SEQ ID NO: 58909 - DNA, 601 bp, Human
ctgttgatggacacttagatcttcagtgttgcattactgtatacagtgctctaaggaccgtccttctttgggaatgtctgtcagtattttagcatattgattctccgcatggaacctggtcacagtgccctccaggtttgtactactgtgatttgatgaactacttcagcagttctgatttgggttgccacaataataaggcagtgaaaatgtgagtttctggcaatatctatctttatatatatataaattgtttataatgtgtatatggatcaaaacattacactgtactgtaaatatatagaacttttatttgtcatttataccttaataaagtagaggaaaaaacagttggaaattttttttaaaaaggcttaataaaaattaagtaagaaattattatttaatatatatatgaattgttgatattcaccagtgtcactcttgacttgcctgctacatgtagaaatcattagctattataggattgccatgcttcagctttaatggagatatttcgggatataaatccatattttatttatattttctaaaaagtacttttcctgacagtcatttcacaagactaatttgtacgatg

SEQ ID NO: 58910 - DNA, 601 bp, Human
aactgaggtagatggtggaagtttgaggggttgtgcattttgtgttttcctacgtggctcatttcagccaggtatagttttctgtgttcacctggtatttcttacagacaaaaatcatgaaaaagcgaatgcaaaatttcagtatgttcaaattgtttcttagtatatcggtggctttggaatgcatttgcattctcaaaacaagcttcatagcagaactgagggtatttaattcgattgagaattttatctaatcatttgatcttcaaagaaaatacatcacacatttgctctgagacamctgcttgagaattctgatacctagagtgtacttcttaaaagtcagagttctagttgagggttttctctgtcttcttcatatcacagacatgctgttcctttagtgcactgtttcagggggtacacaaggtgatttttgtagataaacacggatgaatattttaatgttcagtttatataataagcttattgaacttactgtttcacagatactattgttttggaaaaaaatctatctcagctgagggtagaggtgccctgcttcactctggggcccatctggaaatggattagggggtgg

SEQ ID NO: 58911 - DNA, 601 bp, Human
tttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatgtgagtatggccaagagggtttttaaagcttacctgctggaaatgaaactgtgtacactagtggcatgtgagagtgcctgtgagtaatataaaagagagtctacktggggaagaattcaaatgtatgttgtattgtttcttgatgtttccctgtcatgtcataggaaacttttcagagtagtaatagcagtgataataaggttactaacatttattgatccattcttgtgtgctagctactgaaacctaactctatgtgtgtactatgtcacttatcacaacaaccctatggaataggtactgttactatcctcgttttccagatgaggagaaggaagcttcgtgaggtgggggagttttgtccaaaaaggcctcaagtcacataggcctggatttgtgtcccat

SEQ ID NO: 58912 - DNA, 601 bp, Human
ataacttggttctgttgaagaaagcctcagattgacaaaatgtgaagtgcgttgttataaattataatcttgacagaggttttgtttctaatgagcagtgttgtatccacaggaatagtgttctctcccagtctgttatttttaaaaacttttaatatttccatataggctacccttgactgtgctttaaattatactggcttaaagcaagtgcagaaatttcccttgcgtgtgtatgaacatttaaaaaatgtgtcacccatggtcttaaattttaaagaaccactttttaaaaaatctrtgattttgaaatatccctgttttctagtttaaaaaaaaaatactgcaagccaggcatgcctgtaagtcccagctagtggggaggctgaggcagaaggattgcttgagcctaggagtttgagtccagcctggagaacattacgagacccatctcttttaagagaaaaaaaaaactagataaaatatattaataatttatatacaagctaagaaaatgtaatggtcttcctttttgctctggggtcttccttcttttaaaatgccagtatgctaataaggtatatttgctgaaaagtgtggg

SEQ ID NO: 58913 - DNA, 601 bp, Human
atctgtgattttgaaatatccctgttttctagtttaaaaaaaaaatactgcaagccaggcatgcctgtaagtcccagctagtggggaggctgaggcagaaggattgcttgagcctaggagtttgagtccagcctggagaacattacgagacccatctcttttaagagaaaaaaaaaactagataaaatatattaataatttatatacaagctaagaaaatgtaatggtcttcctttttgctctggggtcttccttcttttaaaatgccagtatgctaataaggtatatttgctgaaaagtrtgggttattgatgtggggtggcttcaggtcatcagtgaacacctctacataaatgagcttgtatgttgatgtgcatttctctggagggtgtccccagctaccccccagataggttcaagaagcattcagagtcactgctttgaagtatgtaattttaaaaccttagagggaggaagtaaaaatgataaaagttagcattttcttctaaaaattaataaaattgttagtgttttactttaaattttattaaagtgtatttgaataaaggacttcaggccctgtcccatgccccagccagtg

SEQ ID NO: 58914 - DNA, 601 bp, Human
gaggaagtaaaaatgataaaagttagcattttcttctaaaaattaataaaattgttagtgttttactttaaattttattaaagtgtatttgaataaaggacttcaggccctgtcccatgccccagccagtggaggcatgttacagtcttctggagtgggaaatttttaagtggttcttactttaagcttctaatttaattttagtatatagattttgtcttacaacagtggttcagaacctttttggggaaaagggttggtcaagagtacctttaaatatctcatttttaaaaaaaaaaaaccacggtccatcttccgagaataaaatagtgcatacacatacacattctgaatttttctatcttggattaatggacacccccaccccaagcccatccttggatttctaggttaaaaactctcataaaacaaactgctttttttttgtatagggtactaattggacacacagtggtgtattggtggtggtgtatgaagatagccacctgagttctgtagaattatgtcagtttcagctgtccctaagagaatgtgtgaaagcatgcctcagccctgtccacatcatgatcacaacttgcca

SEQ ID NO: 58915 - DNA, 601 bp, Human
ctttaagcttctaatttaattttagtatatagattttgtcttacaacagtggttcagaacctttttggggaaaagggttggtcaagagtacctttaaatatctcatttttaaaaaaaaaaaaccacggtccatcttccgagaataaaatagtgcatacacatacacattctgaatttttctatcttggattaatggacacccccaccccaagcccatccttggatttctaggttaaaaactctcataaaacaaactgctttttttttgtatagggtactaattggacacacagtggtgtaktggtggtggtgtatgaagatagccacctgagttctgtagaattatgtcagtttcagctgtccctaagagaatgtgtgaaagcatgcctcagccctgtccacatcatgatcacaacttgccattctccttctgcgctcttcctgcctacctgactctcagtaacatggatttctcagtaatacagtacctgtgggcaatgaggtttgcttttttcaaacccaagatgttctttttcagtcatttacaaagcgtggcagggaaccacacctttaagtgtgcaagacagtattgttgactgtg

SEQ ID NO: 58916 - DNA, 601 bp, Human
caccccaagcccatccttggatttctaggttaaaaactctcataaaacaaactgctttttttttgtatagggtactaattggacacacagtggtgtattggtggtggtgtatgaagatagccacctgagttctgtagaattatgtcagtttcagctgtccctaagagaatgtgtgaaagcatgcctcagccctgtccacatcatgatcacaacttgccattctccttctgcgctcttcctgcctacctgactctcagtaacatggatttctcagtaatacagtacctgtgggcaatgaggyttgcttttttcaaacccaagatgttctttttcagtcatttacaaagcgtggcagggaaccacacctttaagtgtgcaagacagtattgttgactgtgaaagaatattatacagcagatgtctagaacttgttcatcttgctataactgaaactttatgctcattgattagtaactccttatttcgctctcccttcagccgctggcagccaccactctagttgttgattctgtgagtttgattatagatctcatataagtggaatcatgcggtgtttagtcattatgtgactgggttattt

SEQ ID NO: 58917 - DNA, 601 bp, Human
tctattaagcttggtagggctaaacatgcctgcatgtccctaccctgagtgtttcccaagttgctgccaggtctcttctgtcttagacttagaacgttatctgttctcttcaccgtcaggggatttgctgctgttcattcccattactcattctctgttgtctgtctcccatcctcactgcccctcctcacttcttcatctgtctaatatcccgtcgaaagtcctctgtgccttccacgcggagagatttgtgactcctgtagcctttgtccattcactcattgtagaactttttattacrtacatctgtgagcacaggcctcactctttctaggtcgcagggaataaagggtttagcacaataaccacgtgttccctatgcttgtggtgcttacagtctaatgaaagagatggagagtattaatcaccaaaataactgtaaaattaccactgatgagttataaaaagatgagaggactacattatgaaagcctgcaaaaatgaagtttttccagggaaggctttcttgccataggaacattgggctgaaatcaatgtgatgatttatctgggcttgagagggatgggagaggtaggagag

SEQ ID NO: 58918 - DNA, 601 bp, Human
gggaaggctttcttgccataggaacattgggctgaaatcaatgtgatgatttatctgggcttgagagggatgggagaggtaggagaggtggaggaaacaatatgtgtgaaggctctgtgacaggggcagagcaaattccttagaaccttaaagccagccaggtggctgaacagaaagagggaagaagaggtacgcgggaccaaaggagcagggagcagtaagcaagggtcttagagtgtgcagggttccggagcctagttatgcagtcagtctttatcctgtgagccttgggcaacccctrtcggatttctgtttggaatgttcttcacagctcagtggaaaccctacttaggcttcaaactgagctgggaaaatgtatctgcctgctttcttcatttggctgtactgtgctaggcaccgggaacattcaagctgaggagaggtttatacatctgcttggagagacaggcaggtggaccggtaatattatatgttcattcgttctttcaacacacgttggagggccattatttttataaactttttgtttgaagcatttgagcgtcaggtactcttctagatgctggtacaacacaaacaa

SEQ ID NO: 58919 - DNA, 601 bp, Human
ggaagaagaggtacgcgggaccaaaggagcagggagcagtaagcaagggtcttagagtgtgcagggttccggagcctagttatgcagtcagtctttatcctgtgagccttgggcaacccctatcggatttctgtttggaatgttcttcacagctcagtggaaaccctacttaggcttcaaactgagctgggaaaatgtatctgcctgctttcttcatttggctgtactgtgctaggcaccgggaacattcaagctgaggagaggtttatacatctgcttggagagacaggcaggtggaccrgtaatattatatgttcattcgttctttcaacacacgttggagggccattatttttataaactttttgtttgaagcatttgagcgtcaggtactcttctagatgctggtacaacacaaacaaaacaaagttcctggtctttaggttactttcttagggatattttccatattaaagaaaatcaagtaaaaatgtaaaaagctaaacacatttgtctgtgccaggttagattatttaggtagacatagtttgcagtgtgtctcgtaaggaggtgggttgtgttattcaaccgaaaatggtag

SEQ ID NO: 58920 - DNA, 601 bp, Human
ttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggtaagccaggccctccaactctttctcccaccttcagagatgagacttgcagatactgtaaaatttcagtatggtcatgctgtygagaaacatatctcaggctcactgtggagatagttttttaaggagttttactatgaaaaaaaaaaaggaaaggttgagttcagtaagtttcaaccagggctcctcttggttgtaaatgcaagcagcaaaataaagctagagttatctgctctatacttgctgaacatcaagtgtctcaactctgttgagcaggcagaaattgggtccttcctgcgggttagtgacaggaactcttcacatggctttggcagcagtttccctttcatttgtctttatatagcagtgggaattcttgctagg

SEQ ID NO: 58921 - DNA, 601 bp, Human
atgtgctccagtttgcaatttaagacaccttgtgtgatattatgtacctaatgcttcccaaacaggattttaagtggaagaagagttccatggccaaaaaggtttaactcagcctttcctgtaaaaaaaaaaaaaggttctgttttttactgcagaacttgtcagagccttaatgggcactgtgctttgtaactcttgaagcagggaatgtcacgtcatgtataatgtggaacatgtcccaagctcttttcacctcggaaccttttttaggggaacatcttggagaactagtattcggtgrgagtgactttggtgaatagtaagctttgctaaagtgactgtccagtaatccccaggccatcccagatcctctgtttgggcattatttactagtgcctccttaaatggactctgccagtacattcatttgactccctgccttggtttcctaataaagtcagacgctagtcggaggccttggattgtctgcaacccaaagaaccatctccatgatcattagcaggacttacatccgtttccttagaacaccagattcagagcactgttactctgcttttctttttcatatttctttctggtt

SEQ ID NO: 58922 - DNA, 601 bp, Human
gttgggtaggcacccccaagagtctgttcatggcctgtgccaccaaagatgtaaaagcccactgtgaatgccagagtttcctcctccccagcatgggcactgccttgagtgcgaactgtcacacctgtgtgtgctagcccttgaccttgttcccttctcagttaacaacctggaataccttcaaggacacaaaagcactggaataccttcaaggacacaaaatcagtaaataaaaccaaaaggcaaacataagagccttttctctaagttagaaacccaggcctgcaactcttctagccarttggctagaagtgaatctttgcaatgattgtgcccagtagtagtgaaggcatttgaaagctaagaacaaaatctatagctgactgttcctggtgtcactcagtcaatggagactttagtagcgtgcagcctttggaatattcttgtttagaatcaatagagtgcagtgtacaaacgcttacttaccatttcattatttccccaccccctcttttttgaaagccaaaggcacgtccctgacagctgaaaatagcacggggaggaataatgcggacacttttgaggacaagttacacctcca

SEQ ID NO: 58923 - DNA, 601 bp, Human; identical to SEQ ID NO: 27394

SEQ ID NO: 58924 - DNA, 601 bp, Human; identical to SEQ ID NO: 27393

SEQ ID NO: 58925 - DNA, 601 bp, Human
atgtcatgaaaactgagctgtagctttaaggaagagtagtggttcatatgaaatgctgcggagtcccttaggagaatgtccagaaggatttgcaaaggaggtactaatgtgggctgaagcagtgagatggaacaggtgcagggaaactttgtttagtgggagcaaatgaggaaaaatgtcctttttgaattaaaaaataacaaaactgataaaagcatgtacaaaggaagtgaggaaaaaggaaaacatggaagttgcctctaattctactactttttttttttttttgagacgaagtctygctcttgccccctaggctggagtgcgatggcgcgatctcagcttactgcaacctccgctgtctgggttcaagtgattctgctgcttcagccccctgagtaactgggactacaggcacctgccaccatgcctggctaagttttgtatttttagtagagatggggtttcaccatgttggccaggctggtctcaaactcctaacctagtgatctgcccgcctaggcctcccaaagtgctgggattacaggtgtgagccactgtgcctggcctaattctactactttaacacagttcttgaagt

SEQ ID NO: 58926 - DNA, 601 bp, Human
tctactattgagggcttcttaagttttttgcacatttagagatactgcaagcaatgctgttactgtgcatgtatcctgatacatattggcacaagtttctctgtggtttatatctaggactggaattgccaagttggaggataatgcacctctttatgttattagataatgccaaaatgttttccaaagacccttgactgacttatactcccgcaaacccaataagtgaatgcctgttgggcatcgtaattttcatctatcagaagggtgtgcagtggtagcttgtggtttaaacttgcayttgtcaggccattaataaagttgagcaccttttcgtatgtttattgaacatctaggtatccccatctgcgaagtgaatcttgaagatttttctcttgtatctattggattcttttattgatttgtagaagttatatattttagatagaaatcctttgctaattgtatgtacttcaaaatctttcacatgtggcttttttttaaccttcatagcttcttttgatgaacagaaattcttaattttagtgtagtcagatgtatcaatcttttcttttatgtttagtatttttttagcctgttt

SEQ ID NO: 58927 - DNA, 601 bp, Human
aagtttctctgtggtttatatctaggactggaattgccaagttggaggataatgcacctctttatgttattagataatgccaaaatgttttccaaagacccttgactgacttatactcccgcaaacccaataagtgaatgcctgttgggcatcgtaattttcatctatcagaagggtgtgcagtggtagcttgtggtttaaacttgcatttgtcaggccattaataaagttgagcaccttttcgtatgtttattgaacatctaggtatccccatctgcgaagtgaatcttgaagatttttgtcttgtatctattggattcttttattgatttgtagaagttatatattttagatagaaatcctttgctaattgtatgtacttcaaaatctttcacatgtggcttttttttaaccttcatagcttcttttgatgaacagaaattcttaattttagtgtagtcagatgtatcaatcttttcttttatgtttagtatttttttagcctgtttaagaaatctttccctcctaagagattatgatgaagacatcttcctatattttcttttaaaaaagcctacttattttgccattcacatttcga

SEQ ID NO: 58928 - DNA, 601 bp, Human
gccaacactcctgactaaatattttattttttatttgtaaagacagagtcttgctatgttgtccagtctggtcttgaactcctgtcctcaaatgatctacccaccttggcctcccaaagtgctgggattacaggtgtgagccactgcacctgggtcctttgctctgatttttatttcttttcttcttcctttgaatttaatttgctctttttaaaatttcctgacatagaacgtagatgattgatttatgaaggggtggcctgcccctccacacctgtgggtatttctagtcgggtgggayaagagactgagaaaagaaagaagacacagagacaaagtatagagaaacaacagtgggcccaggggaccggcatcagcataccaaggacctgcaccagcaccggcctctgagttccctcagtttttattattattttcattatttcagcaaaaaggaatgtagtaggagagcagggtgataataaggagaaggtcagcaaaaaacatgtgagcaaaagaatctatatcataattaggtttaagggaaggtactatgcctggatgtgcacgtaatccagatttatgtttctctccacccaaa

SEQ ID NO: 58929 - DNA, 601 bp, Human
ccaacactcctgactaaatattttattttttatttgtaaagacagagtcttgctatgttgtccagtctggtcttgaactcctgtcctcaaatgatctacccaccttggcctcccaaagtgctgggattacaggtgtgagccactgcacctgggtcctttgctctgatttttatttcttttcttcttcctttgaatttaatttgctctttttaaaatttcctgacatagaacgtagatgattgatttatgaaggggtggcctgcccctccacacctgtgggtatttctagtcgggtgggacragagactgagaaaagaaagaagacacagagacaaagtatagagaaacaacagtgggcccaggggaccggcatcagcataccaaggacctgcaccagcaccggcctctgagttccctcagtttttattattattttcattatttcagcaaaaaggaatgtagtaggagagcagggtgataataaggagaaggtcagcaaaaaacatgtgagcaaaagaatctatatcataattaggtttaagggaaggtactatgcctggatgtgcacgtaatccagatttatgtttctctccacccaaac

SEQ ID NO: 58930 - DNA, 601 bp, Human
tttcttgtacacaacatatagttgggtcttgttttgtgatgcactctgacaatgtcttaagttagtgtatttagactgttgaccttcatttttaaaatttatttaatttttggctgggtgtggtggctcacgcctgtaatcctggcactatgggaggccaaggtgggcagatcatgagttcaggagattgagaccatcctggctaacatgatgaaacctcgtctctactaaaagtacaaaatattagccaggtgtggtggtgggcacctatagtcccagctactcgggaggctgaggcacragaatggcgtgaacccgggaggcggaggttgcagtgagccgagatcacaccactgcactccagcctgggcaacagagcgagactctgtctcaaaaaaaaaaaaaaaattacttatttctttagagacaggatctccccatttcccaggatagagtgcaatgatacaatcatagctcactgctgtctcaaattcttgggctcaagagatccttttgcctcagtctcccaatgtgctgggattatatgcatgtaggagccgaacgcgaagcgaagttccgttaagaaccgctaaatagggta

SEQ ID NO: 58931 - DNA, 509 bp, Human
ccagcctgggcaacagagcgagactctgtctcaaaaaaaaaaaaaaaattacttatttctttagagacaggatctccccatttcccaggatagagtgcaatgatacaatcatagctcactgctgtctcaaattcttgggctcaagagatccttttgcctcagtctcccaatgtgctgggattatatgcatgaggcaccacatctaaccrtgtgtgtgtgtgtgtgtgtgtgtgtgtgtgtgtgtgtgtgtgtgtgtgtgtttttgagatgaagtcttactctgtagcccagactggagtgcagtggcgcaatcttggctcactgcgacctccccctcctgggttcaagcaattctgcctcagcctcctatgtagctgagattacaggtgcccaccaccacacctggctaatttttgtatttttagtagagacgggatttcaccatgttggccaggctggtctctaactcctgacctcaggtgatctgcccacctcgacctcccaaagtg

SEQ ID NO: 58932 - DNA, 601 bp, Human
agtttgcaatatacattcttttttttgagatggagtcttgttctgtcacccaggctggaatgcagtggcatgatctctcctcactgcagcctccacctcccgagttcaacagatcctcctgcctcaacctccatagtagctgggattacaggcatgcgtgctaccatgcctggctaatggtctgcatttttagtagagatagggttttgccatgttggccaggctggtctcaaactcctgaccttaagtaatccacctgccttggcctcccaaagtgctaggattacaggcatgagccacyatgcccagcctacatttataaataatccaaccctactttcaaataatactgtgccacttcatgtgtagtgcaagtaccttataataaaatatttctcattttttcctccagtccttagtatcactgttgtcattcatttcacttatatgtaagctataatcataaaatacattgttattatcattatttttttgagacagagtctcgctctgttgcccaggctggagtgcagtggcacgatcttggctcactgcaacctctgcctcccgggtccaagcgattctcctatcagcctcctga

SEQ ID NO: 58933 - DNA, 601 bp, Human
cattgaaggcattctttattttcattacaggaattcttttgagatggagtctcgctctgtcacccaggctggagtgcagtggcgcgatctcagcttactgcaagctccacctcccgggttcacgccattctcctgcctcagcctcccgagtagctgggactacaggcagtcgctaccacgcccggctaattttttgtatttttagtagagacgggtttcactgtgttagccaggatggtcttgatctcctgaccttgtgatctgccagcctccacctcccaaagtgctgggattacaggcrtgagccactgcacctggcccattacaggaatttttatttctagtatttccttttgattctttcttaaaattttcatttatctccttacattatccatctcatcttgcatcttgtatactttttcccagtaaaactgttagcatattaatcatagtttcttaagttcctggactgataattccaacattcctaccgtatctgtctcagattctgatgcttgttcagtctgttcaaacttttttttttttgccatttagtatacctcataattttacattgaagggtggacatgatgtactg

SEQ ID NO: 58934 - DNA, 601 bp, Human
tatcatttcaaatgtgtatcatttctatgtgataagagcattcaaaacttctctcttctattttgaaagatacattattattagctataatcaccttaccatgcaagagaacacctgagcttattcttcatatctaacaataacatcttacctgtccaacaccccctttgttttaagacagggtgacattctgttgcctgaattcctgggttcaagcagtccttccaggtcactctgtcaagtagctagaagtacagatgcacagtaccgtgcctaagttttaattttttttttttttttkgggtaaagacaggggtctcactttgtcactatgttgtttaggctggtctcaaactctaggactcaagtgatcctccagcctcagcctcccaaagttggattacaggcatgagccaccacacccggccccaacagctttctatttttttttaatgtccaggttcacttggtatatttcagttcccagtaagtttccttgaagcatttctagatgaagcctttatttattggagtggatttttaaatcttatctctggtcttttatacaatttttaccctaagtataatgaacttgctcttg

SEQ ID NO: 58935 - DNA, 601 bp, Human
aagagcattcaaaacttctctcttctattttgaaagatacattattattagctataatcaccttaccatgcaagagaacacctgagcttattcttcatatctaacaataacatcttacctgtccaacaccccctttgttttaagacagggtgacattctgttgcctgaattcctgggttcaagcagtccttccaggtcactctgtcaagtagctagaagtacagatgcacagtaccgtgcctaagttttaatttttttttttttttttgggtaaagacaggggtctcactttgtcactatrttgtttaggctggtctcaaactctaggactcaagtgatcctccagcctcagcctcccaaagttggattacaggcatgagccaccacacccggccccaacagctttctatttttttttaatgtccaggttcacttggtatatttcagttcccagtaagtttccttgaagcatttctagatgaagcctttatttattggagtggatttttaaatcttatctctggtcttttatacaatttttaccctaagtataatgaacttgctcttgtgtcttatatcaatattttcttctgtgttctct

SEQ ID NO: 58936 - DNA, 601 bp, Human
tactcagttcacatctacagagttcttatttaggtactcagtagatacagaattggtttaaagaagaggcaagaaaggaatttaatgttttatctgcattgacacaattattttaaaagctgtttcactgcctccccatcttgatctttcatgtattttgtatacctaccatataggtacagatcttgatccattattgagatatgaattaaatatttcatcaaagaaacagtctatttacctttccttaaaagcttactgtgagagcaataacagataacatttttcccaaagtgccaaygtatgtttgactgaaatgacaaatgcgtttttagatgttattgggaattttaagcttatgtaaaagttataagaatagtacaaagaatgttcacattcacctttgcttgtacacatttgccttatcatttggcatatgatttttcttctgaaacatttgagaataagttctatatattatggccttttacctctatacacttaagtgtagatttcctaataagaatttcctaaagatacaatttttttttttttttgagacagactctcgctctgtcacccaggttggagtgcagtggcg

SEQ ID NO: 58937 - DNA, 601 bp, Human
tttccttaaaagcttactgtgagagcaataacagataacatttttcccaaagtgccaacgtatgtttgactgaaatgacaaatgcgtttttagatgttattgggaattttaagcttatgtaaaagttataagaatagtacaaagaatgttcacattcacctttgcttgtacacatttgccttatcatttggcatatgatttttcttctgaaacatttgagaataagttctatatattatggccttttacctctatacacttaagtgtagatttcctaataagaatttcctaaagatacaatttttttttttttttgagacagactctcgctctgtcacccaggttggagtgcagtggcgcaatctcggttcaccgcaacctctgcctcccaggttcaaatgattctcctgcctcagcctcctgagtacctgggactacaggtgcatgccaccacgcctggctaattttttgtattcttagtagagacggggtttcactgtgttagccaggctggtctcgatctcctgacctcatgatctgcccgccttggcctcccaaagtgctgagattacaggcgtgagccactgcgcccggccaagag

SEQ ID NO: 58938 - DNA, 601 bp, Human
cacattcacctttgcttgtacacatttgccttatcatttggcatatgatttttcttctgaaacatttgagaataagttctatatattatggccttttacctctatacacttaagtgtagatttcctaataagaatttcctaaagatacaatttttttttttttttgagacagactctcgctctgtcacccaggttggagtgcagtggcgcaatctcggttcaccgcaacctctgcctcccaggttcaaatgattctcctgcctcagcctcctgagtacctgggactacaggtgcatgccaycacgcctggctaattttttgtattcttagtagagacggggtttcactgtgttagccaggctggtctcgatctcctgacctcatgatctgcccgccttggcctcccaaagtgctgagattacaggcgtgagccactgcgcccggccaagagtatgaatgtatttttaaggagacacttcatattatttcaaaattctgttccaatttaaaaatgatgaagtccctcgttaaaattcagcatggagaaaattagggcttatatttgtcaaacacatttgatattaagacactttatttttct

SEQ ID NO: 58939 - DNA, 601 bp, Human; identical to SEQ ID NO: 27392

SEQ ID NO: 58940 - DNA, 601 bp, Human; identical to SEQ ID NO: 27391

SEQ ID NO: 58941 - DNA, 601 bp, Human; identical to SEQ ID NO: 27390

SEQ ID NO: 58942 - DNA, 601 bp, Human; identical to SEQ ID NO: 27389

SEQ ID NO: 58943 - DNA, 601 bp, Human
gcgcctgcctgggatgcagctccgtggctaagtagggatccccagtgactggccccaaatatcccctaagactgaccctcgttctgcagcccctcaactcgaaccgagctgcccacctttcccgggggtcggaggggcaggacgtagcgcaagcccatgtcggggttacagcttccaacccactgagttaagcaataaaacggtctgctgtcctgaccccgcccccacagggcccgcgggggagcccgcgtacgccccccagttttctcgtccccagccgcactccagctggtccttctcyaggcagatccggaggcggccgccgatctctccggcgctctcccctccgcctaaggggcagcagggtcccgggaggcccgccgctcaggttgaacccagggcggcccaggaagcggcgctgccaccgcacgccatatggagaggtggccaggggcggaagaaaagggaaaatcgatccggagcaagcagccccgagccggggtctcagccccagcctgaagaccaccgcccccgagcacagcccacgcggggatggttgcaacagccgcagggtggcctggaccacggacccccaaggaga

SEQ ID NO: 58944 - DNA, 601 bp, Human
aggatgcctttggctgaaaaaaaaaacttcagtcggctctataaactaccccccttttaagtttaaaaaagggaatgaatgttaccatttttggacatgagcgttctccctcaagcccagccctaaccgcactatccaaagggacgcgccatcctgtcccccccccacccaaaaccccattcccagatcagcctgggggtggggagggtatgaaacggggagggaccggatggaagtgggcagccgggaggagggggagggaaaggggtattcagggtacgtggccgcctgggggcacagrctcaccgcgcaggcaggaagcagcggtagggttgaggcgccctccccccaccaccacgagtggtttctgacctcttcctgccactggccactgtgcccgggtcccatcgccagctccgagcccagctcccgtggcggggcgcgcacccggcacaccgcgcctgcctgggatgcagctccgtggctaagtagggatccccagtgactggccccaaatatcccctaagactgaccctcgttctgcagcccctcaactcgaaccgagctgcccacctttcccgggggtcggaggggcaggacg

SEQ ID NO: 58945 - DNA, 601 bp, Human
gccttgggcaccgcggcccaggtcatcctgctttgaggaagcccattgtgtgtgttttagattacctctgcctgtctgatgaagtgagtaaaagggctccgtttcagggcctaggattcctgagtgagctaatacaggatgcctttggctgaaaaaaaaaacttcagtcggctctataaactaccccccttttaagtttaaaaaagggaatgaatgttaccatttttggacatgagcgttctccctcaagcccagccctaaccgcactatccaaagggacgcgccatcctgtcccccccccacccaaaaccccattcccagatcagcctgggggtggggagggtatgaaacggggagggaccggatggaagtgggcagccgggaggagggggagggaaaggggtattcagggtacgtggccgcctgggggcacaggctcaccgcgcaggcaggaagcagcggtagggttgaggcgccctccccccaccaccacgagtggtttctgacctcttcctgccactggccactgtgcccgggtcccatcgccagctccgagcccagctcccgtggcggggcgcgcacccggcacaccgcgcctgcc

SEQ ID NO: 58946 - DNA, 601 bp, Human
aggtgctccctaagcagggatttctccttcgattctaacccccagggaagaccccaatccaccaccctaatctcacttctaatttaaaatccattctcaagaaggcttcaccctgaaattattaaagagccttctgcctggtgccccatagggatctccaaattactcactcacttttcagttccacccacagcacccatggtcccaggaaataagccaagtgagtgggggactgtctgcagcccccagtcttcagctcttactaggaagatgacaggaagagggggagtttaagcaactrgcacattacaaagaagtcagttcgaagtcaggggaccttcccatgtccgatgtagatgaccgatgtcgctgtatagggcccagccctgcataggccttgggcaccgcggcccaggtcatcctgctttgaggaagcccattgtgtgtgttttagattacctctgcctgtctgatgaagtgagtaaaagggctccgtttcagggcctaggattcctgagtgagctaatacaggatgcctttggctgaaaaaaaaaacttcagtcggctctataaactaccccccttttaagtttaaaaaagg

SEQ ID NO: 58947 - DNA, 601 bp, Human
gcctcggccaagccagtgcagcttcttgagtcatgcctcctgcctgcacagacttctccctgcctccacatcaggccatactttcaccaaggaagcacttctcaatgcatcatttaacctgattccccagaagagtcctgagggctccacgggcagaaatgtgtcccatttacagaggaggaaacctaatggaaatgccacaagaacgggaacttggtctgtcttgctcagtgccccatccctaatacctggaactgtgtctgacccagaatgagtgctcacaaagtatttgctgaatgayctaataaaagctcgatgaaatggaaagacttgcccaaagtctcagaaatagctatggctgcaccaaagctaaaaagagggtcttctgccttctaccgggtgacctttgtatccctctacactgtgtcctcctcttcccctcctcacactcactcccctgcctccctctggaaccatcagcctctgtccacttgtggactctggtcccacacaaaccccgcctcccagtcagtagaaagagtgtcaaaagcaacacgtttaccttacgtcttatccctcacctgtaataccacctccttaa

SEQ ID NO: 58948 - DNA, 601 bp, Human
aacccacaggcccctctagcagagacatgggcctaccaacatctctctatgcactctaaagagggcataaaagcagggccagtggggaaggtaccctttggctccataccaagtccaggaaaaccacaggtgggttacacatggaggcagctcaggtggggttaactggctgggatgatcccaacaatatctgtagagaggtgtggacttgagaatctggtctgtgacctgtccagatggcctggccgtctctcgcagaaaggtgagaggtcagctctgggaggggcaaaacaaatggaaragaacaatgaagctaggcatagtggctcatgcctgtaatcccagcactttgggaggctggggcaggaggatcacttgaggccaagagcctgggcaacatagcaaaacccccatctctataaaacataaatttaaaaattttaaactataatagaagaatgataagggagaatgggagggggtgctccccagcatggatagtcactgttgctctgctctgccctttcaggcatctcccctctccccacctctgtcctacaacatcacacacacacacacacacacacgtggctgaaatgcc

SEQ ID NO: 58949 - DNA, 601 bp, Human
aaggggttccagggtggctctgagccctagtttgctgtgtctcctgtccctactactcctaaggctccttgtctcagtcagagccaggtttggccaaacagtacttaggaggccactggcaccggcactgtgggagatggagccagaaccccgggctaaattgaatcctgagtcctgtgggggctgacccatctgccagaactaaggaagcaggctcagcgggtttcctctgtgcctggcctctctgccatgacctctctggggaggtgcagactagaaccgcccaaaccatctcagctggtgggttccaggaccccaccactgtccatggcgagtaactcagcccaacccacaggcccctctagcagagacatgggcctaccaacatctctctatgcactctaaagagggcataaaagcagggccagtggggaaggtaccctttggctccataccaagtccaggaaaaccacaggtgggttacacatggaggcagctcaggtggggttaactggctgggatgatcccaacaatatctgtagagaggtgtggacttgagaatctggtctgtgacctgtccagatggcctggccgtctctcg

SEQ ID NO: 58950 - DNA, 601 bp, Human
ctcgtgagagtgagttctcacaagatacaatggttttatatggggcttttccccaccttcgctctgcacttctccatcctgcagccatgtgaagaaggacatgtttgcttccccttccgccatgattttaagtttcctgaggcctccatgctgaactgtgagtcaattaaacttctttgctttataaattacccagtcttgggtatgtctttattagaagcatgagaatggacaaatacagaaaccttggtcatgcatgaagagggaggaagaaggggttccagggtggctctgagccctrgtttgctgtgtctcctgtccctactactcctaaggctccttgtctcagtcagagccaggtttggccaaacagtacttaggaggccactggcaccggcactgtgggagatggagccagaaccccgggctaaattgaatcctgagtcctgtgggggctgacccatctgccagaactaaggaagcaggctcagcgggtttcctctgtgcctggcctctctgccatgacctctctggggaggtgcagactagaaccgcccaaaccatctcagctggtgggttccaggaccccaccactgtccat

SEQ ID NO: 58951 - DNA, 601 bp, Human
ttggctgtgtccccacccaaacgtcatcttgaattgtagttcccataatccccacatgtcgtgggagggacccggtgggaggtaattgaatcatgggggtggttacccacatgctgttctcgtgagagtgagttctcacaagatacaatggttttatatggggcttttccccaccttcgctctgcacttctccatcctgcagccatgtgaagaaggacatgtttgcttccccttccgccatgattttaagtttcctgaggcctccatgctgaactgtgagtcaattaaacttctttgcttyataaattacccagtcttgggtatgtctttattagaagcatgagaatggacaaatacagaaaccttggtcatgcatgaagagggaggaagaaggggttccagggtggctctgagccctagtttgctgtgtctcctgtccctactactcctaaggctccttgtctcagtcagagccaggtttggccaaacagtacttaggaggccactggcaccggcactgtgggagatggagccagaaccccgggctaaattgaatcctgagtcctgtgggggctgacccatctgccagaactaaggaagc

SEQ ID NO: 58952 - DNA, 601 bp, Human
tccccccatctgctgagaagagaaggattcctgggagcctggacttgatgcccagcctggggataggtgggaaactgatagggtttggctgtgtccccacccaaacgtcatcttgaattgtagttcccataatccccacatgtcgtgggagggacccggtgggaggtaattgaatcatgggggtggttacccacatgctgttctcgtgagagtgagttctcacaagatacaatggttttatatggggcttttccccaccttcgctctgcacttctccatcctgcagccatgtgaagaaggmcatgtttgcttccccttccgccatgattttaagtttcctgaggcctccatgctgaactgtgagtcaattaaacttctttgctttataaattacccagtcttgggtatgtctttattagaagcatgagaatggacaaatacagaaaccttggtcatgcatgaagagggaggaagaaggggttccagggtggctctgagccctagtttgctgtgtctcctgtccctactactcctaaggctccttgtctcagtcagagccaggtttggccaaacagtacttaggaggccactggcaccggca

SEQ ID NO: 58953 - DNA, 601 bp, Human
aggacagacagaacaggtgaaactgaaggaaccaaaacaagagagaaggggagggtgctgctgaatcttaaagcaggggaagctagctcccaaaagctggggtcagcaccagaagaggccaccaggaacgtgggactggggaggcctccaggttcaggggatttgagtctattcctgacagttactgcttcaactgaaaaacacagagaaatacaacttgcatccttcactacctttaaaaccaagaaaagtaccttcactgaggcctatgtccatccccttaaacctcacagaccctccygtcaaagacctggattgaaaaccaactctacttccaggctacggaaagcctggtaaagtcgcttaacctttctgagccttactttccctgcatgtaaaatggggataagacctcacaagtttgctcaccatgattactgaagagaaagccacacatggaagcacaaatgttaaaaatgcgccacaatgagttgttctcttatttcaattccatataagccttgcctcccaattcaaacataaactccttaatagcaaagagtgtgtctgtacttctggttaaaagccgagttctgaggtc

SEQ ID NO: 58954 - DNA, 601 bp, Human
tcaacagccccacgatcacccaccaccaagaaacaggaaaaacaaggtaacagagaggaggctcccttcccccagccgactgctctttggcctggagctgaacatttggggcctctgatttaggcctggaaggttcaaagctgggggtcaggaaatggcactgccccccacttggtgctgatctctgacctggcacaaaaactccccagccctgtaacaccaaaagccaacctaagtcccccactccctcatcaactttctaaatcgtctcaaggcttaaacaagaacctcaaacgttacrggtttcacgtgcacaggcttttaaaatcaaaataaacctgagcctcggctgcctggttcaaagcctgtttggttcccgtggtgaccacaaaggaagagactctctaaacaaagggaaggacagacagaacaggtgaaactgaaggaaccaaaacaagagagaaggggagggtgctgctgaatcttaaagcaggggaagctagctcccaaaagctggggtcagcaccagaagaggccaccaggaacgtgggactggggaggcctccaggttcaggggatttgagtctattcctgacagtta

SEQ ID NO: 58955 - DNA, 601 bp, Human
gaaccagtggcttctggggaaaaggcatcaggtacaggccccccagccaggcacctttgggtgctactgtggcctccttgcccatgccaagcagactcagtgagggggtggcacacgggcccactatataactgagaccccaatgtggcattccttaaagaaactatacacaatgaacctctaaatataagaaaagagagaaagaggaaaaagaagaagagaaaaagaaagctacaaagcaaaacttcatttggagctaaagttgggaaaatatgcagatttctaataagaggcctcaggrcttcatgcatgcaaaaacacctccatgcagccccagccaccagtatccgagatgaaggacaggaaaccaggggtctggccccatttccctgcctccaggaaaacacaattcataagccacctcctgcatctcccagctcccagggccaagtctggaaaagcactttgggttcctggaaagaaaggcccttacaaaatatcgggaactcgactggaaagcgccattatctattatctggaggatgtctgcggagtttaaaagggagccactcctctgccaaggtcaaggaggtggccaaaa

SEQ ID NO: 58956 - DNA, 601 bp, Human
cctaggaatggtcctggcggagtggggctcatcgtggctccccacatctggcctcttccaaaactctacatgcagcccaagcctcatatccagagcagtctcttgtcttgcagagcacagccagcttccaaatggcacaagaggctgctgagccataaaatataaactcatttagaagcattcccaaattcacgcaccttttcgtcatgacacatttgctttatcaagaagtaataaaagcacaactactaccctgggaggtgaaaaaaatggcaacgtggcataggtccctaggaacctraatctcaagcccaggaaaagagggcagcaggcaagggaccagggacccataggtacggacaccagatgccacacacacgtgtgggtggaaagagagtaagatactgagactgacgtctcctgccctccctcatcaaacatcagcaagtctttgaacactggcggggtgcagggtggcaggtgtaacatacgaacgccaccgcagaggcaggaagccgggttcagtcccacctgccacctacaagttgctgtgtgacctgggcaagtgctttggaactcagcagtctcagccacaaaacag

SEQ ID NO: 58957 - DNA, 601 bp, Human
aatacctagtatgtgcaagcttgattcgtgcttacctgctctttggggtgctgggatgagctcatcagggagctcctgaaagtccattactagggggaccccaggagactccacaaatccacctttgatcatccaaggagcctcagatcagttacagatcagtgacatcccctgagaatcctctaaatgtctttagagaggagtttcacaacagtgccccaagaaagtgtaatgaaggcaggcaggctgccacatatctgtcctttctgactctcctagcccaggtactaactgggcaagkcaatggccgagtggctgagagccagaagataagaaggcaagaggagggaaatcagacagggacaaaggccactcaactgggaccccacttgttgtccttgaagcctaggaatggtcctggcggagtggggctcatcgtggctccccacatctggcctcttccaaaactctacatgcagcccaagcctcatatccagagcagtctcttgtcttgcagagcacagccagcttccaaatggcacaagaggctgctgagccataaaatataaactcatttagaagcattcccaaattcacgcac

SEQ ID NO: 58958 - DNA, 601 bp, Human
cgctgagcagcatggcaggggctgaggtcatcctaggctatgaccccatcccaatgacaaggccagcttccctggcccctgtcctccttctgattccaggacacacctcttagtcctgaggagccaactgggcctctgccctggtcccagcaatcaacctcatctctggggtggtccttggtgactcagactaccaccacccaggccctcagcatctgtcagttgtctcctgcaggactacagctgccacactcctgtccaaaggccctcaccaccactgttcatcaacactggatactcrgtgaatacctagtatgtgcaagcttgattcgtgcttacctgctctttggggtgctgggatgagctcatcagggagctcctgaaagtccattactagggggaccccaggagactccacaaatccacctttgatcatccaaggagcctcagatcagttacagatcagtgacatcccctgagaatcctctaaatgtctttagagaggagtttcacaacagtgccccaagaaagtgtaatgaaggcaggcaggctgccacatatctgtcctttctgactctcctagcccaggtactaactgggc

SEQ ID NO: 58959 - DNA, 601 bp, Human
aaacgcagctaggctggctggtagggagctgggaggtctgtgccagttccaaccagcctaccattggacgcaccagctcagagaggggcgctgagcagcatggcaggggctgaggtcatcctaggctatgaccccatcccaatgacaaggccagcttccctggcccctgtcctccttctgattccaggacacacctcttagtcctgaggagccaactgggcctctgccctggtcccagcaatcaacctcatctctggggtggtccttggtgactcagactaccaccacccaggccctcagsatctgtcagttgtctcctgcaggactacagctgccacactcctgtccaaaggccctcaccaccactgttcatcaacactggatactcagtgaatacctagtatgtgcaagcttgattcgtgcttacctgctctttggggtgctgggatgagctcatcagggagctcctgaaagtccattactagggggaccccaggagactccacaaatccacctttgatcatccaaggagcctcagatcagttacagatcagtgacatcccctgagaatcctctaaatgtctttagagaggagtttcac

SEQ ID NO: 58960 - DNA, 601 bp, Human
gctgaggccccacagttatctagatccacacccctcgggatactgtggctaaagacagtgggctgctgacgtccaacactccagagagaaccctcagcagagggactggaaggagaaggaaaaccaagacccaggttttacttcctttaaggtccacaaacccacacaaaaggaccagaaattccctgtgattttctgaagcagggctcagccaaatgcaataaccccaccctccagagaggaaggggcaggatgaagagggacatgtcagtatggccagcaccttggaatctgatgggcwgttagccaaagaaaaaacgcagctaggctggctggtagggagctgggaggtctgtgccagttccaaccagcctaccattggacgcaccagctcagagaggggcgctgagcagcatggcaggggctgaggtcatcctaggctatgaccccatcccaatgacaaggccagcttccctggcccctgtcctccttctgattccaggacacacctcttagtcctgaggagccaactgggcctctgccctggtcccagcaatcaacctcatctctggggtggtccttggtgactcagactaccacc

SEQ ID NO: 58961 - DNA, 601 bp, Human
tgggtgacagagcgagaccctgtctcaaaaaataaaaaagtaactaattttgtttttaaaaaaagaagtgcttaactctgctgagtgtccaagagggcagaaacacagaatgttggcatcaccgcagaccccagagatcatctgcatgtgataatccaagtacagcctttagaacagagccccaccaccatcctaccatccaatttctcggtttataggtggtttcaggtgtgacttatccagcatcacaaagtggccacaggcagcactaggacaagacctcgggtctcctgaggccccrgtacctaacacacaaccattcttcctgttcctgggggacaagataggtttctgccaaacaactctctggcctaataaatcaaagaagacagtcttttcacacctatccccactcccaaatgccactcccaaagtcccaacagaaagggagcaggaggcaggtgaaagctttgctgaggccccacagttatctagatccacacccctcgggatactgtggctaaagacagtgggctgctgacgtccaacactccagagagaaccctcagcagagggactggaaggagaaggaaaaccaaga

SEQ ID NO: 58962 - DNA, 601 bp, Human
ctcctcaaagctgaagacacagagggctcctaaagaagctgtgttcgccgaatagttaacttcagggccaggctacaaagcccaggagtcaactgcaaggtcacctttagaagtgcctgactcggatgagtatggtggttcatgcctgtaatcccagcactttgggaggccgaggcaggagatcgtttaagcccaggagtttgagaccagcctgggtaacacagcaagaccctgtccctacaaaaaaaataaaattatctgggcatgacgacacactcctgtgggcccacctacttgggaractgaggtgggagactcaattgagcccaggaggtagaagctgcagtaagctgagatcatgccactgcactccagcctgggtgacagagcgagaccctgtctcaaaaaataaaaaagtaactaattttgtttttaaaaaaagaagtgcttaactctgctgagtgtccaagagggcagaaacacagaatgttggcatcaccgcagaccccagagatcatctgcatgtgataatccaagtacagcctttagaacagagccccaccaccatcctaccatccaatttctcggtttataggtggtt

SEQ ID NO: 58963 - DNA, 601 bp, Human
tcctggactgtggggagaaaagagcctttccaaccctgcctattccacctacacttgaaggcccccatgcacaggggcgtcatcaaaaggcagcaagcagctgcaggaagccaacagcatccctccaacttaaaggcaactttccctcaaaaaacaggagtcaagtaccctccattctacctgagccacccccacctccactgctcaacacagcacggggacttcagtctccacgaccagagaggggccacttccctggtgcacaggaatgtacgggtcaggagagaagtgtatggggccygggagggtggagactcagctccatctctcatgaggggcctcccttctccagtcagggctgacagctggtgcttgctaccagaaggaatgagctagcagagaggaagcaactaggacaggggttagcagtgtggactctggccaggcagccctgaaatcaaagcccaactgccccactaaaagctgtgagttgggagaaaatatttaatctctctaagcctcagttccttctgtaaagtgggactaaaaatgtcacagtaccttttcctcatagggcggctatgatgattccttggtataa

SEQ ID NO: 58964 - DNA, 601 bp, Human
gggtgaagcaagtaaggcaagcagaggctagaaacgcagtgttcccctgggtgttctgatgcatctcacaggccgccacacggggcacagggcgcgggggcacgggggtgggctataggccctatgtggatcctgagggaccagcccccagtgggtggtgccatggatttcacagggtcttggataaaaatggcttgtacactcaagtcacagctgtttgagattcttgcaatacccccgacatgttctgatcactccctcacaactgggcatctggggaggggcacagaaggaggaggcrggagccatgaccctggctggcctcagatgcctaggacttggtgggcaaactagttgctcctcatccctccagcaccagatcagaagccactccccacgggaagcattcctcatccacctccagaaactacccccacgcccgaccgacaggcattcacacccacccagcctgtacttctccttcacaagacaccctgaaagcttgccctcggcacccatctaccccctggaccacaagccctggcccagtacagctgtggctggtgtgcagcccacatcagctgagtggccggcagagaga

SEQ ID NO: 58965 - DNA, 601 bp, Human
tccgagtatgatcaaaaaacccagctcctggatattatccaaaaatgcaggaaaacatccacatgaaaggaatatttatagaggcattatctacgataggccaaaactggaaaccacggaagtgtccaataatggaagaattattagcagaggacatgccagcagccagggcgtgaggcagctggtaagggggacttgcccaggcccagccccgactgaccacactgtttccttcctgaagggcctcatcccagttctgtgggcagatcccaaactgcttctagaagacaactttggcctygacagccatccttctggaaagggagagtgggccaggctctcattttcataataaaaaagcagctttgcccttcacatgcttagcacccaaaacaaatattcaggttggtgcaaaattcccattacatttaatggcaaaacccgcgattacttttgcaccaacctattagctctcttttctgtgaagacctcagaaaacctctgaactcagagccaggagtccacacagcctgctctccagctcctgtcaaacaactgccacgacagagtctccaagaagtgctcaagagtatctcaaagg

SEQ ID NO: 58966 - DNA, 601 bp, Human
gctgagacattccagtggcttcccccttctctgccccaaggaaacatccccaaaccaagattctctctggtgaatcccatggttccaaagttctaatcatccacagcccctggaaattggaaaactgaaagctgtttgcaactatgtgtcagatgggctggccggaggatacacagctctaagaacatcgagcatctatcttgaaggcacatctctaacagagtctgtctgagagttccatgcatggtaagaggggtttggataagatgccatcatttaggcattcatcccctcttccccyaagagacacctgtgacctccagctgtggtccctgcccagatcccacccaactcaatgaaactgctagagtggcaggagagggggccttctgtgcatcagctcctatatgctgaacaatgactcggccatcaggtgtgccactgctgtgtgcacagtgcccagcacacctgccatgcccattctggcatttaaagccatccgggaactctttgatcagtcattacagttcctaaggactgaagcctcgctctctatttgaggtcaagtaattccacgaatggaccatcttcttcctgcccc

SEQ ID NO: 58967 - DNA, 601 bp, Human
agaacgatgaagaccctgtctcaaaaacaaaaaaaaagaggctgcacagtgggttacttctgtattcctagcactctgggaagcagagggagggggatcgcttaagtccaggagtttgagacccacctgggcaacatggtgagaccctgtctccattttcataaaaagtgaaaaacattaaagggggaaaaaatgtaaaggaattgagttcatttagctaaactctttccattcagactgaagcaataatattcctccagataatccttcatagggttatctagctttatctaaaaattargtagggcgcttgctggaaatgcagatttctgggctctaacagagcatttggttcaggaggtctggaaaaggcccaggaagctacagttttacacaaacctaggtggtccacgggccatcctataaggaatatagccttggagtgaacctctccacttgggtagcagagggtggacatacccaggggagctagaatatctacaaggaagttgtggtcacctgcagcgaatgatcactgaatacagcttaggcaggaggcccctcattgcatgacccacctccaatcctcatcgcaaaggaa

SEQ ID NO: 58968 - DNA, 601 bp, Human
gcctggcagtgcacaacacacactaaagatgctcaaagtgggtcattcaatctcacccagttgccatgactccttaagaaaagggacaagtgaccaggcacggtggctcacgcctgtaatcccagcactttgggaggccgaggcaggcagatcatgaggtcaggagttccagaccagcctggccaatatggtgaaaccccatctctactaaaaatacaaaaaaaaaaaaaaattagctaggcgtggtggcatgcgcctgtactcccagctactcgggaggctgaggcagaagaatcacctraacccaggaggtggagttgcagtgagccaagatcgcgccactgcactccagcctgggcgacacagcaagactctgtctcaaaaaaaaaaaaaagaaaagggacaagtgatagtagaaaaatatttgaagaggaatgatgcttcagatagaaattctctgacttgccataaaatttaaatactaattttttaaaataatgaatcctctagccttaacatagccatttgtatttttacatattatcttccttatttacactacttactacactatcttccttatttacagtacgatcaatta

SEQ ID NO: 58969 - DNA, 601 bp, Human
cctccaccaccagtgacgccaccaacccagaagggatggaaagggtttcctgagagggtcggggggatgatttcccatccctaggggcatctgccactggaacgcagccaacccacagggagtcagcctgcgcacccacccctgtccccaggggactctggagattcctggaagagcttatttcctggacttcagtttccaatctctagaaaacagggtgaataacagacatcttatttaactctgagctcactcacagctgtgatgatctgaaaatccctcttaggcaaactcaactctsctggtcttcctaggtttccccaatgccgggctggttgtttccctgtcctgaaagctctcctggtccttcttccagccccagctaaaggcccaaaccactccacccactccctaccctcagcctccatgtcccccactccatgcctgagccatgcatcagcctcagcactaatcagcgtgcccagcacagggacatcttatctccccagcaaagacacatatcctctgcccttaagctcagaggaccacatcttacactgtgcgtactccgcagagcctggcagtgcacaacacacactaa

SEQ ID NO: 58970 - DNA, 601 bp, Human
aacggggtgacgggcaggctcctccctgggccctgactccagggtgactcaggcgctggtttccccggaaggaagtgagccagccgactctctttttccctttctaggaagacacaagggaatgacttggcccaatcccaggggcccagcctttttactcagactgttatggagaaaccaccccaccgtcctccactacaggagaggaagccagagtgaggagggagagaaagaggaaacagctcatcccacagaggaagatacagaaaaggggaggcacaatggacaagacagggccttstctttctaacctcaactcccaacataaatgcccaaggagggatgcatggaagctctgcaaccccacagacttgggctctggtcctgacgttcccgctgactagctgtgtgcccttgactccgtttccccaactctaacgtgaaggtgatgcaacatttgatatccaaggcccctttcagctctgaaactccaggctcctgtaaaagccgggtgatgggctgggactgaggaaggcctggagaagactggacgtggtcttggaacagggagagctttgggtgtggagactcgtgcctggta

SEQ ID NO: 58971 - DNA, 601 bp, Human
acccagacacaaaagaataaatgctatatgattccacttacatggggcccctagagtagtcaaattcatagaggcagaaagtagaatggaattatcaggactgggggtcaggaattgttcatgggtacagagtttcagttttacaagatgaaaagagttcagaagatggggctgggcgctgcggctcacacctgtaatcccagcactttgggaggctgaggtgggcggatcacaaggtcaggagttcgagaccagcctagccaacataatgaaaccccgtttctactgaaaatacaaaaaytagccaggcatagtggcaggtgcctgtaatcccagctactggggaggctgaggcagaagaatcacttgaacccgagaggaggaggttgcagtaagctgagattgtgccactgtactcccagtctgggtgacagagtgagttgttgtctcaaaaaaaaaaaaaaaaaaaaaaaaaagagttcaggagatggatgctggtgatggttacgcaacaacatacatgtacttaatgctgctgaactgtacgtacacttcaaaatggctaaaatggtaaatatcatattatgtatcttttaccata

SEQ ID NO: 58972 - DNA, 601 bp, Human
gagaaaccaaacatggtcatacatacaatggactatgattcagccttaaaaagggaggaaattctgacacatgctgcaacatggaccaaccttcaagacattctgctaagtgaaaataacccagacacaaaagaataaatgctatatgattccacttacatggggcccctagagtagtcaaattcatagaggcagaaagtagaatggaattatcaggactgggggtcaggaattgttcatgggtacagagtttcagttttacaagatgaaaagagttcagaagatggggctgggcgctgcrgctcacacctgtaatcccagcactttgggaggctgaggtgggcggatcacaaggtcaggagttcgagaccagcctagccaacataatgaaaccccgtttctactgaaaatacaaaaactagccaggcatagtggcaggtgcctgtaatcccagctactggggaggctgaggcagaagaatcacttgaacccgagaggaggaggttgcagtaagctgagattgtgccactgtactcccagtctgggtgacagagtgagttgttgtctcaaaaaaaaaaaaaaaaaaaaaaaaaagagttca

SEQ ID NO: 58973 - DNA, 601 bp, Human
atttgtacacccacattcacagcagcactgttcacaacggccaaaaggggggaacaacccaaatgtccatcaacagatgaacggagaaaccaaacatggtcatacatacaatggactatgattcagccttaaaaagggaggaaattctgacacatgctgcaacatggaccaaccttcaagacattctgctaagtgaaaataacccagacacaaaagaataaatgctatatgattccacttacatggggcccctagagtagtcaaattcatagaggcagaaagtagaatggaattatcaggrctgggggtcaggaattgttcatgggtacagagtttcagttttacaagatgaaaagagttcagaagatggggctgggcgctgcggctcacacctgtaatcccagcactttgggaggctgaggtgggcggatcacaaggtcaggagttcgagaccagcctagccaacataatgaaaccccgtttctactgaaaatacaaaaactagccaggcatagtggcaggtgcctgtaatcccagctactggggaggctgaggcagaagaatcacttgaacccgagaggaggaggttgcagtaagctga

SEQ ID NO: 58974 - DNA, 601 bp, Human
gaagggtggggacctggcccaaaaaggcccttctgcaccacaagattccaaaacttttcattagctctgcagctccacagtgtgccctcggggacccaaatggccaggccagccctagcctctgcagacagctactgtggcaggcctggcgctggcagggggaaggggtggtatccaaagccctctgctgacctgtcaacactgcccaggggacccaaggtgcctgagaagcacaaccagtaacagcataaaatatagcagtactactttctgagcatatacacaaaaaaattaaatgcarggactcaaacaggtatttgtacacccacattcacagcagcactgttcacaacggccaaaaggggggaacaacccaaatgtccatcaacagatgaacggagaaaccaaacatggtcatacatacaatggactatgattcagccttaaaaagggaggaaattctgacacatgctgcaacatggaccaaccttcaagacattctgctaagtgaaaataacccagacacaaaagaataaatgctatatgattccacttacatggggcccctagagtagtcaaattcatagaggcagaaagtaga

SEQ ID NO: 58975 - DNA, 601 bp, Human
ctagcgaggagctgctctggggcccaacttggtgaaagcaggcatcaggacaggagctcctgctctgttagcaagaaatagaattttcctccaaaggaagctaggaagttttgcattagtctctgtaattaacgggccaaaaatctttttcacactaaccctctgggagagcctcggagagaaaaacagcccaggacaggaagaactggaggcaggggtgggggaggtcataagaagaatgggcctctaggtcccaaagtaagctcggggtccccgtgcctccccagggctcccagaagcygcatcccccttccccaagtccaaaacacgaggaggtcaggaggaaggaagggtggggacctggcccaaaaaggcccttctgcaccacaagattccaaaacttttcattagctctgcagctccacagtgtgccctcggggacccaaatggccaggccagccctagcctctgcagacagctactgtggcaggcctggcgctggcagggggaaggggtggtatccaaagccctctgctgacctgtcaacactgcccaggggacccaaggtgcctgagaagcacaaccagtaacagcataaaat

SEQ ID NO: 58976 - DNA, 601 bp, Human
gctgtgcacagggctctagcgaggagctgctctggggcccaacttggtgaaagcaggcatcaggacaggagctcctgctctgttagcaagaaatagaattttcctccaaaggaagctaggaagttttgcattagtctctgtaattaacgggccaaaaatctttttcacactaaccctctgggagagcctcggagagaaaaacagcccaggacaggaagaactggaggcaggggtgggggaggtcataagaagaatgggcctctaggtcccaaagtaagctcggggtccccgtgcctccccrgggctcccagaagctgcatcccccttccccaagtccaaaacacgaggaggtcaggaggaaggaagggtggggacctggcccaaaaaggcccttctgcaccacaagattccaaaacttttcattagctctgcagctccacagtgtgccctcggggacccaaatggccaggccagccctagcctctgcagacagctactgtggcaggcctggcgctggcagggggaaggggtggtatccaaagccctctgctgacctgtcaacactgcccaggggacccaaggtgcctgagaagcacaacca

SEQ ID NO: 58977 - DNA, 601 bp, Human
gtgagcccacagagaccagtcagctgtgcacagggctctagcgaggagctgctctggggcccaacttggtgaaagcaggcatcaggacaggagctcctgctctgttagcaagaaatagaattttcctccaaaggaagctaggaagttttgcattagtctctgtaattaacgggccaaaaatctttttcacactaaccctctgggagagcctcggagagaaaaacagcccaggacaggaagaactggaggcaggggtgggggaggtcataagaagaatgggcctctaggtcccaaagtaagytcggggtccccgtgcctccccagggctcccagaagctgcatcccccttccccaagtccaaaacacgaggaggtcaggaggaaggaagggtggggacctggcccaaaaaggcccttctgcaccacaagattccaaaacttttcattagctctgcagctccacagtgtgccctcggggacccaaatggccaggccagccctagcctctgcagacagctactgtggcaggcctggcgctggcagggggaaggggtggtatccaaagccctctgctgacctgtcaacactgcccaggggaccca

SEQ ID NO: 58978 - DNA, 601 bp, Human
gggggtcaaagcagctcataatgaagctcgaaccagtgagcccacagagaccagtcagctgtgcacagggctctagcgaggagctgctctggggcccaacttggtgaaagcaggcatcaggacaggagctcctgctctgttagcaagaaatagaattttcctccaaaggaagctaggaagttttgcattagtctctgtaattaacgggccaaaaatctttttcacactaaccctctgggagagcctcggagagaaaaacagcccaggacaggaagaactggaggcaggggtgggggaggtsataagaagaatgggcctctaggtcccaaagtaagctcggggtccccgtgcctccccagggctcccagaagctgcatcccccttccccaagtccaaaacacgaggaggtcaggaggaaggaagggtggggacctggcccaaaaaggcccttctgcaccacaagattccaaaacttttcattagctctgcagctccacagtgtgccctcggggacccaaatggccaggccagccctagcctctgcagacagctactgtggcaggcctggcgctggcagggggaaggggtggtatccaaagcc

SEQ ID NO: 58979 - DNA, 601 bp, Human
cctggggaggaagcagtttccttctgcaggggaagctgctgccacccaaccagacaacctcacacgcagcctctcccaggggagtagggcttggatggacagaaagcacacagaggtcctaggaagttggccttctgcagggagtcccccccaggcccttccacttagcagaggcacaacggtgacaaaagctgacattcactgacacttacctacgcactttataacaatgaccccatttactcttcacaacaagcttattaagaagtagggttttctggctgggtgcggtgggctcacrcctataatcccagcactttggaaggccaaggtgggtggatcacctgaggtcaggagtccaagaccagcctgaccaacatggtggaacccccgtctctactaaaaatacaaaaattagccgggcatggtggcgagcgcctgtaatcccagctacttgggaggctgaggcaggagaatggcttgaacccgggaggcagaggttgcagtgagccgagattgcaccgctgcactccagcctgggcaaaacagcaagactccatcttaaaaaaaaaagaagtaaggttttctgatccctatttta

SEQ ID NO: 58980 - DNA, 601 bp, Human
gctaaaagcaccccttggcccatccacacacaaaataacaacacacttagggagcctaccaggtatgggatgccagcttgggtggtttacatccatcatctcatttagtctcggcaacaactctgcaagacagattgtctttttacagaggaagaaactgaggctcagaataaggaccagctcaaggacacagcaagtcagacagcagagcttgcctccacaccagtgctgctggctccaaagctgggttctccctaacactctgcagtctctgcaaggtgaagtcttctgcagggagggrccgaacacagaatgcagctccaagcagggttcccgttcctattccctcccccaagcctggacaggccggtcccaatcatcccacaggagaaaggggcatcctactgcatggaaagagaagctcttattttctgtccccaaatatgaggaatatggaggtcctggagcctatcatctaaaaagggaagtaggacccacctatgaaactgtcaaatagcaatccggagcagtgggagttctgagccacaatgcctggtgctggagtgaggggctccaaggaagggagtgcgaggtcagagaa

SEQ ID NO: 58981 - DNA, 601 bp, Human
gtaggtcaccctatgcgtgtgtgggtcaggtagctgtaggtcaccctatgcgtgtgtggagcaggtagctgtaggtcaccctacgcgtgtgtggggctgggcaacatggtgaaaccctgtctctactaaaaatacaaaattagctgggtgtggtggcacgtgcccataatcccagctactcaaaaggctaaggtaggagaatcgcttgaacccaggaggcggaggttgcagtgagcctattgcaccactacactccagcctgggcaacagagtaagactccggttcaaaaaaaaaaaaaaagaaagaaagaaagaaagaaaagaagaagaagaagaaaacaaacaaacagcaaaggccccagagaaaagagagtaaggtctgttcaaaaaactgaaaaaaaaaaagtcacagtgcaggagggaagaagagggtgccagagactggagatcaactagccacatgggtgttcgggttcctgcagctgttgtttctcctgagagcagtggaagtcaccgaagacattttattttagctgaaagaaacaaatggggctgtggcgggctgagttgggctgggagtgccaatcagatgctggttaca

SEQ ID NO: 58982 - DNA, 601 bp, Human
gggagcagaacttcctgcaggaacctacgcaacaggcaaaaaactctgtctctacaaaaaatttaaaaatgttagccaggcatgatggtgcacccctatagttccagctacccaggaggctgaggtgggaggatcaccccagcccagggaggtcgaggctgcagtgagccataatcataccactgcattccaacctgggagacagtgagaccccagctcaaaaaaaaaagaacttcctgcagggactgaggcattaacgggctgtatctataaactgccactccttacagaggagaggttwtctgcagagcatcaccatgattctcaacaccacccaggaggaagtttctggttccaagagagctgactggaggaggggagcagtcttggcacttggaggagagttcctcttcagctgcagctcaaaactaaaatgcatctctttacacctaatagacaggcaaacaattagaaagttgattacgccgaatgttggtggggttgagggatccggaagccctcgtgcccggctggtggagagtagactgtacagccattttagggggtaactcagcagcgtatcaggaaattccctgcaacc

SEQ ID NO: 58983 - DNA, 601 bp, Human
aagcatcacaagccaccacaagtcacagcagtgatttgcacccccggggtgggactggagcagacactcccagggagcagaacttcctgcaggaacctacgcaacaggcaaaaaactctgtctctacaaaaaatttaaaaatgttagccaggcatgatggtgcacccctatagttccagctacccaggaggctgaggtgggaggatcaccccagcccagggaggtcgaggctgcagtgagccataatcataccactgcattccaacctgggagacagtgagaccccagctcaaaaaaaaaagaacttcctgcagggactgaggcattaacgggctgtatctataaactgccactccttacagaggagaggttttctgcagagcatcaccatgattctcaacaccacccaggaggaagtttctggttccaagagagctgactggaggaggggagcagtcttggcacttggaggagagttcctcttcagctgcagctcaaaactaaaatgcatctctttacacctaatagacaggcaaacaattagaaagttgattacgccgaatgttggtggggttgagggatccggaagccctcgtgcccg

SEQ ID NO: 58984 - DNA, 601 bp, Human
agtacaagaaagacaagagaaagggtgctcatggaaaggcatgagacaaaaagaacgactccaggacccatggaattgcccttgtctactaaacggtcccaggtagcatcaagggatcatgggggacaccttggcacccagtgtgttccttcatctgggctagcaggatccagcaggcactgcaccccaacctctctgactcagtcaaaacttgatcaataggacctcagcactgatccagcccaaactccaagccaatgccacagcgccacccacctcctccctgagggacaaccacccrgcagcagccacatgactttgcaaaggaattctcaaagctccaggaaacccaagcccgcaggatgccagagataccaggggatgaggcaacaagttcagcaactgtggaagcatcacaagccaccacaagtcacagcagtgatttgcacccccggggtgggactggagcagacactcccagggagcagaacttcctgcaggaacctacgcaacaggcaaaaaactctgtctctacaaaaaatttaaaaatgttagccaggcatgatggtgcacccctatagttccagctacccaggaggct

SEQ ID NO: 58985 - DNA, 601 bp, Human
cagtttcctcatctgtaaaacagggataatacctttctcaactggtttggtaaggagtttcaatgagataatctatgcaaaaagcccagcacaccctaagtagttaatagtgtctagagttcattactaaagtacaagaaagacaagagaaagggtgctcatggaaaggcatgagacaaaaagaacgactccaggacccatggaattgcccttgtctactaaacggtcccaggtagcatcaagggatcatgggggacaccttggcacccagtgtgttccttcatctgggctagcaggatcsagcaggcactgcaccccaacctctctgactcagtcaaaacttgatcaataggacctcagcactgatccagcccaaactccaagccaatgccacagcgccacccacctcctccctgagggacaaccacccggcagcagccacatgactttgcaaaggaattctcaaagctccaggaaacccaagcccgcaggatgccagagataccaggggatgaggcaacaagttcagcaactgtggaagcatcacaagccaccacaagtcacagcagtgatttgcacccccggggtgggactggagcag

SEQ ID NO: 58986 - DNA, 601 bp, Human
tttctcttttaaactaaaatgttccaggaccccgctaagccttttatatcaagacgtggttttgtttttaacccatttggcccattggaaagaaaccaggctcaaagacaggccctggaccagagccctctcgggggactgatgtaattgagctagttcagctactgaacagtggctggtaagcctgctgagatgaggattactaaatgggcggagctggtcttcgaagcagagtggcacccgctccgggaggccagtgtgagaacagcctcctccccggtcctccggggttacagtttgrtcctgctgtaacccctcccccatgtctggagtctgattctggcccttgcaggtctgagagcacacaggcctcagcaggctgtagctcccagcagtggccagcacattccttccccaaagaaggaaaagccaccaaaagtgaggtcatttggtttttttggcacagatgctgagagctctgggtcactcaattccatagagaactcccccagctgacagggatttggcccagcctgctactcatacaatatgggaacccggggtctggcagactctggcccctaacttgacccctccatgt

SEQ ID NO: 58987 - DNA, 601 bp, Human
aagaagcagggggcctgcagctttttctgggaggcctaacaaaggcaccgtgcttgagagggctcctgggccaccatgagactctgatctggcctccctgccatccaaggccccccagaaggcagactgcccagctccttcttgcctggtacaggtggaacctatgggctcccaggagaaatcagagccactttaaaacaggtggacacacgatcctagtgaagaaacaggtctgtcctcttagctcctcgccaatgagagtcaactgcctcagccaatctgtcaccatccacagcctcamccctcccagggacccaagagcccaccccaactgccagccaccagctagctctgtccagtacttgcgactgggcctcccggagccttggttctcacatcagtaaagacttctgtgggccagaatgatgatggtgaaaatagtaataataaaataaagataaaatgagcctgcagcccataaagtagtcacgagggagggctatgtgagctagtgcaaagggctcagtctgctaccagacgcagaccaagcactcactagatgttaaaacacaaaagcacctaggaagaccgaaagcggctt

SEQ ID NO: 58988 - DNA, 601 bp, Human
cagagcaagaaagaagtcctgttgttttttttccccactgatgagagaactctgagacgggcctctggccaagaggaggagatggggaggggggagtggagcctgcatttcctggtttacacccatctacagcccatttcaaaagacatagcaccagacacccagagggtcaccagggccaagaagcagggggcctgcagctttttctgggaggcctaacaaaggcaccgtgcttgagagggctcctgggccaccatgagactctgatctggcctccctgccatccaaggccccccagaakgcagactgcccagctccttcttgcctggtacaggtggaacctatgggctcccaggagaaatcagagccactttaaaacaggtggacacacgatcctagtgaagaaacaggtctgtcctcttagctcctcgccaatgagagtcaactgcctcagccaatctgtcaccatccacagcctcacccctcccagggacccaagagcccaccccaactgccagccaccagctagctctgtccagtacttgcgactgggcctcccggagccttggttctcacatcagtaaagacttctgtgggccag

SEQ ID NO: 58989 - DNA, 601 bp, Human
acaggagatttaatcctagcctcaggatccctatctgtaaaatggggataacaaggcctacaatggcacagaatgaaagacgaccaaattagaccctatgtcctgaaagacttagcctggtgctgtgtccacaacagacacttaaacaatgttaacccagcaggtcctcaccactcactggctgtgtggctttagttaaactgtctaggtgtcaattgcctcaccttacaatggggataaagaacatcaccactttgtgaagattatgacaatggaagcaaaacagccagcaagatacccyggacacatcaggagcccagtcaatgtcagcggtcagcatgctctcacttcccatccactgtctatttaatcaaagttaatcattcacagagcaagaaagaagtcctgttgttttttttccccactgatgagagaactctgagacgggcctctggccaagaggaggagatggggaggggggagtggagcctgcatttcctggtttacacccatctacagcccatttcaaaagacatagcaccagacacccagagggtcaccagggccaagaagcagggggcctgcagctttttctgggagg

SEQ ID NO: 58990 - DNA, 601 bp, Human
ctgctgaaaaagctgacaaccaccaggcctctgctgagacctggcactgctctaacagcctgtccccaggacatgtgagtgctggggtcctggagattcagagtaggggggactgggggtgcaccttggactttggaacaagacagacctaggctccagtgccagcccacacctcacattacatctgtctgcttggacaggagatttaatcctagcctcaggatccctatctgtaaaatggggataacaaggcctacaatggcacagaatgaaagacgaccaaattagaccctatgtcctsaaagacttagcctggtgctgtgtccacaacagacacttaaacaatgttaacccagcaggtcctcaccactcactggctgtgtggctttagttaaactgtctaggtgtcaattgcctcaccttacaatggggataaagaacatcaccactttgtgaagattatgacaatggaagcaaaacagccagcaagataccctggacacatcaggagcccagtcaatgtcagcggtcagcatgctctcacttcccatccactgtctatttaatcaaagttaatcattcacagagcaagaaagaagtc

SEQ ID NO: 58991 - DNA, 601 bp, Human
actgggtaagataaagggctgtgctctggccaagtgaccccaggaaatcacccaaatgagcttctacacttcctgaaaatggtacacagcttcctatacaagccagcttctcgtctgatggtcgttcttctccctgagtagagcacccaggactctggtctaggctcatcgagtcaaaaacaaactcaccagcctccccaggcaagcaccctgccagcccaagccagccccctgctgtgtgggcggggtgtgtgaaccagcagggtccttggagaaggccaggccagcacctgtgctcagsgttgagtcccctgcagcatccactgatgttgaagacgttactgaggtgcagccagggggcgtgctggaatccctctgacccccatacaagtatggccagtctggccagggcgtgggccctgggtggtttgtctaagcaaagacctgcccagaagtgatctcagatgcccagtgttctggcatggtaaataggagtatctggctaacttatcaggggctgactgccagcccttcaaagccagccgtcagctggttcatgcgctgatgaaaagcagagtcttcgggaacatctccacccaga

SEQ ID NO: 58992 - DNA, 601 bp, Human
cggaggaaaggggctttgacaaagcctatgttgtccttggccagtttctggtgctgaagaaaactgaagacctcttccaggaatggctgaaggacacttgtggtgccaacgccaagcaatcccagaactgcttctgatgcctttaagagtggtaggacaacttcttgtgatgctctctgggaagccctcaatccccagccctcatccagagtttgcagccatgaagggactcctcccctgtcctctacagaggaaaagattgctattgtactcacctctgatgtactccagggtcttttgrgagttttctcccctaaccatttcaacttttttggattctcgctcttgtatgcctcctccttcctttttcccttgccaattccctggtgacagttatcagctttcctgcatggattcctggccccgtctctcacccccaccctcacttgcagtccatttgataccatttggctccttttttggcagaacagtcactgtccttgtaaagttttttagatcaataaagttagtggttttcaaaaaaaaaagaaaaaagaaaagtctgtctgggaatatatacatttaattgttatgtcagacc

SEQ ID NO: 58993 - DNA, 601 bp, Human
gaagtcctgggcaagaagccggaggaaaggggctttgacaaagcctatgttgtccttggccagtttctggtgctgaagaaaactgaagacctcttccaggaatggctgaaggacacttgtggtgccaacgccaagcaatcccagaactgcttctgatgcctttaagagtggtaggacaacttcttgtgatgctctctgggaagccctcaatccccagccctcatccagagtttgcagccatgaagggactcctcccctgtcctctacagaggaaaagattgctattgtactcacctctgaygtactccagggtcttttgagagttttctcccctaaccatttcaacttttttggattctcgctcttgtatgcctcctccttcctttttcccttgccaattccctggtgacagttatcagctttcctgcatggattcctggccccgtctctcacccccaccctcacttgcagtccatttgataccatttggctccttttttggcagaacagtcactgtccttgtaaagttttttagatcaataaagttagtggttttcaaaaaaaaaagaaaaaagaaaagtctgtctgggaatatatacat

SEQ ID NO: 58994 - DNA, 601 bp, Human
acacacgtaataatgtatgacatgctaaaacaagcacgcagcagacagctgtgcctaccacagttaacactcctgacaggtcttggggacatcagccatctgggagtcggcaaaagctggcaagacttcccgtaaggggcagcgggcgcgcctctcctggggctggatcaatgaggaacccacgtcaatacctgtcacaagggcctgtggttagacatgtcacgcacatgctgccatgcttgtgaattttcaaaaggtgtatttgtcacttattacatgtgcaaagtagttttctgatcayttccactgctggtgggttcaatgacaaaggcacattactgtgggcaggcgattggtacaactctgatggacagcaactcaccaaggtgaactaagatgggcaccagcccttagcccaattctgggccaccatcctgaataaagactaataattctaaatataaagcaaaggctgtaagcatacaaatgttcttgccagtattccttgagagagaaaaattagaaagagacagaaattgtattaataaggtattaggttaagtatattaggcttcatcatccacttaatgaaatattacat

SEQ ID NO: 58995 - DNA, 601 bp, Human
cctcagttttgaaatgctgccacaatataaaaataagacatcccacaggccccccaaaaatgtcagcaggctaaatgtgaattaagacccaatgggtctttagtttcacaatgggaaaacatgaaagctttctaagtctgctaataaagttacacacgtaataatgtatgacatgctaaaacaagcacgcagcagacagctgtgcctaccacagttaacactcctgacaggtcttggggacatcagccatctgggagtcggcaaaagctggcaagacttcccgtaaggggcagcgggcgcrcctctcctggggctggatcaatgaggaacccacgtcaatacctgtcacaagggcctgtggttagacatgtcacgcacatgctgccatgcttgtgaattttcaaaaggtgtatttgtcacttattacatgtgcaaagtagttttctgatcatttccactgctggtgggttcaatgacaaaggcacattactgtgggcaggcgattggtacaactctgatggacagcaactcaccaaggtgaactaagatgggcaccagcccttagcccaattctgggccaccatcctgaataaagactaat

SEQ ID NO: 58996 - DNA, 601 bp, Human
gatttcaggtgcaggcatgggtgggtgctggaagggaacagcagaaccaaggctgagattctcaatggtcaaacaggtaagctgaatctcatagggtatcactgaaaatgggtcactgtgaagtgaaaacaccaaccagatgaaatccaggggaccgcagccagcattggcacagagagtctgagttgatggaacatcagcagagttggcagaagatgggcagcccctctggggcagcctggcagacagaggcagagcccagggacagacaggtgttgtcaagaggcaagagagatcattmcagatggtaagcagaccagacagccctttgaggggaactttgggaactggggctctatgaccaggaggagagatgagatggctgagggattcactgcaaatatctaaagatccttccatgaatgagtgagtaaacttgctgggtacagaccaggcagaataggccagtggtgaggaatggtgaggaatgtggattctacggcaagatggacctggatccactgagtgaccttgtgcatgtgacttgacttctccaagcctccatctccacatctgtaaaatggggatggtaatagaacca

SEQ ID NO: 58997 - DNA, 601 bp, Human
tccgttccagaaatggcttcagggatgccgagaggtcccaggaaaagtccttgggaccaaggaccacactgggatgttcccgcagagcagcggcaacggcctgttcccctctcagcagccctgtctgcactccacctgccccggccctgcagagtctctgaggacccgggacagagggaggggccgcaaaacagcctggacccctgctcagcctctcaatgacctcgaagccactgcccatgtctaatccagtttgaaggtggtttgaggaggtggagagtgcaactgtccagccctgtasttcagggttgcaaagagggacctggccaggcgccaacagaggggccccagcccaggctaggagccatggagctggccatggagacagaatcacattgtccaccttctgtacaggtctcatagccttgctctcacagactccgctaacctcttttcgtcacatctttcacaattatcatgtgatatacttcctttaaaatgtgttggaaaggaatatggcttttgagaacgtgccttccctgcccccaagctcagacagacacactgcaatgtttctttagccacaacaggcctctttgag

SEQ ID NO: 58998 - DNA, 601 bp, Human
cagcctggacgcccggcgtggtggggagtgctaccccggcaggtttgtggcccagccgcattcaaacaaagggtacagggccatgttactgctcagcccgatgaagccctgccctatctggcctcccctcaccccaagagccatcttcaagtcacctccttgggccatactcaggctcacagcctgacaaaggagatccgggatggcaggtcttcagtggatacactccgttccagaaatggcttcagggatgccgagaggtcccaggaaaagtccttgggaccaaggaccacactgggaygttcccgcagagcagcggcaacggcctgttcccctctcagcagccctgtctgcactccacctgccccggccctgcagagtctctgaggacccgggacagagggaggggccgcaaaacagcctggacccctgctcagcctctcaatgacctcgaagccactgcccatgtctaatccagtttgaaggtggtttgaggaggtggagagtgcaactgtccagccctgtagttcagggttgcaaagagggacctggccaggcgccaacagaggggccccagcccaggctaggagccatggagctg

SEQ ID NO: 58999 - DNA, 601 bp, Human
tggaaagtttccccaacaagcagcagccaccgcaaagtttaggctagaggaggaaatggtggctgtgacccggtgatcaacaacatgcacttcgggacgcatcagagctggattcagttctcagatccactatttactggctgtgtgaccttcagattaaccttcctaaacttcagttccctttgcagtaaaacagggatagtaacagcgctccataaaagttaaaaagattaactcaaaaacatctgtaaaaaacttgccatttagtaagtgctcagtgaacagtggggaggaggaagakgacaggactagctcccccaaaatgatcccgggaccaggtctcagaggacttgctcttgctcctctgcactcccaccccacatcctctccctgcccccagccaccaaactctcctgtcgtaggtcccaccccaccacgcgctgtactgtttccaagatgacaacatgcgagctcttttttgcaccggtgctggtgtgttcgtgggagagggctggaactgtggtgagttcctgggagaggggtggaactgtggtgagttcctgggagaggggtggaactgtggcacattcgtgggagaggg

SEQ ID NO: 59000 - DNA, 601 bp, Human
gggcacctctcaaactggaaagtttccccaacaagcagcagccaccgcaaagtttaggctagaggaggaaatggtggctgtgacccggtgatcaacaacatgcacttcgggacgcatcagagctggattcagttctcagatccactatttactggctgtgtgaccttcagattaaccttcctaaacttcagttccctttgcagtaaaacagggatagtaacagcgctccataaaagttaaaaagattaactcaaaaacatctgtaaaaaacttgccatttagtaagtgctcagtgaacagyggggaggaggaagaggacaggactagctcccccaaaatgatcccgggaccaggtctcagaggacttgctcttgctcctctgcactcccaccccacatcctctccctgcccccagccaccaaactctcctgtcgtaggtcccaccccaccacgcgctgtactgtttccaagatgacaacatgcgagctcttttttgcaccggtgctggtgtgttcgtgggagagggctggaactgtggtgagttcctgggagaggggtggaactgtggtgagttcctgggagaggggtggaactgtggcac

SEQ ID NO: 59001 - DNA, 601 bp, Human
aggtagaaactcaatgttcacctttatatcccagagacccagggcacagagtcagggacacagcagtgaactaaacagcaaaagtccctgcctctgtgcagcagacattctagtggacgtaagaattgggcagccaggtgaaggaacaagtggggaactggatgcaaagctgagagggtcctgggagatccaactgcaccttgtgggtgaggctgaatgctctcagggcagggggtgatgggacaaacagtgctcttagggaccccctggacacagaagacagctcggaggaaagaggacrcagcaggacagggaagcgtatgtaccaagcatccttcctccgctgctggcactgcaggagatgagagggcctttagcctttatccttattttaacttctttttattggtagaaaaatattaaaggatttttaactctttaaaacaaatataatttactttggttttgcacattctctcccagctgacactggtctgcccagtgtcttcaagctgtgcgttcacacttgagtgtgcgttgacactggggtgggtggtcttttctcatttatcaccatcttggccatccccagcacccactc

SEQ ID NO: 59002 - DNA, 601 bp, Human
cagggtagataggggacatacactgatttccaatgtcctctctatcttgcttaactaactcactcatctttcaagactgggtagagatatcacctcctccaggaagccttcctgatagccacctgctctgtctgggctggacacacacccatagcaccctgcattcacccattatgcctagccacttgtcagctccacacccccagcctgggagctcttggaggtagaaactcaatgttcacctttatatcccagagacccagggcacagagtcagggacacagcagtgaactaaacagcwaaagtccctgcctctgtgcagcagacattctagtggacgtaagaattgggcagccaggtgaaggaacaagtggggaactggatgcaaagctgagagggtcctgggagatccaactgcaccttgtgggtgaggctgaatgctctcagggcagggggtgatgggacaaacagtgctcttagggaccccctggacacagaagacagctcggaggaaagaggacgcagcaggacagggaagcgtatgtaccaagcatccttcctccgctgctggcactgcaggagatgagagggcctttagcct

SEQ ID NO: 59003 - DNA, 601 bp, Human
aaaagaaatagctgcttagatttaggagcaaaagttgaagagcctatgaacaagaaagggaacagggggacagaagctatccctccacacaggcggggagaaagggacagcattatgataccctgtgactttgggcttaatttttcaatcatgtctcactagtaacttaccaatatggaatacctctctctccctgcaaacatatctccactctgcaggccagcctactcccatgatgaagagaaacggcgtattgtgctatcccagagctctgggaagactggcacacagatcagggtasataggggacatacactgatttccaatgtcctctctatcttgcttaactaactcactcatctttcaagactgggtagagatatcacctcctccaggaagccttcctgatagccacctgctctgtctgggctggacacacacccatagcaccctgcattcacccattatgcctagccacttgtcagctccacacccccagcctgggagctcttggaggtagaaactcaatgttcacctttatatcccagagacccagggcacagagtcagggacacagcagtgaactaaacagcaaaagtcc

SEQ ID NO: 59004 - DNA, 601 bp, Human
ggcaataagtgggtaggaagagggaagaacatcacaccagcgagtatcaggggaaaagaaatagctgcttagatttaggagcaaaagttgaagagcctatgaacaagaaagggaacagggggacagaagctatccctccacacaggcggggagaaagggacagcattatgataccctgtgactttgggcttaatttttcaatcatgtctcactagtaacttaccaatatggaatacctctctctccctgcaaacatatctccactctgcaggccagcctactcccatgatgaagagaaacrgcgtattgtgctatcccagagctctgggaagactggcacacagatcagggtagataggggacatacactgatttccaatgtcctctctatcttgcttaactaactcactcatctttcaagactgggtagagatatcacctcctccaggaagccttcctgatagccacctgctctgtctgggctggacacacacccatagcaccctgcattcacccattatgcctagccacttgtcagctccacacccccagcctgggagctcttggaggtagaaactcaatgttcacctttatatcccag

SEQ ID NO: 59005 - DNA, 601 bp, Human
aatcaaagaccatcagcttcatagttacttctctattaagcagattatgatcaggtgaggcagcaactaagccatcctgtgccaacagcaccagctagtggctcaaacaggaagagggtgtctcaacaaacatgagaaacaaaagcatgcatcgcagttttacatgtccatctaaaacaggtgtctctctccagctgtctccactctgtggcaaccagagagaagagctcccttgctttagatctaaaccattcattggcaactccagacttctctgcaccaaatggcactaccaattacrtggggctcacccaacaccagagccattcagctctcttcccacctgccctgcaaaattcaaaggatgggcagtgtatcattcatgtgacagtaggagccacactagaaatactcttcctcatgggaaaggtcacagcttcatgctccccaatcccttcctcctgccctggggaactctaaaggtgaagtggcaataagtgggtaggaagagggaagaacatcacaccagcgagtatcaggggaaaagaaatagctgcttagatttaggagcaaaagttgaagagcctatgaacaagaaagg

SEQ ID NO: 59006 - DNA, 601 bp, Human
cccatggttaacattcttggccacagaatcctggcactggggaggagaaggaacctcagttccttcaaaccctttttttttttttttttttttttaaaacaaacaaggatgctgaaacaaatgtccaaggcacctggatggctggcagcagaaccagaactcagacccacgctcctaggatgaattcatacatgtcatccccaacttgtttcaagagaccaaaaccagctgcgctcataggcagagcagatgccaaggtgtcaggcagcaccaatagacagtatctcgtcctgggccaggktccgcctcacctgagatgacctccagcagcagcatgagcttcaggccatcccggaagtcctcttcgatgttctcgatctgtgtccccgccttccggaggtgggagttacaccatgccgtgaatgtctgggcagagacaagaagggcaagtggtcagggggctggtgttgtcaccctcattggacaagccatttaatggtgccagggggtgggaggtggacacctactcagcagagcctctcaacacagttgccccaccatggtctcattcactgcatcaaccaagcactgagctacccac

SEQ ID NO: 59007 - DNA, 601 bp, Human
ggtgtttaaatggagttgcctatagcagcccatccccatctgagaaccacagttcttgtcctattatgctgcctcctgtgggcacccagggctcagctccaggtcaaccctccacccccacctccagattccacacagtagcttctgctgctcaggtttcaaggtcagaacctttgagaaaataaaggtagaggagctggctctccaaataccccattaacagcacttttattccagaacaaagagcatccaggggcctcctgaaatgatctgagaattttctaagtgcagcatagagccwtacctagggaaggggtatatagctttcagggtctctaaggggccaaggaccccaaaaggctgagaaccaccatcgcagagcctggaattcaggccccttgtgcctgccctgatatcccgaccacacccactgtctccccagcaggtcgacaatctggctgcgaggactccagggaccagccacggggattctgggccaggcccaccctgtcagagcagcacctctccaggtggcctcccagcagcctgctagcttctggaagacggcagacttcctgccacagatgggatctggctgtca

SEQ ID NO: 59008 - DNA, 601 bp, Human
tccctggtgtttaaatggagttgcctatagcagcccatccccatctgagaaccacagttcttgtcctattatgctgcctcctgtgggcacccagggctcagctccaggtcaaccctccacccccacctccagattccacacagtagcttctgctgctcaggtttcaaggtcagaacctttgagaaaataaaggtagaggagctggctctccaaataccccattaacagcacttttattccagaacaaagagcatccaggggcctcctgaaatgatctgagaattttctaagtgcagcatakagccatacctagggaaggggtatatagctttcagggtctctaaggggccaaggaccccaaaaggctgagaaccaccatcgcagagcctggaattcaggccccttgtgcctgccctgatatcccgaccacacccactgtctccccagcaggtcgacaatctggctgcgaggactccagggaccagccacggggattctgggccaggcccaccctgtcagagcagcacctctccaggtggcctcccagcagcctgctagcttctggaagacggcagacttcctgccacagatgggatctggc

SEQ ID NO: 59009 - DNA, 601 bp, Human
aaaaaaagaaaagaaagttctgtcctgggctctgactggggaggcagcactgccgacagtaacaggaagaggaaggcctcagctctggagcctacccctgggtttaaccctggatctgccacatagaagcagtctggctcagagcctgggctcaactgatgacactcttccactctagcaacttttctgagcctcagtttccttaactgtaaaacgtggctggtgatacccatcctacgagcccatcatgagtgtagcaggagatggcccacgtaaagcaccctgtctagcaacacagagygggtactcggtgagtgctattctcttccaccttccccttccctgccctcctcccctttggtagaggctttaaagagcaaacaagttatttttttaaatttagttgccaaatttttcttttcaaaaaatctggatttctggcttcttttgaaaaactggaagatctagcagcactggatccacacagcagcaacttcttacatccacaaggtgcccatcccgcttaggacatgactctctagcttgccacggtccctacccacccctgccactgacccctgaaccacttcacaaattctct

SEQ ID NO: 59010 - DNA, 601 bp, Human
acaccttcagggacagggaactcataaccctcccagagccccggctccatttcccaaggctcccagagtccacctacctacagggtacctattctgggcctggttctgcccttcggagtcagccagaggtcttagtccttgcactgcatgataatccttcaaagactttggtggggggtgaggggtgtccctgctgggcctggtctccacagtcacagccttcagcagcccaggatggacaacctgcaacgttcccccgctccccttccaggagagctcattctatgccatctgcccatcrccttttattttataatcgacatcaataaactccatttcacttttaaaagcccacaaaacgccatttgctgcctcatctagtttcttggctcagcagagcggccattgtggcataatcttggtgctcagcctgatgggagtggatgatttcactcctggaagccacagctgaaaacactggctcctcagggcagggagaaggtaaagaacgtctcactttaaaggaacttttcgtcggggcgtggtggcttgcgcctgtaatcccagcactttgggaggctgaggctggcggatcatttga

SEQ ID NO: 59011 - DNA, 601 bp, Human
taaaatacaaaatcctttttgagttctctcccctggttaactacattccaaccactcacccaggccaattccatgaagtctatgcattctagaaccaaatatcgtaggggagaccttaaggatctgctctaacctcccctttatgtgtggaagctccttgtctccagccttcatgtgcacaccttcagggacagggaactcataaccctcccagagccccggctccatttcccaaggctcccagagtccacctacctacagggtacctattctgggcctggttctgcccttcggagtcagmcagaggtcttagtccttgcactgcatgataatccttcaaagactttggtggggggtgaggggtgtccctgctgggcctggtctccacagtcacagccttcagcagcccaggatggacaacctgcaacgttcccccgctccccttccaggagagctcattctatgccatctgcccatcgccttttattttataatcgacatcaataaactccatttcacttttaaaagcccacaaaacgccatttgctgcctcatctagtttcttggctcagcagagcggccattgtggcataatcttggt

SEQ ID NO: 59012 - DNA, 601 bp, Human
gaacgcagacattaatgcttatgagtgcttaataacttagaaaaattttttagcatgggaagtgggaaaagcaggtaaaaaatttcataaacagtgtttaaaatataagggaaaaattttttaagcctagaaaaaagctctgagtggtaatcccatggtttggccttcctaggagtggggctgcaatgctagccctcccttggtcccccacatgctgccccactctgtgacggccaaactccagggcctcccgctggccctgagctcactgcctgcagatttgccctcttggagtcctccyggagggactgggagaggcaggtggcttctttttagggtcttgcctacttattcctcttcttcttccccagaaactccccagagaattttgcttactgaattctcattcacaccaaaggcatagtttcactccagaaaacagaggcgccaagcacgagcatagagagtagggcgtgcttaattagcagcccatgcacgcccagccccagttcccacctgactcccatcccatccactctccttccccttccctggcatggcaggtcctgtataccgggcctccggcttctcaacgtttgca

SEQ ID NO: 59013 - DNA, 601 bp, Human
ttttctctctttcccctctagaatgtaagccccttgagggtaagaatacttcctgttttgcatcactgcttagagttcagtatgaagcctggcacaggcaaagcccccatcagcatctgctgagtgaacgaatgagtgaacaaacactaaccacaagtaggggaatgggcagagctaacacaggcctgccattggccccctgagaacacaatggacctcagtctcttccagggcagggcccaggcctgggacgaagtacgacaaacagatgatgaggccagacgcagtggctcacacctgwaatcccagcactttgggaggccaaggtgggacagatcacttgaggtcaggagttcaagaccagcctggacaacatggcgaaaccccgtctccactaaaacagaaattaggcagatgtggtggcacatgcctgcaatcccagctactcgtggggctgaggcaggagaatcgcttgaattcgggaggcggaggttgcagtaagctgagatcgtgccactgcactccagactaagcaagagagcgagactcatctcaaaaaaacaaaacaaaaaagacaatgaacgcagacattaatgcttat

SEQ ID NO: 59014 - DNA, 601 bp, Human
ctccccttccctagatacccacgtggcctgtccctgcctcctgccagtttcactcacacgtccccttctcatggacacctcccttgaccacccaagttcctccctgctttggttttctccatctgacaggtgtacatgtgtattttctctctttcccctctagaatgtaagccccttgagggtaagaatacttcctgttttgcatcactgcttagagttcagtatgaagcctggcacaggcaaagcccccatcagcatctgctgagtgaacgaatgagtgaacaaacactaaccacaagtrggggaatgggcagagctaacacaggcctgccattggccccctgagaacacaatggacctcagtctcttccagggcagggcccaggcctgggacgaagtacgacaaacagatgatgaggccagacgcagtggctcacacctgtaatcccagcactttgggaggccaaggtgggacagatcacttgaggtcaggagttcaagaccagcctggacaacatggcgaaaccccgtctccactaaaacagaaattaggcagatgtggtggcacatgcctgcaatcccagctactcgtggggctgag

SEQ ID NO: 59015 - DNA, 601 bp, Human
ttcccagctattaaattagcaaagttaaaaaacaaagttaggctgggtgaagtagctcatgcctttaatcctagcactttgggaggccaaggtgggaggatcgcttgagcccaggagttcaagaccagccggggcaacataggagaccttgtctctacaaaaaaatgaaaaaattagccaggtgcagtggtgcaaacttgtagtcctagcttcttgggaggcagaggcaggaggactggggactgagcccaggagctcaaggttgcagtgagctgtgtgatatcaccgctgcactccaacytaagcgacaagttgagaccctgtctcttaaaaacaaaacaaaacaaaacaaacaaaaaaacccaaagttgaaaaccacacgccttgatgtcagcaaggccaccacactagaagtgtaaattggtttaaaaaacaataataataatttctgggaaattaatcaattaatctgggaaataatttggccacaaggagcacgcattttacagttgctcagctttttggcagtataattttatctccaggaatctatccctagccaatgaaaggaaatgcagagtaaggttcctgaatgaatgca

SEQ ID NO: 59016 - DNA, 601 bp, Human
atccactgactcaatctcacaatgccatcagtttgggtattaaaacagatgtttttttaaaaaatcaaacaatagcttcaagatcacagctaagagataacccaatatatttagtctaagcagcaccttttagagttttagaatctacaagttctatgaagtagattttctctttttttctgtaccaggcctaatggcagggaatacaacataaataagccctattttaaggagcccaatacatggagcaatctatggtcttgtggttgaacaagtgatactcaaatgtagattccacacycactcatcacctgcttccagaccaggagatagtaatccggcccatggtaagacacgctcagttaagagtaaggtacccaaagaatatctttttttttcctacctgcaacattaattttaggggagacccaatagaaccatgagaaggatcaatttctaggcagttctgaccctactaggatttgcatcccacaaacccctgaaacaagagtggatttccattaaggatggtatactctaacatcttagcccctttcccaaaagtgagggcaaaactgtatgctgttccatgaccagccgg

SEQ ID NO: 59017 - DNA, 601 bp, Human
cctgggctcaagcgatcctcccatctcaccttcctgggtagctgggactacagataggccaccacacccggctaattttttcattttttgtagagacagggtcttacgatattgcccaggctggtctcaaactcctgggttcaaacgatcctcccaccttagcctcccaaagtgctggaattacaggcatgagctaccatgcctggcctggatgtttcttaaagttaatgcaataaactgtgacaggtgctggaagagaagtctatttggggcacaaaaaaagggtgtaatcaatcctagytggagacagtgggtacatcagggaaggccacagagaagggggcatttgaaatcctgatctgtgttcccagcctgatgaagaggggaggatttctaagcaatcacaaatgttctggcaattctgtgagctggggctctctgggcaatcacagctctcaaaatagccacccacacgtggaaaaacagtggaatcaagagaaagtcacaaacttaaagttttgtaaattgccatcttgaactatccactgactcaatctcacaatgccatcagtttgggtattaaaacagatgtttttttaaa

SEQ ID NO: 59018 - DNA, 601 bp, Human
gcctcagcggggacagaattaacactccctcagcacccacagcactccatgccccacgctaggaatcaaaagactccagagctctacttctagagggaaacaggatttttgcttgtttttgagacagggttttcgctctgtcacccaagctagcgtgcagtggtgcaatcatggctcactgcagcctccaaatcctgggctcaagcgatcctcccatctcaccttcctgggtagctgggactacagataggccaccacacccggctaattttttcattttttgtagagacagggtcttacratattgcccaggctggtctcaaactcctgggttcaaacgatcctcccaccttagcctcccaaagtgctggaattacaggcatgagctaccatgcctggcctggatgtttcttaaagttaatgcaataaactgtgacaggtgctggaagagaagtctatttggggcacaaaaaaagggtgtaatcaatcctagttggagacagtgggtacatcagggaaggccacagagaagggggcatttgaaatcctgatctgtgttcccagcctgatgaagaggggaggatttctaagcaatcacaaa

SEQ ID NO: 59019 - DNA, 601 bp, Human
agaagcccaggacatggcccctgatcaacgtccgttgccctgggtatgggagttctccaggctaagcccagggagggagacgagatggtgatggcgggatggaacaaagcagaaacccaccttccacggagatgtcctggatggcaaagcgcaggatgatggtccagatcatgcccagggtcatcttcacattcccatccacgatttctacagaaacagcagcagcacacatcagaaagggcctcagcggggacagaattaacactccctcagcacccacagcactccatgccccacgctrggaatcaaaagactccagagctctacttctagagggaaacaggatttttgcttgtttttgagacagggttttcgctctgtcacccaagctagcgtgcagtggtgcaatcatggctcactgcagcctccaaatcctgggctcaagcgatcctcccatctcaccttcctgggtagctgggactacagataggccaccacacccggctaattttttcattttttgtagagacagggtcttacgatattgcccaggctggtctcaaactcctgggttcaaacgatcctcccaccttagcctccc

SEQ ID NO: 59020 - DNA, 601 bp, Human
agacataaagctcaaaaactgcccgagtgtggaatcaagcgtagagatcacctctccagaccatggcggcccttgcagatctgtgaaatggccactagagggtgctaggggagcaaagtggaggacggggttagcgcccctcctggtccttcctcccagccgctatttccccaccctttcagattaacaacccaagagccaggtgggttttccaatatacttccccatggcagccttgggctttcccaaagtggggagtttccctgaggccaacatgcctatgagaatcagaatggcaaayagttcttttttctacattgactggaggagaaggctgatgcccaataaatgagcaagaagcccaggacatggcccctgatcaacgtccgttgccctgggtatgggagttctccaggctaagcccagggagggagacgagatggtgatggcgggatggaacaaagcagaaacccaccttccacggagatgtcctggatggcaaagcgcaggatgatggtccagatcatgcccagggtcatcttcacattcccatccacgatttctacagaaacagcagcagcacacatcagaaagggcctca

SEQ ID NO: 59021 - DNA, 601 bp, Human
tccacccaaaagaatcaaaatcatcaagaaggctatttgagaaatggatttacatccactatcattaacaagaaccacaccccaggtgactactatgaccctctttccaaccacttcaaccctaaataccaagtacccataaaccgaacttggaactctacattgctgcatcacagagtgtcacacctagatctccatcacaaagcaattgaattgaatccacgttgttttcattaagaaattcctttgattaaaaatgtttatgatgtctatgccattaaaacaaatatttaaaaaataktatctccatctcatcttgtaaaagtttgtttcagtatgtgtgttttatcacaggcacaacaatacacaaatattattatgcaagataaatacaggcatagcagacataaagctcaaaaactgcccgagtgtggaatcaagcgtagagatcacctctccagaccatggcggcccttgcagatctgtgaaatggccactagagggtgctaggggagcaaagtggaggacggggttagcgcccctcctggtccttcctcccagccgctatttccccaccctttcagattaacaacccaagagc

SEQ ID NO: 59022 - DNA, 601 bp, Human
ttcaagggttcctacaaagaccataaccacctaagcaaaagcagacaatttaaaaattggaaaagctaatgcttctacttagcttaagctcttcgtcagctaaatcacaagagtaacacaatgatgactgcagagctgacaagaagtccacccaaaagaatcaaaatcatcaagaaggctatttgagaaatggatttacatccactatcattaacaagaaccacaccccaggtgactactatgaccctctttccaaccacttcaaccctaaataccaagtacccataaaccgaacttggamctctacattgctgcatcacagagtgtcacacctagatctccatcacaaagcaattgaattgaatccacgttgttttcattaagaaattcctttgattaaaaatgtttatgatgtctatgccattaaaacaaatatttaaaaaatagtatctccatctcatcttgtaaaagtttgtttcagtatgtgtgttttatcacaggcacaacaatacacaaatattattatgcaagataaatacaggcatagcagacataaagctcaaaaactgcccgagtgtggaatcaagcgtagagatcacct

SEQ ID NO: 59023 - DNA, 601 bp, Human
gggtatgtccttaccagcagcgtgaaaacggactaatacaccctgtgtttgtgcctgtgaattggaggttaaggtactcagtggactgtgttcatgaatgatctcatttattttcaacacacaaaatggactttaaaatgacattcaagggttcctacaaagaccataaccacctaagcaaaagcagacaatttaaaaattggaaaagctaatgcttctacttagcttaagctcttcgtcagctaaatcacaagagtaacacaatgatgactgcagagctgacaagaagtccacccaaaakaatcaaaatcatcaagaaggctatttgagaaatggatttacatccactatcattaacaagaaccacaccccaggtgactactatgaccctctttccaaccacttcaaccctaaataccaagtacccataaaccgaacttggaactctacattgctgcatcacagagtgtcacacctagatctccatcacaaagcaattgaattgaatccacgttgttttcattaagaaattcctttgattaaaaatgtttatgatgtctatgccattaaaacaaatatttaaaaaatagtatctccatct

SEQ ID NO: 59024 - DNA, 601 bp, Human
ggcgtggtttcccccatactgttctcgtggtagtgaataagtctcacgaggtctgatggttttctaaggggaaacccctttcacttggctctcattctctgcctgctgccatgtaagaggtccctttgctctcccttgctcttctgcaatgactgtgaggcctccccagccatgtggaactgtgagtccattaaacctctttttatttataaattacccagtctcgggtatgtccttaccagcagcgtgaaaacggactaatacaccctgtgtttgtgcctgtgaattggaggttaaggtrctcagtggactgtgttcatgaatgatctcatttattttcaacacacaaaatggactttaaaatgacattcaagggttcctacaaagaccataaccacctaagcaaaagcagacaatttaaaaattggaaaagctaatgcttctacttagcttaagctcttcgtcagctaaatcacaagagtaacacaatgatgactgcagagctgacaagaagtccacccaaaagaatcaaaatcatcaagaaggctatttgagaaatggatttacatccactatcattaacaagaaccacaccccaggt

SEQ ID NO: 59025 - DNA, 601 bp, Human
gcctgaggggtgcacacagctgagtgagaaggaagcattaggactcctagacagattttgtttttaatctaaaaaataaggtttccttatatttactgcacggatcaatactgctgccctctgtgtgtgaagcagccacgtgtctatgaggttaggcaggcaactgagggggctcacggagctcccagcacagaagaaagactgcaaaccacactacccccgttaggcttgtgctgtgtccccgcccaaatctcatcttgaattgtagctcccataattcccacgtgttgtgggagagagmcggtgggagatgattgagtcgtgggcgtggtttcccccatactgttctcgtggtagtgaataagtctcacgaggtctgatggttttctaaggggaaacccctttcacttggctctcattctctgcctgctgccatgtaagaggtccctttgctctcccttgctcttctgcaatgactgtgaggcctccccagccatgtggaactgtgagtccattaaacctctttttatttataaattacccagtctcgggtatgtccttaccagcagcgtgaaaacggactaatacaccctgtgtttgt

SEQ ID NO: 59026 - DNA, 601 bp, Human
tatcaggttggggaggaagatttgatctgggaaatctacacatctaggggtctccagacaggggaatcccacagcctgaggggtgcacacagctgagtgagaaggaagcattaggactcctagacagattttgtttttaatctaaaaaataaggtttccttatatttactgcacggatcaatactgctgccctctgtgtgtgaagcagccacgtgtctatgaggttaggcaggcaactgagggggctcacggagctcccagcacagaagaaagactgcaaaccacactacccccgttaggyttgtgctgtgtccccgcccaaatctcatcttgaattgtagctcccataattcccacgtgttgtgggagagagccggtgggagatgattgagtcgtgggcgtggtttcccccatactgttctcgtggtagtgaataagtctcacgaggtctgatggttttctaaggggaaacccctttcacttggctctcattctctgcctgctgccatgtaagaggtccctttgctctcccttgctcttctgcaatgactgtgaggcctccccagccatgtggaactgtgagtccattaaacctcttttt

SEQ ID NO: 59027 - DNA, 601 bp, Human
acctctatcaggttggggaggaagatttgatctgggaaatctacacatctaggggtctccagacaggggaatcccacagcctgaggggtgcacacagctgagtgagaaggaagcattaggactcctagacagattttgtttttaatctaaaaaataaggtttccttatatttactgcacggatcaatactgctgccctctgtgtgtgaagcagccacgtgtctatgaggttaggcaggcaactgagggggctcacggagctcccagcacagaagaaagactgcaaaccacactacccccgytaggcttgtgctgtgtccccgcccaaatctcatcttgaattgtagctcccataattcccacgtgttgtgggagagagccggtgggagatgattgagtcgtgggcgtggtttcccccatactgttctcgtggtagtgaataagtctcacgaggtctgatggttttctaaggggaaacccctttcacttggctctcattctctgcctgctgccatgtaagaggtccctttgctctcccttgctcttctgcaatgactgtgaggcctccccagccatgtggaactgtgagtccattaaacctc

SEQ ID NO: 59028 - DNA, 601 bp, Human
caacctctatcaggttggggaggaagatttgatctgggaaatctacacatctaggggtctccagacaggggaatcccacagcctgaggggtgcacacagctgagtgagaaggaagcattaggactcctagacagattttgtttttaatctaaaaaataaggtttccttatatttactgcacggatcaatactgctgccctctgtgtgtgaagcagccacgtgtctatgaggttaggcaggcaactgagggggctcacggagctcccagcacagaagaaagactgcaaaccacactacccccgttaggcttgtgctgtgtccccgcccaaatctcatcttgaattgtagctcccataattcccacgtgttgtgggagagagccggtgggagatgattgagtcgtgggcgtggtttcccccatactgttctcgtggtagtgaataagtctcacgaggtctgatggttttctaaggggaaacccctttcacttggctctcattctctgcctgctgccatgtaagaggtccctttgctctcccttgctcttctgcaatgactgtgaggcctccccagccatgtggaactgtgagtccattaaacc

SEQ ID NO: 59029 - DNA, 601 bp, Human
ccatcaagtctattcccttgacagagtttgagaagttatttgagaaacagaaaaagcaagctgggaagctgttcagagctagtcatgttacacgtgcaaattttgagacaacagtttttcaaacttcaagaattagctccccctactctcttttattcaaagaaatggtaatgatacaaaataagtcggcaacctctatcaggttggggaggaagatttgatctgggaaatctacacatctaggggtctccagacaggggaatcccacagcctgaggggtgcacacagctgagtgagaagraagcattaggactcctagacagattttgtttttaatctaaaaaataaggtttccttatatttactgcacggatcaatactgctgccctctgtgtgtgaagcagccacgtgtctatgaggttaggcaggcaactgagggggctcacggagctcccagcacagaagaaagactgcaaaccacactacccccgttaggcttgtgctgtgtccccgcccaaatctcatcttgaattgtagctcccataattcccacgtgttgtgggagagagccggtgggagatgattgagtcgtgggcgtggt

SEQ ID NO: 59030 - DNA, 601 bp, Human
ccttatgtggaagttctggatgttgacatttttgtaaggggctgtctttctctgacaccacaggagcagcccttccttggctgaagtctctatggggaaggggacgggcagcgaggtcagagggctgactcggtggaggaagggatgccggctcacaggaggccccactgtgaccccttgatgccaaccctgcagctactgaaggaggagccctggccatcaagtctattcccttgacagagtttgagaagttatttgagaaacagaaaaagcaagctgggaagctgttcagagctagtcrtgttacacgtgcaaattttgagacaacagtttttcaaacttcaagaattagctccccctactctcttttattcaaagaaatggtaatgatacaaaataagtcggcaacctctatcaggttggggaggaagatttgatctgggaaatctacacatctaggggtctccagacaggggaatcccacagcctgaggggtgcacacagctgagtgagaaggaagcattaggactcctagacagattttgtttttaatctaaaaaataaggtttccttatatttactgcacggatcaatactgctg

SEQ ID NO: 59031 - DNA, 601 bp, Human
gctacttcttcccccagaggtctccactttgttctaaagctgagactgacccagccaagggggtctgggagctcccgggggaggcagcctggttctgtgagagcccctcagcccccagcactcaccttatgtggaagttctggatgttgacatttttgtaaggggctgtctttctctgacaccacaggagcagcccttccttggctgaagtctctatggggaaggggacgggcagcgaggtcagagggctgactcggtggaggaagggatgccggctcacaggaggccccactgtgacccyttgatgccaaccctgcagctactgaaggaggagccctggccatcaagtctattcccttgacagagtttgagaagttatttgagaaacagaaaaagcaagctgggaagctgttcagagctagtcatgttacacgtgcaaattttgagacaacagtttttcaaacttcaagaattagctccccctactctcttttattcaaagaaatggtaatgatacaaaataagtcggcaacctctatcaggttggggaggaagatttgatctgggaaatctacacatctaggggtctccagacagggga

SEQ ID NO: 59032 - DNA, 601 bp, Human
gattcagagcgatggcgacatccccttcccaaggaaagctacttcttcccccagaggtctccactttgttctaaagctgagactgacccagccaagggggtctgggagctcccgggggaggcagcctggttctgtgagagcccctcagcccccagcactcaccttatgtggaagttctggatgttgacatttttgtaaggggctgtctttctctgacaccacaggagcagcccttccttggctgaagtctctatggggaaggggacgggcagcgaggtcagagggctgactcggtggaggragggatgccggctcacaggaggccccactgtgaccccttgatgccaaccctgcagctactgaaggaggagccctggccatcaagtctattcccttgacagagtttgagaagttatttgagaaacagaaaaagcaagctgggaagctgttcagagctagtcatgttacacgtgcaaattttgagacaacagtttttcaaacttcaagaattagctccccctactctcttttattcaaagaaatggtaatgatacaaaataagtcggcaacctctatcaggttggggaggaagatttgatct

SEQ ID NO: 59033 - DNA, 601 bp, Human
ccccatctaagacactgcagggagagagacggggggattcagagcgatggcgacatccccttcccaaggaaagctacttcttcccccagaggtctccactttgttctaaagctgagactgacccagccaagggggtctgggagctcccgggggaggcagcctggttctgtgagagcccctcagcccccagcactcaccttatgtggaagttctggatgttgacatttttgtaaggggctgtctttctctgacaccacaggagcagcccttccttggctgaagtctctatggggaaggggaygggcagcgaggtcagagggctgactcggtggaggaagggatgccggctcacaggaggccccactgtgaccccttgatgccaaccctgcagctactgaaggaggagccctggccatcaagtctattcccttgacagagtttgagaagttatttgagaaacagaaaaagcaagctgggaagctgttcagagctagtcatgttacacgtgcaaattttgagacaacagtttttcaaacttcaagaattagctccccctactctcttttattcaaagaaatggtaatgatacaaaataagtcgg

SEQ ID NO: 59034 - DNA, 601 bp, Human
ccaaggcctatggccctagtctgctgttccagagccctgggctgggacttcctggacaatttccttgggggcgctcccagtagcaaaagcatcaaccaaagttatatcaggcagcagccccatctaagacactgcagggagagagacggggggattcagagcgatggcgacatccccttcccaaggaaagctacttcttcccccagaggtctccactttgttctaaagctgagactgacccagccaagggggtctgggagctcccgggggaggcagcctggttctgtgagagcccctcagmccccagcactcaccttatgtggaagttctggatgttgacatttttgtaaggggctgtctttctctgacaccacaggagcagcccttccttggctgaagtctctatggggaaggggacgggcagcgaggtcagagggctgactcggtggaggaagggatgccggctcacaggaggccccactgtgaccccttgatgccaaccctgcagctactgaaggaggagccctggccatcaagtctattcccttgacagagtttgagaagttatttgagaaacagaaaaagcaagctgggaagctgt

SEQ ID NO: 59035 - DNA, 601 bp, Human
tcagataaacctgccatatccagccctacccccgaccaaggcctatggccctagtctgctgttccagagccctgggctgggacttcctggacaatttccttgggggcgctcccagtagcaaaagcatcaaccaaagttatatcaggcagcagccccatctaagacactgcagggagagagacggggggattcagagcgatggcgacatccccttcccaaggaaagctacttcttcccccagaggtctccactttgttctaaagctgagactgacccagccaagggggtctgggagctcccrggggaggcagcctggttctgtgagagcccctcagcccccagcactcaccttatgtggaagttctggatgttgacatttttgtaaggggctgtctttctctgacaccacaggagcagcccttccttggctgaagtctctatggggaaggggacgggcagcgaggtcagagggctgactcggtggaggaagggatgccggctcacaggaggccccactgtgaccccttgatgccaaccctgcagctactgaaggaggagccctggccatcaagtctattcccttgacagagtttgagaagtt

SEQ ID NO: 59036 - DNA, 601 bp, Human
aaagcaggggcctcctagactccagagagatgaacacatagagctttctggggtaggagttagaagacaggatgggaagggacatttcttcctgccacaaatcccaggcactagggtcaagactttgtgggggggttgacaagttcagataaacctgccatatccagccctacccccgaccaaggcctatggccctagtctgctgttccagagccctgggctgggacttcctggacaatttccttgggggcgctcccagtagcaaaagcatcaaccaaagttatatcaggcagcagccccrtctaagacactgcagggagagagacggggggattcagagcgatggcgacatccccttcccaaggaaagctacttcttcccccagaggtctccactttgttctaaagctgagactgacccagccaagggggtctgggagctcccgggggaggcagcctggttctgtgagagcccctcagcccccagcactcaccttatgtggaagttctggatgttgacatttttgtaaggggctgtctttctctgacaccacaggagcagcccttccttggctgaagtctctatggggaaggggacgggc

SEQ ID NO: 59037 - DNA, 601 bp, Human
ccttccgcagcttcccgtagtcaatcagctcgggccggtgtcggtggatcaaagcacagaagccgaggccatccttccagctgcccggggagagagaagaaggagcaggctggtaaatgaggctgaacaaacgggcaaccagggcaaagcaggggcctcctagactccagagagatgaacacatagagctttctggggtaggagttagaagacaggatgggaagggacatttcttcctgccacaaatcccaggcactagggtcaagactttgtgggggggttgacaagttcagataaaccygccatatccagccctacccccgaccaaggcctatggccctagtctgctgttccagagccctgggctgggacttcctggacaatttccttgggggcgctcccagtagcaaaagcatcaaccaaagttatatcaggcagcagccccatctaagacactgcagggagagagacggggggattcagagcgatggcgacatccccttcccaaggaaagctacttcttcccccagaggtctccactttgttctaaagctgagactgacccagccaagggggtctgggagctcccgggggaggcagc

SEQ ID NO: 59038 - DNA, 601 bp, Human
gctctgtctggctattctaagaggccaacactgctcaggctggaccatggactgtcacaacaagggtcctagtcctgctcttttcccaccccacctgccagggacccaaagcgggtggtcaggtgggcacacataccttccgcagcttcccgtagtcaatcagctcgggccggtgtcggtggatcaaagcacagaagccgaggccatccttccagctgcccggggagagagaagaaggagcaggctggtaaatgaggctgaacaaacgggcaaccagggcaaagcaggggcctcctagacwccagagagatgaacacatagagctttctggggtaggagttagaagacaggatgggaagggacatttcttcctgccacaaatcccaggcactagggtcaagactttgtgggggggttgacaagttcagataaacctgccatatccagccctacccccgaccaaggcctatggccctagtctgctgttccagagccctgggctgggacttcctggacaatttccttgggggcgctcccagtagcaaaagcatcaaccaaagttatatcaggcagcagccccatctaagacactgcagggaga

SEQ ID NO: 59039 - DNA, 601 bp, Human
gcacagacccctttagtggggatgtccaacagctgtggatgaactggccactgacaccccagcatacccaagcagggacagagataggtgcacacctgtcaccaaagcccatcagctgaataggaagtggtgatgccttcaaaagaaaaaactgccacctgtagaatattcccccttggccacgtttgatttggccacacaactttccagcaggacaggaaggttctctttttttttttttccttgcaaagcagctgaggaggtgggccaaggatcctcttcccccaggaggttagctggygaagggctggcccctgctgtggctcctctccttcagcagatgggcccttccagtgggcagaggcctcagcctcaagcttcaggtgacggggcagtgtgtatggggtgggggtggggcggggcacggtgcagggaagcgggtaggcatctgctcctttcctccctcaagatcctttttggcagcttgctatccacccgcccgaaacaaagggcctgccaccaccatgagttgcacagcagctcctgccccagtgatattaaacctctcctggccactgagaagcaagacgcccttcctgga

SEQ ID NO: 59040 - DNA, 601 bp, Human
aacagagcaagacctcgtctcaaaaaaaaaaaaaaaaacagcaaacaccatatggcttcactgttatgaggttcccagacagaaagcagaatggtagcagccagaggccgggggggcaggaaagaacggggaactaccgtttaatgggtacagactttcagttttgcaagaaaagagttctgaagatggatggtaggaacagttgtacaataatgtgagtgtacggaatacccctgaacagtaagtgtatttaaaaatggttaaagtggtaaattttgttttgtatattgtaccagttatygtataagtttttaatgcagaggataaaaaaccttagtggaagagtttctggctgggcccttctcctctattcttggttccccagactaacctaaagcaagctggttgtgtcggcccaggactcagtttccctgtttgctaaagggagaagtatagggtaacacaaagataaatacatcatccaggatgttttcaggaggaaattgctctaaacagagaaggtggggtccctctgggaaagtctccaacagcagccaggaggatgaacactgccgagtagtcaaggtcattctcatccagg

SEQ ID NO: 59041 - DNA, 601 bp, Human
tgtaatcccagtactttgggaggccgaggcagatggattgtttgaggtcaggagttcatgactagcgtgaccaacgtggtgacaccccgtgtctgctaaaaatacaaaaattagctgggtgtggtggcacgtcccagctactcgggaggctgggacaggagaattgcttgaacccgggaggcagaggttgcaatgagccaagatcgcgctgctgcactccagcctgggcaacagagcaagacctcgtctcaaaaaaaaaaaaaaaaacagcaaacaccatatggcttcactgttatgaggytcccagacagaaagcagaatggtagcagccagaggccgggggggcaggaaagaacggggaactaccgtttaatgggtacagactttcagttttgcaagaaaagagttctgaagatggatggtaggaacagttgtacaataatgtgagtgtacggaatacccctgaacagtaagtgtatttaaaaatggttaaagtggtaaattttgttttgtatattgtaccagttattgtataagtttttaatgcagaggataaaaaaccttagtggaagagtttctggctgggcccttctcctctatt

SEQ ID NO: 59042 - DNA, 601 bp, Human
aattgaaagcaggttctcaaagagatctttatacctccattgttcatagcagcattattcacagtagccaagaggtggaagcaacccaagtacccattgatggatgaacggatgagcaaaacgtggtgatacatacaatggaatattattcagcctcaacaagagggaatttctgacacatgctgcaacatggatgaactcttagaatgttatgctcagtgaaataagccagacacaaaaggacacaggccgggtgcagtggctcacgtgtgtaatcccagtactttgggaggccgaggcrgatggattgtttgaggtcaggagttcatgactagcgtgaccaacgtggtgacaccccgtgtctgctaaaaatacaaaaattagctgggtgtggtggcacgtcccagctactcgggaggctgggacaggagaattgcttgaacccgggaggcagaggttgcaatgagccaagatcgcgctgctgcactccagcctgggcaacagagcaagacctcgtctcaaaaaaaaaaaaaaaaacagcaaacaccatatggcttcactgttatgaggttcccagacagaaagcagaatggtagcagcc

SEQ ID NO: 59043 - DNA, 601 bp, Human
tgaaaattttcctcatgacattttgaaattttaaaagctactggtggctttgggaggccaaggcaggtggatcacttgaggccaggagttcgagaccagccttgccaacttggtgaaaccccgtctctactaaaaatataaaaattagccggtggtgggtgcctgtaatcccagctacttgggaggctgaggcaagagaatcgcttgaacccaggaggcggaggttgcagtgagcggagatcgcaccacagcactccagcctgggtgacacagggagaccccgtctcaaaaaaaaaaaaaagccactggtggggcagaggggcagggaacagtctggaccccaccgtggtcttttcctgtctccataacccctttctagcccttcagcactgagcagttggggccaaggagagcacacagggaaggggctgtggtgagtcaggctcctcccaaggggcaagcgcggaggtgggacaagacccagcctgaccccagcctggagctgccagccctggcttcataagcccacagacccctatgctcccagatgcttcccttccccccacagcccctgctcaccccatccgagacgctctacaca

SEQ ID NO: 59044 - DNA, 601 bp, Human
aaagaaatgtcataggtaattagggaaatttcattatgaactgggtatcacatggaattatcaatttgctaaatgtgataactttatcattgactaagaaaataactctatttttaaggatgtattcggaagtatgcagtggtaaaatgatgtgatatctcagaattgctttaagatacttcaacaaagaaaacaagaaaaacacaaagtgtggcaagacctcagtagccattctatctggatgatggaaataggaaaggtcatcgtgctattctttctgcttttgcctgggtttttatgygtttgaaaattttcctcatgacattttgaaattttaaaagctactggtggctttgggaggccaaggcaggtggatcacttgaggccaggagttcgagaccagccttgccaacttggtgaaaccccgtctctactaaaaatataaaaattagccggtggtgggtgcctgtaatcccagctacttgggaggctgaggcaagagaatcgcttgaacccaggaggcggaggttgcagtgagcggagatcgcaccacagcactccagcctgggtgacacagggagaccccgtctcaaaaaaaaaa

SEQ ID NO: 59045 - DNA, 601 bp, Human
agaggaacaggtgaaatgaagccccaaaggaggcggacaaacccagtataaggaacttgctacaggacagcggccccatttctgcagcaagttcattggcaggaataaaaggggtcaaagggaggagagaagtactagagatgggaaaagctgtcagaaacacaaccgaatgccagtatggaccttgtttggattctgattaaaacaaaccaaccctcaaagaaatgtcataggtaattagggaaatttcattatgaactgggtatcacatggaattatcaatttgctaaatgtgataackttatcattgactaagaaaataactctatttttaaggatgtattcggaagtatgcagtggtaaaatgatgtgatatctcagaattgctttaagatacttcaacaaagaaaacaagaaaaacacaaagtgtggcaagacctcagtagccattctatctggatgatggaaataggaaaggtcatcgtgctattctttctgcttttgcctgggtttttatgcgtttgaaaattttcctcatgacattttgaaattttaaaagctactggtggctttgggaggccaaggcaggtggatcacttga

SEQ ID NO: 59046 - DNA, 601 bp, Human
ggcatgaagcccgggacagacccctgaaggagaaggggagagactggaagagaaggaaggagctttgggaagaggggaaaagaccatagcagagagctcagcctgaccacggacacgggcaggtgcacacccgtggctattgggccaggaggccaaccaaggcaagggagagaagctgttcacaccctggctgcgaggggccaggggaggggcacaggaacagcagcaggagatgtgggaaggacaaagaggaagcagaaggaaggccagaggaggggctgagaggggctgggcaggctcrggggatacctatgagaaacagcctccagacggggctggtctcctgtctctggcccgcaccaatgagccctggaaggaagttccggagggtcttgggtgcccaaccaggcagggaacagggctgctgccagcccatatggtgtctctggatcattttttacctcttccccaagggcacttctactgggaaaatgtcctactgattttgttagaagacattttcactgccatctgcaggatcactttagtaatcaatattcaaatctccattgtccactgcacacacgtggcacttgtgagt

SEQ ID NO: 59047 - DNA, 601 bp, Human
ccacagattcacatgaatgccacgaggatctcatctatgtcatctgtagccaaaatgttcccaaatctagctggacctgcttttttcttcttcccacagctgtccactgcccagtctttccctctgtccggagtcagccaccaagcccagggttcctactaagagagccccagatcagcagagatctcagaccaggcatccgagcttcctcacggtgagtgggccagggtgggtgaccaggcagagggaaactggcccctttcctcaggcagcccacaccttgccagcttcctctcctacygcaggctccgcctgcataccccgaagcttcttgcacaagctgtggtcacctccctccacaacactgtctgccccttcccaaggccttgctaagccttccccccacagacctcatgttcaagtttctgctgctcaagaaaaccttggtggccggcagtcttgtgactgcacctgccctgctcagatctggggcagagcagggcactggtcagaccgcagccactgccggctcctttttttaggttttcccagatggctcatgaatttctctcagatcgagtccaagccttcaagtgttctt

SEQ ID NO: 59048 - DNA, 601 bp, Human
agacaaccctttagtccagaagttcaaaggagagatgtgttctaggggaggaaagattccttccctgagaacctcaggaactgaagcagcttcagaagcaacttcagaagagaaccccgggagagacctggcttcaggctattcctgaagaggagatgggctgctctggccccagcaagaagaaccaggtgccctgacatgagataatgtaacagatgcacagataattgatggcttcatgagataatgtaacagatgtaacagataattgatggcttcagaaaatattctctggaaatgrgcaaaatgttgcttccaagtgccaaaggagaagactactagaaatctgtgtttcctttcccttagtttgtattttcatggttgttttgtttgtttttttgttttttgagacagaatcttgctctgtcacccaggctggagtgcgatggcacaatctcggctcactgcaacctctgcctccaaggttcaagccatcctcctgcctcagcctcccgagtagctgggattacaggtgcatgcgccactatgtctggctaatttctgtattttcagtagagatgggatttcacggtgttggcca

SEQ ID NO: 59049 - DNA, 601 bp, Human
gcacccagaaccaccaagtacataaagaatctcaaagacaaccctttagtccagaagttcaaaggagagatgtgttctaggggaggaaagattccttccctgagaacctcaggaactgaagcagcttcagaagcaacttcagaagagaaccccgggagagacctggcttcaggctattcctgaagaggagatgggctgctctggccccagcaagaagaaccaggtgccctgacatgagataatgtaacagatgcacagataattgatggcttcatgagataatgtaacagatgtaacagayaattgatggcttcagaaaatattctctggaaatgagcaaaatgttgcttccaagtgccaaaggagaagactactagaaatctgtgtttcctttcccttagtttgtattttcatggttgttttgtttgtttttttgttttttgagacagaatcttgctctgtcacccaggctggagtgcgatggcacaatctcggctcactgcaacctctgcctccaaggttcaagccatcctcctgcctcagcctcccgagtagctgggattacaggtgcatgcgccactatgtctggctaatttctgta

SEQ ID NO: 59050 - DNA, 601 bp, Human
ccagccttcagaaataacacacaagtaccacgggagacacaagagtgctttctgtatggcaggccaggctgcagactccaccgggttcccttgagagacagcccagctcctacattaccttcaggaagcaggttcctgaagtccagatttgatttttctaaaaaaactacggcagaatcctcagaacctcatcctctccctttctctcgcagcctgactccccctacaggcaggatgcaccacagagaagcccactgggtggtgagttggacctgcttccacgtggtcccttgatgaaggyggcttcatcacccaccagcctcagcctgagaagtaagatgaggtcagctgggaaggccaggcttaggcccacgggacacgatcccgggagcagaaggaaaggccgctgggggtgacaggccttccccatcaccgcaaactcctggttttctagctttttcctctcacagctacaagaaccccatgaactctgagggatctaggagagaggcacccagaaccaccaagtacataaagaatctcaaagacaaccctttagtccagaagttcaaaggagagatgtgttctaggggaggaaaga

SEQ ID NO: 59051 - DNA, 601 bp, Human
ttacagaggagacaaccgaggccctaccaggtcctgtaacttgccaaggtgacctggctggaatggcagaaatttaaacccaggcacttgggctccagaacctgcgttcttactatgctgggcagcagatccaccaagaggctgggctgagcagctcaacgggctgaattctttcaagaagaggaggcttaacctaaatgtagccaatggcagaacaggaaacccagcactgtgccatcctgttccctgaacagtaggggacagccgctacttttggtagctgttatgctagcctgagccrgcactaatttaccgaaaaccctaccctcaccctcttagaaccagatgtgctccttttctcactgaagcaaaactcacagactaagagtacactaggctggaaaggctttgacatcccctggctcaactctcacttgacaagtgaaaaaaacaagaagactctgagaggcaaagggatatcctaggctcatgataactcagggactggcctctgcccccacctcactactttctgggagagccacaacagagctcaggctgccctggactagcagtattgggatcagagactatacaagcc

SEQ ID NO: 59052 - DNA, 601 bp, Human
ttcaattcttacaagcctgtgaggttggtactattattattcccactttacagatgaggaagctgaggcgaccagaaggctaatgaacttgcctaaagccatggaactagtaagagaccaaatgaaacaaatgaaaagcaaagaatagcatagtggctgctggctgggctgaagagtagggaagtgaagccctggggggaggcaggaggctgggctggcctcaccgtcagtccaggcctcgtggatggaggccttctgccggaacttctctgccaggtggtccagtcgctccagcctccgkatctcattcagcaaccactcctcatagcccttctccacctgctccaggcagccccaggcattgttgatgtcctgtggggatgggaggtacagggtcagggtctggcttgggcctaggcttcaggtcccctagccccctagacccctgaaggtgccccatgccttccaggaagagcctcttccctatctctgccccatatccaccctagccaggctgccccaccatacctcccatctcccactggtattttctgggctcccaggagccaggcctcctgggcaaggcatgggacctgcatct

SEQ ID NO: 59053 - DNA, 601 bp, Human
tgaaaaccacaagcatgcaatgtactataatatttaagcctcacaacaacccatgaggagactgaattaggttgaatggggtcccccataaaactcatgtcaacccagaacctcaagatagaaccttatttggaaacaggctctttgcagacataattccttaagatgacattatacggctgggcacagtggctcacgcctgtaatcccaacacttcaggaggcagaagcagatggatcacctgagatcaggagttcaaaaccagcccgaccaacatggtgaaactaaaaatacaaaaatyagctgggaatggtggcaggcacctgtagtcccagctactagggaggctagggcaggagaatcacttgaacccacgaagtggaggttgcagtgagctgagatttcaccattgcattcgatcctggcaacaagaacacaattccatctcaaaaaaaaacccccataaaactaaaaaacaaagtgaacactcggggtagaggatttgactgcaaagtgaacactcacacagcactgcactatgcaggaactctcctcagaacttcgttatgtattaactgattcaattcttacaagcctgtga

SEQ ID NO: 59054 - DNA, 601 bp, Human
acaagcaggtcttgcgtttcttaaatttgtttccacaggaggaaagcaggaacaagaaatgacctcccagggccattgttagacgacgctcaccagctgccttgtgaagttgacaggcacaggatgggggctggcccagcctccctcactcacatacccaaccctctgctgctggtatgctcggcccatctcaataaataaggctgggctgggagccaaggttgtgtccccaggtggcatttctttccttccccctactctttcttctttaaaacagaatggtaatatataaagcttaggraaaaaattacaggtaagcctacttatccactcctattcagtctttccttatgtggatattctttgggcatatataaattatgtttcctgcttttaaaatatttagcagcacatgggccgggcacggtggctcacgcctgtaatcccagcactttgggaggccgaggcgggcagatcacgaggtcatcaggagatcgagaccatcctggccaacatggtgaaaccccatgtctactaaaaatacaaaaattagctgggcgtggtggcgcatgcctgtaatcccagctacttgggaggctga

SEQ ID NO: 59055 - DNA, 601 bp, Human
gaactggtggcctttaacaggatggcagtggtcccgggctccttccccaccaggagagatatttgtctcctgcgttgactccctccccacctgggcacccacctgtacccaccctccccatcttccacggccacacccccacctcccccagcagctgagaaagcccagcctcagcccctcaccacagggtaggggtgtctggggccacctacttgagctcctgtgcgatggcggcaatctgctccacacggtcctggtgggcagccaggtcactctcgaaggcctcatgcttcttgagcarggccttgatctccgagagggtggcggtctcatagtccttctgtcgcagcatggcctctttgcctgggttgagagagggccacatggctgagctggagtgagaagcatctccttggtcccaaccgcccacccctcagggccccaggagctccacttctgggggtgcttctcaaggaggtgcccattgtgcagggatctgcagggtgcaaaagcagatgtgcaactagaacatccaccaaccggcgcaacggggaaaagcactctcctcagagcacttccaaggccatgaaagtgtctacgc

SEQ ID NO: 59056 - DNA, 601 bp, Human
ctgggtctataaaatccttaggatgctcttcctcagggggcagtcctgcaaaagtgacccacagagcatgggccaggggccccaggggagccagcctccggggagtggaggtggggctcacctggatctcctcaatggtgtgcacaatgaaggtgtcctgcaggtcctccatggccccctccatccagttgttgaagggtgcagcccgcttggcatactccaagtacagctggtcaatggtctccagcagtttctcggtccgctgggagtgccaaatagggtaagggttagtacagtgatrtccagaatcatcccccactcctatcaagatcctcctggtgagccccaggtctagaagcactgactcaatcaggcagaaagaacaagctcttcctgccagctgtatgaaccatctcacatcacagtcacctggcctgggtcccagagtctggtgtgtagaataggagggttctcaaatggctggggttgggctgtaaagcacactaaactgggaggatgagacatgtgagggcaagagaggaggcatcgccatgagggcaaagtccaaatcctgtgccaaagtgaatcttccacatttagg

SEQ ID NO: 59057 - DNA, 601 bp, Human
ctactccccaaccatcaaaatggccaaagccatcaaacttggccttctgtgtggctgagtgtcaccagaggaaggggaaccaggacaaggacaacctactaggacaaggaccctagatgaccaaggggcagggtggcagcctctgcctgggagagcaaagaaaccaggacttgccaatgggggtcaggtcaggaaggagggcagatttgggggtaggaaagattgagacaaaaaaatgtgtgattccccgaacctccaaccccacagccacgcgcgcacacacacatacacacacacacactcttgcacagttaaaacaagtagccattttcaaagcagatgcctgagccagtgtttggagcccaccagcacccagaaccaccagaagtgcttattctgaactccaccccagaattagtgaagcaaattctagagatggggcctagaaatgtgcattctcaacacattccttgggaaagcagaaggtactaaaaattgaagatgtgaggcttcaggggtgaagttaatttatcctccaactatgacctgttcccttggagacttccccacccaggagaaagagcagaaggggccacgggct

SEQ ID NO: 59058 - DNA, 601 bp, Human
aggagaggacgagccccatggcccacaggagggggacaggagatccagacagagagaagagaaaaaggaaaaacgcattatttcttgccccagacgccacccctgagcgtgctccatgcaggaggcgagtacctgggggtcgttgccaatatcataacccaagctgatgaggcaggctttgaactcctcgggacccagtgtgccggagtgatcctggggccgcggtgcgccaggcagcgagccatgcggtgtcagggaggtggagccgtgaggggggcatgccccgggggagggtggcgtrtgtggggagacacagggacaggcatgcggagggagggtgggggggcgggggaggaggggaaataaaagtgcacacggttagacacaccaacgaggctccagggggtgccctccccccagcacacgcagccctgctccagggagcaggaccacagtggggtgtgatgagccacaagggtgagaagctccctcagaagtgacccagcccccccgcttccccaggggcttccccccaggtgcctagagagccatgaagcaggtggggtggtgggcagcacccaagcccatgctcccacgcctt

SEQ ID NO: 59059 - DNA, 601 bp, Human
agatttatggttttgggggtcaggataggtaaaggaacataggagaagatgcgaacacacatcggtggaaatgtccaaagacaggaggaagacagagcagggagatgcaaaaatccacccatgggatgaagagcagcgaggacggaagacagcgggcacccagtaggttgccatgaaagacagcagagggcagagggtggaccagtgatggggcagacagagacagcaggagaggacgagccccatggcccacaggagggggacaggagatccagacagagagaagagaaaaaggaaaaaygcattatttcttgccccagacgccacccctgagcgtgctccatgcaggaggcgagtacctgggggtcgttgccaatatcataacccaagctgatgaggcaggctttgaactcctcgggacccagtgtgccggagtgatcctggggccgcggtgcgccaggcagcgagccatgcggtgtcagggaggtggagccgtgaggggggcatgccccgggggagggtggcgtgtgtggggagacacagggacaggcatgcggagggagggtgggggggcgggggaggaggggaaataaaagtgcac

SEQ ID NO: 59060 - DNA, 601 bp, Human
tcagtacctactttgtaagccactttccaatctaattccatgtgccaattacacctataatcatcttctgaatcacactagtctgcaataattgcgtgctggagcagtatcagcagatactctggtggagcgtataggttcctggggagaccccacacgcactcaactgagctctctggacgcctcggacagacagtctaattttaatgagccctccagcagattaagaacaccatccatgtttgggcatcactgcttcccaaatatggccaggctatgttaagcagctttgcagaaatgygggccttgccccatgcaagcagctccagcctgggtatctaccttctcccaggtttgctcatgataggtctacttggaagctgcttcttttaggagcttcaagatccaggagagctcatttgggggctctgacccacaaggtagtcgccctgcaccatgccctacctctgccagagtgccctgggaaccagtttgagggagggtagagctgccactgtcaagccaaaagttgggagaccaggcccctagctgggccctagttttcctcctctacaaaattagccactacaactaaatggtt

SEQ ID NO: 59061 - DNA, 601 bp, Human
aacaaacgtcagataaaaggcatgggctcagggggcctggtgccagagcagacggcatcctatagagactatcttttactctggagaagctagagcagtacacacagtattcgacattcaggggtggggcctgagattctgtatttccaatgaactcccaggtgatgctgaacagctgccatctgtgggtcatctcgaatagcaagggatgagatgactcttaagagacaactcaagctgttccctgcagcaaaaataaaacgagtggggggaatgcagatgtcacagggctgtttggtgycgtggaaaaatgaaggtggggcttatcatcaagaagtcctttacacatccatgactttctgtccaactcataggagactgtgaagaaattaccttttcctttttaaaatgaagaaactgaagtgtaagaagattgaacacagcagggtcaaaaacattaggagtagatacaggtgccccacaccatccttgaccccacacacacttccagaaaacatcaagcaaggagcaggcaaagagctgtcataggagtgtggtttttttaataccatctgtgccaagcaatatcaaagttgtccat

SEQ ID NO: 59062 - DNA, 601 bp, Human
cccgggggcaagtgatgtaatgggttgcaaaacaaacgtcagataaaaggcatgggctcagggggcctggtgccagagcagacggcatcctatagagactatcttttactctggagaagctagagcagtacacacagtattcgacattcaggggtggggcctgagattctgtatttccaatgaactcccaggtgatgctgaacagctgccatctgtgggtcatctcgaatagcaagggatgagatgactcttaagagacaactcaagctgttccctgcagcaaaaataaaacgagtggggkgaatgcagatgtcacagggctgtttggtgtcgtggaaaaatgaaggtggggcttatcatcaagaagtcctttacacatccatgactttctgtccaactcataggagactgtgaagaaattaccttttcctttttaaaatgaagaaactgaagtgtaagaagattgaacacagcagggtcaaaaacattaggagtagatacaggtgccccacaccatccttgaccccacacacacttccagaaaacatcaagcaaggagcaggcaaagagctgtcataggagtgtggtttttttaatacca

SEQ ID NO: 59063 - DNA, 601 bp, Human
ttaaaggatgcccgggggcaagtgatgtaatgggttgcaaaacaaacgtcagataaaaggcatgggctcagggggcctggtgccagagcagacggcatcctatagagactatcttttactctggagaagctagagcagtacacacagtattcgacattcaggggtggggcctgagattctgtatttccaatgaactcccaggtgatgctgaacagctgccatctgtgggtcatctcgaatagcaagggatgagatgactcttaagagacaactcaagctgttccctgcagcaaaaataaaacgagtggggggaatgcagatgtcacagggctgtttggtgtcgtggaaaaatgaaggtggggcttatcatcaagaagtcctttacacatccatgactttctgtccaactcataggagactgtgaagaaattaccttttcctttttaaaatgaagaaactgaagtgtaagaagattgaacacagcagggtcaaaaacattaggagtagatacaggtgccccacaccatccttgaccccacacacacttccagaaaacatcaagcaaggagcaggcaaagagctgtcataggagtgtggtttt

SEQ ID NO: 59064 - DNA, 601 bp, Human
ttagccaaggatgaaatttaaaggatgcccgggggcaagtgatgtaatgggttgcaaaacaaacgtcagataaaaggcatgggctcagggggcctggtgccagagcagacggcatcctatagagactatcttttactctggagaagctagagcagtacacacagtattcgacattcaggggtggggcctgagattctgtatttccaatgaactcccaggtgatgctgaacagctgccatctgtgggtcatctcgaatagcaagggatgagatgactcttaagagacaactcaagctgttcmctgcagcaaaaataaaacgagtggggggaatgcagatgtcacagggctgtttggtgtcgtggaaaaatgaaggtggggcttatcatcaagaagtcctttacacatccatgactttctgtccaactcataggagactgtgaagaaattaccttttcctttttaaaatgaagaaactgaagtgtaagaagattgaacacagcagggtcaaaaacattaggagtagatacaggtgccccacaccatccttgaccccacacacacttccagaaaacatcaagcaaggagcaggcaaagagctgt

SEQ ID NO: 59065 - DNA, 601 bp, Human
ccagggagagaaggaaagcaacattatcggccccatttaaggaggtcacttgcccaaggtagtccaaatggccggtggcaggcagacgagctcacatctgcctcccttgacaggcactgatgttgaggttgtatttcttcccttggcgtccataacgcagaccctaaagtcttgtttgtgttggagagctttggagccttaaatttagaggcgcttcacacagctcatgccacccgcagaagtaccagagagcctggcataggccaaagaactggcaaagccttcagtctctcctcaccayctcaggaaattgaatctgttctccctcctagtaactcacttagccaaatgactacacttgttgggcactaaccccatgtccaagggacaactatgagctggtccagtgatggaggaggtgggtggcagctgggtcacactcctgccacagatttggtacccagaacagtcattaaggttttgtcaagggatggacaagccagagagaggagagatgggccttcatgaggatatcaacaaagtccctacaaaaaagtcggaggtagataaaaatattaggcaggaaagagatgtaatggat

SEQ ID NO: 59066 - DNA, 601 bp, Human
ttgtggcctcacatcactccaacccctgcttctgtcgtcacatttcctctgatgccgacatgcctgctccctaaggacccacccagataatccagaaccaatctccccacctcaagattcttaatcccatctgcaaagtcttatttgtcatatgaattaacaatcatgggttccagggactcggaaatggatatcttgggggaccattactcagcctactactaccctcagcacagagactgaaagagggttccccttaatggtatttttctgtaatcaggcctttttctttaagaatatyttaaacagcataacaaagcacagctgacttttttcccccattttacagacagggtcttgttatgttgttcaggctggactcaaaactcctgggctcaagtgatcctcacctcagcctcccaagcagctggcactacggacatgcaccaccacgccctgctagagctggttttttatacaactctagggacaatacccattgccacttattaaatgcctactgtgtgccagggagagaaggaaagcaacattatcggccccatttaaggaggtcacttgcccaaggtagtccaaatggccg

SEQ ID NO: 59067 - DNA, 601 bp, Human
ctgctgggcccagctattctggcctttttgggctctcagaacttggaagcttccttctcccctctccatgaatggcgcttttaaggcttaggagatcaagtccagcagctaaggcagcctcccaagggccaatgttgcacactcaggcctttgaagctagggcagtttctccagcaggtcatgcctataccacgggtcactgacgtcagggaggcagccagctccccagggcatgaacgatggagcacatattagcttcctatggttgctgtaacaaattatcacaaatgaagtggcttaraacaacacaaacgtattatctcacagttctggagaatagagacccaaaatgggtctgtagacctgcattctatctggaggctctcagggagaatctgtttccctggcttttctagcttctagaggctgtccgcattcattggcttgtggcctcacatcactccaacccctgcttctgtcgtcacatttcctctgatgccgacatgcctgctccctaaggacccacccagataatccagaaccaatctccccacctcaagattcttaatcccatctgcaaagtcttatttgtcatatgaat

SEQ ID NO: 59068 - DNA, 601 bp, Human
actatgcaacttttgatactggagcttgatcttaccaggaggtaagattaatggaagtttttgagacaaaagacaggactcacattcctgtctcaaataggcaggcaatgacactaagtcatgactgctatctggccaacagcaattgtaagacaccattaatcctaaagtgagatcaattgtatgctctatctcaatatcagagatgctaaaatgtgaaaattgatgaactgagacagttcttatgaggccaccttttgggttatcctaaaggtgatacccaatctagcccatgagcaayggccccagccttatccactgacaggcatcactttatcacaccaggtcagactgggccaagtgcctcctggacatttggaattgggactagtctcgtgtcaagaaaatgtcaacactaggcactgtggaattgacctctgccaccatggggaggtgtgcacccaaagctgggctgcagggagaggagggaggctgacacacagagaggggtcaagataagctatagagaaggcaggacctcagcctcccaagggctttccagttctgtggctggtgcctacctggagctgggctgccctct

SEQ ID NO: 59069 - DNA, 601 bp, Human
tttggtggatttgacaggcaatagggcccataggccatattatactcttcagatatgatcagatttatagatgctccattattttatgagctataaagtgtaaccagttaaaccataacacaatgctttctttagaattttattatgttctttatgtactcatatatgtacattattatatacttattgaaagagctcagacttttttagacttgtatcatggacaataagaggaaaccaaatttgctaaaattctcttctgaattccttgtcagagtcttttttttttttttttttttttgagacaaagtttcacactctcacccaggctggagtgcagtagcgcgatctcggctcaccgcaacctccgcctcccgggttcaagcaattctcctgcctcagcctcccgagtagctgagattacaggcacccaccaccacacccagctaattttttgtatttttagtagagacatagtttcaccatgttggtcaggctagtctcgaactcctgacctcatgattcacccgcctcagcctcccaaagtgctgggattacaggcatgagccaccgtgcccggcccagagtctttaagtgcctg

SEQ ID NO: 59070 - DNA, 601 bp, Human
ccttacattgcttttggattaagtttaggatgtatctttcttttcctcttccatcaaatatagaatccagatttggtggatttgacaggcaatagggcccataggccatattatactcttcagatatgatcagatttatagatgctccattattttatgagctataaagtgtaaccagttaaaccataacacaatgctttctttagaattttattatgttctttatgtactcatatatgtacattattatatacttattgaaagagctcagacttttttagacttgtatcatggacaatargaggaaaccaaatttgctaaaattctcttctgaattccttgtcagagtcttttttttttttttttttttttgagacaaagtttcacactctcacccaggctggagtgcagtagcgcgatctcggctcaccgcaacctccgcctcccgggttcaagcaattctcctgcctcagcctcccgagtagctgagattacaggcacccaccaccacacccagctaattttttgtatttttagtagagacatagtttcaccatgttggtcaggctagtctcgaactcctgacctcatgattcacccg

SEQ ID NO: 59071 - DNA, 601 bp, Human
attctcctgcctcaacctcccaagtagctgggattacaggcgcccaccaccacgcccagctaattttgtatttttagtagagactaggtttctccatgttggtcaggctggtctcaaacccccaacctcaggtgatctgcccgcctcggcctcaccaaagtgctgggattgcaggcgtgagccatcacgcccagagggacctaatattcttacagcttccacttctactgcttttcagtgagcattttccctggctgaactcctgggctctctgtaatggaactgctttcttccatggacyctgaaggctatgatggcttctggattggaccccacagggaacttcaacagatttaggtggctcctcagtttggggatgaagtaagggcgactttggtttctcaacttttaagagtagtcatttttttcccttaaccactgaaaatgcattccaagacttctactgaacaacctctaagattcttattctccccattttagggggcttcacttgacaggctctttgaatcggtatcaccaggttaacttctcacagacttcttccactctgaagaccttcccaggccctccagacatccct

SEQ ID NO: 59072 - DNA, 601 bp, Human
cataagttatagtagctttgggatataatcttttttttttttcttttttgagacagagttttgctcttgttgcccaggctggagtgcagtggcacaatctcggctcaccacaacctctgcctcccgggttcaagcaattctcctgcctcaacctcccaagtagctgggattacaggcgcccaccaccacgcccagctaattttgtatttttagtagagactaggtttctccatgttggtcaggctggtctcaaacccccaacctcaggtgatctgcccgcctcggcctcaccaaagtgctkggattgcaggcgtgagccatcacgcccagagggacctaatattcttacagcttccacttctactgcttttcagtgagcattttccctggctgaactcctgggctctctgtaatggaactgctttcttccatggaccctgaaggctatgatggcttctggattggaccccacagggaacttcaacagatttaggtggctcctcagtttggggatgaagtaagggcgactttggtttctcaacttttaagagtagtcatttttttcccttaaccactgaaaatgcattccaagacttctact

SEQ ID NO: 59073 - DNA, 601 bp, Human
tatttttgttggagctatcataagttatagtagctttgggatataatcttttttttttttcttttttgagacagagttttgctcttgttgcccaggctggagtgcagtggcacaatctcggctcaccacaacctctgcctcccgggttcaagcaattctcctgcctcaacctcccaagtagctgggattacaggcgcccaccaccacgcccagctaattttgtatttttagtagagactaggtttctccatgttggtcaggctggtctcaaacccccaacctcaggtgatctgcccgcctyggcctcaccaaagtgctgggattgcaggcgtgagccatcacgcccagagggacctaatattcttacagcttccacttctactgcttttcagtgagcattttccctggctgaactcctgggctctctgtaatggaactgctttcttccatggaccctgaaggctatgatggcttctggattggaccccacagggaacttcaacagatttaggtggctcctcagtttggggatgaagtaagggcgactttggtttctcaacttttaagagtagtcatttttttcccttaaccactgaaaatg

SEQ ID NO: 59074 - DNA, 601 bp, Human
tggggttaaaggcgtgagccagcctccaatacattctttactctgagagttccttattaggttctgtaaactccctctgactaaggaattctcctttatgatgtcccagagacatcataattttgttggagctatcatgtgttattgtatttttatatttttgttggagctatcataagttatagtagctttgggatataatcttttttttttttcttttttgagacagagttttgctcttgttgcccaggctggagtgcagtggcacaatctcggctcaccacaacctctgcctcccggsttcaagcaattctcctgcctcaacctcccaagtagctgggattacaggcgcccaccaccacgcccagctaattttgtatttttagtagagactaggtttctccatgttggtcaggctggtctcaaacccccaacctcaggtgatctgcccgcctcggcctcaccaaagtgctgggattgcaggcgtgagccatcacgcccagagggacctaatattcttacagcttccacttctactgcttttcagtgagcattttccctggctgaactcctgggctctctgtaatggaactgctttctt

SEQ ID NO: 59075 - DNA, 601 bp, Human
ggctaatttttgtatttttagtagagacagagtttcatcatattggccaggctggtctcaaactcctgacctcgtgatccacctgcctcagcctcccaaagtgctggggttaaaggcgtgagccagcctccaatacattctttactctgagagttccttattaggttctgtaaactccctctgactaaggaattctcctttatgatgtcccagagacatcataattttgttggagctatcatgtgttattgtatttttatatttttgttggagctatcataagttatagtagctttgggayataatcttttttttttttcttttttgagacagagttttgctcttgttgcccaggctggagtgcagtggcacaatctcggctcaccacaacctctgcctcccgggttcaagcaattctcctgcctcaacctcccaagtagctgggattacaggcgcccaccaccacgcccagctaattttgtatttttagtagagactaggtttctccatgttggtcaggctggtctcaaacccccaacctcaggtgatctgcccgcctcggcctcaccaaagtgctgggattgcaggcgtgagccatcac

SEQ ID NO: 59076 - DNA, 601 bp, Human
cttctttcataattcttgagcttttctttttttttttttttgagacggagtcttgctctgttgcctaggctggagtgcagtggcacaatctcggctcactgcaacctccgcctcccaggtgcaagcgattcttctgcctcagcctcccgagtagctgggactacaggcgtgcaccaccacacccggctaatttttgtatttttagtagagacagagtttcatcatattggccaggctggtctcaaactcctgacctcgtgatccacctgcctcagcctcccaaagtgctggggttaaaggygtgagccagcctccaatacattctttactctgagagttccttattaggttctgtaaactccctctgactaaggaattctcctttatgatgtcccagagacatcataattttgttggagctatcatgtgttattgtatttttatatttttgttggagctatcataagttatagtagctttgggatataatcttttttttttttcttttttgagacagagttttgctcttgttgcccaggctggagtgcagtggcacaatctcggctcaccacaacctctgcctcccgggttcaagcaattc

SEQ ID NO: 59077 - DNA, 601 bp, Human
caaggactagacattcaaagtgatactgaagatcatccccaacagaagccaccagcaactttttaatctcatgatttacctccttctgtatacggagctggtttcaaagaccttctttgtcctgtagtaatcttctttcataattcttgagcttttctttttttttttttttgagacggagtcttgctctgttgcctaggctggagtgcagtggcacaatctcggctcactgcaacctccgcctcccaggtgcaagcgattcttctgcctcagcctcccgagtagctgggactacaggcgygcaccaccacacccggctaatttttgtatttttagtagagacagagtttcatcatattggccaggctggtctcaaactcctgacctcgtgatccacctgcctcagcctcccaaagtgctggggttaaaggcgtgagccagcctccaatacattctttactctgagagttccttattaggttctgtaaactccctctgactaaggaattctcctttatgatgtcccagagacatcataattttgttggagctatcatgtgttattgtatttttatatttttgttggagctatcataagtta

SEQ ID NO: 59078 - DNA, 601 bp, Human
aaaacaaaactgctcttgatgctcttgacttggttaactcatctgccattaccctgcttgcaaggaatttactttgccatatatcacactgtattaacacacgttctgtttggaaagctgagctgtatttcaacctagggcttcattttctaaaataagctgatttttctcaaggactagacattcaaagtgatactgaagatcatccccaacagaagccaccagcaactttttaatctcatgatttacctccttctgtatacggagctggtttcaaagaccttctttgtcctgtagtaaycttctttcataattcttgagcttttctttttttttttttttgagacggagtcttgctctgttgcctaggctggagtgcagtggcacaatctcggctcactgcaacctccgcctcccaggtgcaagcgattcttctgcctcagcctcccgagtagctgggactacaggcgtgcaccaccacacccggctaatttttgtatttttagtagagacagagtttcatcatattggccaggctggtctcaaactcctgacctcgtgatccacctgcctcagcctcccaaagtgctggggttaaagg

SEQ ID NO: 59079 - DNA, 601 bp, Human
tgcctgccaccacacctggctaattttttgtatttttagtagagatggggtttcaccatgttggctaggctggtcttgaattcttgaccttgtaatccacccgcctcagcctcccaaagcgctgggattacaggcgtgagccaccgcgcctggccccccgtatccttttacaagtgctcacaagccatctttcaaatagcttgtttccagaagccagcttccccagctattggagtttgcaaaatttctcttgcattgttggttggaaaagtaggacttaaggagatttctagacaagaaagcatgattagaaatggaagatgctacagagtgcaattagaaagtatatcttaaggtaatctgtgataagaggggatttttatattgccttttttaagttgacattaaaatatattattatttgaccaggtttgtcttttgaagacttctctactgataggcacttctgcaacaaatttgcataatttgatataaatattttgtaattattcttaaaggccaatcaatgggtatttatgatggctcataataaatatacaatagtatatattacataatatatattaattgatgggttgca

SEQ ID NO: 59080 - DNA, 601 bp, Human
ggggggatggaatctcgctctgttgcccaggctggagtgcagtggctcggcctcagctcactgcaacctctgcctcatgggttcaagtgattctcctgcctcagcctcctgagtagctagggttacagctaggattacaggtgcctgccaccacacctggctaattttttgtatttttagtagagatggggtttcaccatgttggctaggctggtcttgaattcttgaccttgtaatccacccgcctcagcctcccaaagcgctgggattacaggcgtgagccaccgcgcctggccccccstatccttttacaagtgctcacaagccatctttcaaatagcttgtttccagaagccagcttccccagctattggagtttgcaaaatttctcttgcattgttggttggaaaagtaggacttaaggagatttctagacaagaaagcatgattagaaatggaagatgctacagagtgcaattagaaagtatatcttaaggtaatctgtgataagaggggatttttatattgccttttttaagttgacattaaaatatattattatttgaccaggtttgtcttttgaagacttctctactgatag

SEQ ID NO: 59081 - DNA, 601 bp, Human
tcacagcatgcagaaatgtccctgcaagttgtcagatgcataagccagcacattctggcatgttggtttccacagccacttagtcctctagtgggactctccatccactcccctttccccatcgttcccaccaggattagaggagacgctgcttgtctgaatttcagcaaggacagagacattttcatattgctcttctgtagagcctggtatccaaccccaaaagaagagttaatcaagcagagcctcttctacctgggactgggctgggcccaaggatccctgtatcttttttttttgtgggggggggggggggatggaatctcgctctgttgcccaggctggagtgcagtggctcggcctcagctcactgcaacctctgcctcatgggttcaagtgattctcctgcctcagcctcctgagtagctagggttacagctaggattacaggtgcctgccaccacacctggctaattttttgtatttttagtagagatggggtttcaccatgttggctaggctggtcttgaattcttgaccttgtaatccacccgcctcagcctcccaaagcgctgggattacaggcgtgagccaccgcgcc

SEQ ID NO: 59082 - DNA, 601 bp, Human
tattaaggtctttttgaacctcaaatctcccacttactttattggcttcaaaatggccatgagtttgatgagtccaagtcattaagaaaaatgactggctgggaataatcactggtcctcacagcatgcagaaatgtccctgcaagttgtcagatgcataagccagcacattctggcatgttggtttccacagccacttagtcctctagtgggactctccatccactcccctttccccatcgttcccaccaggattagaggagacgctgcttgtctgaatttcagcaaggacagagacatyttcatattgctcttctgtagagcctggtatccaaccccaaaagaagagttaatcaagcagagcctcttctacctgggactgggctgggcccaaggatccctgtatcttttttttttgtgggggggggggggggatggaatctcgctctgttgcccaggctggagtgcagtggctcggcctcagctcactgcaacctctgcctcatgggttcaagtgattctcctgcctcagcctcctgagtagctagggttacagctaggattacaggtgcctgccaccacacctggctaattttttgta

SEQ ID NO: 59083 - DNA, 601 bp, Human
gctggaagtcattttgctgccttggagagagacacttttgagaatggggtccagccagagaagctaggccctgctggcatttgagcctctgcctcagccacctggaaagtcagcattacctctgaacacttcagttatttgagccagtaacttatcctttttttttttttttttttttcccaagacagagtcttactctgctgagtgcagtggtgggatctcagctcactgcaacctccacctcctgggctcaagcaattcttatgcctcagcctccctgagtagctgggactacaggcaygtgccaacatgcccagctaattttttgtattttagtagagacgaggtttcgccatgttgcacaggctggtctcgaactcctgagctcaggcaatccacccaccttggcctcccaaagtgctgggattacgggcatgagccatcacacccagcttatccttctatctttaccagcttagattgggttttaagtttcctgcacccagaagggtcctaaccactacacaatctaatggttactgtcacccacaaatgacagtgggttgggtacattgatgacttattacatttattatctcat

SEQ ID NO: 59084 - DNA, 601 bp, Human
gggctctgggaaccccaagatgaatcagacccagccactgccctaagtgcttacttcatgttttgggctgactttagcatgtcaccatgcctctaattttccctctgaaaagggacccaattgtccaggcatggtggctcatgcctgtaatgccagcactttgggaggctgagttgggtggatcatttgaggccaggagtttgagaccagcctggccaacattgcaaaaccccgtctctactaaaaatacaaaaattagctgggtttggtggcaggtacctgtaactcagctactcaggargctgagacaggagaattgcttgaacccagggggtggaggttgtagtgagctgagatcataccatggcactccaacttgggcaacagagtgagactctgtctcaaaaaagaaaagaaaagggacccagtcatggtacttaccctgaaagtttgggtttaacacagaatcggacatccagtaaacatttaatgaacgttagtccctgcagtgagatagatgagtccccaccctgtgttgtacgggggaggacacagtggtgggcgtggcatggagcttatgccaggaggtggggtgaaatta

SEQ ID NO: 59085 - DNA, 601 bp, Human
cttcccctgccagctgcagagtcagcacgtggcaggggacgctggcacttggggccggaagggacccgaagacgcccctgaccctcacccgagcctcctgcctaggctggtcaatgtcaccatccacttccggctgaagaccattaacctccagagcctcatcaataatgagatcccggactgctataccttcagcgtcctggtgaggccccccgggaacccacagggctcctgagttccagggcagggacctggtcagggagtgtcttgggagcactggccaagggcaagcgtgcgggtratgagggagggagcccggggtctgtcaggccacctgtcatgtggaccttggggcttggggctgccaaggtttactctgcccccaactggcccccacagatcacgtttgacaacaaagcacacagtgggcggatccccatcagcctggagacccaggcccacatccaggagtgtaagcaccccagtgtcttccagcacggtgagcccctgagccccagaccagcactgaccaggggccctggcctgtcctgggattccccaagccccagatcagcgctgcctgggggccgtgacctcccca

SEQ ID NO: 59086 - DNA, 601 bp, Human
cctgtgctgagatcccccaagccccagaccagcactgaccggggttcttgactcaccccaagcaagccctgagcccactgaccaaccaaaaccagccgtgcagccccctaggtctccagcctggcctggcaccaatgctagcctcccaaggctccatgccatccttggccctacccgctctgccctccccgcaggagacaacagcttccggctcctgtttgacgtggtggtcatcctcacctgctccctgtccttcctcctctgcgcccgctcactccttcgaggcttcctgctgcagaaygtgaggcttctgcgtcatgtgtgctggtgtcctccccgcctggccctggggcgataaaagccagggctttgagggtcctgtgcctggtcaggccctcaccccgcctgccttctgcaggagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaaggtgcgtcctgccaacaccctgggccccaggtcc

SEQ ID NO: 59087 - DNA, 601 bp, Human
gcgtcctgccaacaccctgggccccaggtcccatccctgctgtcagtgcctatccggggccatatcctcccccaggccccccaaaggaagggctgggccagataggttgacgcagctcccacccgcagaacttggcgagctacgacgtctgcagcatcctcctgggcacctcgacgctgctggtgtgggtgggcgtgatccgctacctgaccttcttccacaactacaatgtgagttttgcacatgcagctgggccttccacatggttactccacaccctccaaataaatccctacacacrcagccctcaccagccccggccaatggccccttgcaagcctcctcctcctacctgcccacaccagatatatctgtcactgcacctgcgcggggccccgggagcctgctcctttgtgcccacccagctgagtctagccgtgcgttgccctcggaccccctcagacgtggccacgccccctctaggcacccactggctcccatgaccacaccggctgtgccctcggcaaggccccgcccctcccacccccatctgggtgcccacagctgacctgagttgtggccacaccctcaacgaggctcc

SEQ ID NO: 59088 - DNA, 601 bp, Human
cactttggcctcccaaagtgctgggattacaggcgtaagccaccacacccagcctattattattattttttttttgaaatggaatcttaccctgtggcccaggctggagtgcaatggcatgatctcggctcactgcaacctccaccttctgagttgaagcgatccttgtgcctcagcctcctgagtagctgggattacttgcacgtgccaccacacctggctaatttttgtatttttactagagatggggtttcaccacgttggccaggctggtctcgaactcctgacctcaggtgatccmcctgccttggcctcccaaggtgctgggatttcaggcatgagccactgaacccagctaagtcatacagtttcaatgaccttgtcattgaccctgggacgttgccattaacatggtgatcctcagctggccccattcctatggcggacctctaaaaacccaaccctgaccccagcccccagccatgcccccgactccctctgaccctgcccaaggttagcttctttatttatttattttttttgagacggagtctcgctgtgtcacccaggctggagtgcagtggtgcaatctcggctcact

SEQ ID NO: 59089 - DNA, 601 bp, Human
ggagaggctgataacggggctggcccaggctggggataaccacaaggcaggaagactcggggccagcagctagccagcccacacctcctctccacctcaccctggggagagcccccaggggagagcagggcagcccccgccccctcacctgtgactgcgctgctgtacaattcattttcctccatgcagggccggctctgctttccctctggccccgagagctccttcctctgcccctagggaggaggcgccccgtctcatcaccttccccgatccccaggcccccctctggcccaggccktctttcaggccacctcaacctgctggctctgtctgcacactgggttcgggtccccccacatggaggaagcaccccatcaccctgaccttgacacctgtaacacttgcccacaggaagtatctaacaccctcggcctgcacgcccccttgccctttccgcaccccgcgcgactcacggggaaggccaggaggcagatggcctgcacccagtcgccgcgctccgctgcaggggccgccaggaggtacaggcgctccttggtctccaggaagaaggcactggtgtcccgggggctgctggcct

SEQ ID NO: 59090 - DNA, 601 bp, Human
ctcctgcgggctgtcatagagggacagggcagccactccctcgggctcatcgtatatgtggtcaggtcgagggggcagggtctcctcaatgctgtcgtacagagggtcggccaggagctgaggagggactgccaagatgcccctgaagttcttccccaaggaacgggccaccgcatcgaagggcacggcatactccccctcctggccccgaggccgtggagcaggcaccggtgtggtgggtgaaggcggcggcagtgagtcatgcggccgagagtaggggctatcaggccggggcagcgasgcggggattgtggctggctgcggttggggtgtagcgggtgcagcattcttctgggcagagatggcctcttccagggccaagaagatctcattgccttgccgggtttcgaactcaaagttgccctctccagagacgcagcgacggcctgcctcaaaggaaaaggttacctggaccagggagaaagcaggttattggccaggccacagggcaggggtgcatttttttttttttttttggagacagagtctcactgtgtctccaggctggagtgcagtggcacaatctcagctcactgcaacc

SEQ ID NO: 59091 - DNA, 601 bp, Human
tgactggggagactgctaacctggagaatgtggatgcatttctcaggagagggagaggaccgcctgcctgcacacgaggtgagtccaaggcaccggctgagctggcctgatgggtggggcggcagcacctcacctgtaccagggcaccccaggaggctgcacccagtgacgtgggctgaggatggggccggcccctctctctgcataggaagctggcctctcagtgtgaggagtcgtcttgcaggggaagcagcaatctcatccacataggatactgtctacatgtccaggacaaggatgyaggcagctgcctgtgacaagcgccatgaccctgccaggctcactccttggcggctcacagaccctgaaggcttggcagggcttgcctgctgccttctgccaactgcaggccactcaaccacgggatgctttcctgctgcttgttcctcgtcccttgggacacggaggcagccatccgagactcacatcagccccattgtccccagccctggggatgggaaactcttgcaggtaccagagcttacctgaggccatctcagacaaaagtaagcagagagtaaacagcagaaggtaggaagtt

SEQ ID NO: 59092 - DNA, 601 bp, Human
actttctgaactggagtgcttgctttcaggatcatccttcccagcccctcattctgcagatgaataaaccaaggcttagcaccatgtgactcgtgtgaacaaggatagggctgggataaaacatgttcccgattcctcccgcacgtcccaccatcatgtcagggtcatggctgctttggcccagagaagctgacatacacctggctcacaggaagccccctcctattgactggggagactgctaacctggagaatgtggatgcatttctcaggagagggagaggaccgcctgcctgcacasgaggtgagtccaaggcaccggctgagctggcctgatgggtggggcggcagcacctcacctgtaccagggcaccccaggaggctgcacccagtgacgtgggctgaggatggggccggcccctctctctgcataggaagctggcctctcagtgtgaggagtcgtcttgcaggggaagcagcaatctcatccacataggatactgtctacatgtccaggacaaggatgcaggcagctgcctgtgacaagcgccatgaccctgccaggctcactccttggcggctcacagaccctgaaggcttg

SEQ ID NO: 59093 - DNA, 601 bp, Human
caaaatccattgtagcaactggcagcatgaaaagttctgcatttagaatgcttttgtactcagctttcagatggaaaaactgaggcataattggaataaattaagcctatctgctggatacagtgatggcctagagaaacttacaataggatcttacagagactttctgaactggagtgcttgctttcaggatcatccttcccagcccctcattctgcagatgaataaaccaaggcttagcaccatgtgactcgtgtgaacaaggatagggctgggataaaacatgttcccgattcctccygcacgtcccaccatcatgtcagggtcatggctgctttggcccagagaagctgacatacacctggctcacaggaagccccctcctattgactggggagactgctaacctggagaatgtggatgcatttctcaggagagggagaggaccgcctgcctgcacacgaggtgagtccaaggcaccggctgagctggcctgatgggtggggcggcagcacctcacctgtaccagggcaccccaggaggctgcacccagtgacgtgggctgaggatggggccggcccctctctctgcataggaagct

SEQ ID NO: 59094 - DNA, 601 bp, Human
gagtggctcatgcctataatcccagaactttgggagtctgaactaggagggttgcttgtgcccaggagtttgagaccagcctggtcaacacagtaagaccttatctctacgaaaaaataaaaataaaaaaattagccaggtgtggtggtgcatgcctgtagtcacagtttcttgggaggctgaggtgggaggatggcctgagctcaggaggcagaggctgcagtgaggcgagatcacaccactgcactttagcctgggtgacagagtgagaccctgtctcaaaaaaaaagcaaagcaaaamcaaaaaccaaaaaccaaaaaccaaaaaaaaaaaaaaaaaacaaaatccattgtagcaactggcagcatgaaaagttctgcatttagaatgcttttgtactcagctttcagatggaaaaactgaggcataattggaataaattaagcctatctgctggatacagtgatggcctagagaaacttacaataggatcttacagagactttctgaactggagtgcttgctttcaggatcatccttcccagcccctcattctgcagatgaataaaccaaggcttagcaccatgtgactcgtgtgaa

SEQ ID NO: 59095 - DNA, 601 bp, Human
gactgaaccaccatcagaaagaaatttctcactgctactcagtaaaaacatatgcacacaccccaaactgaaatatgggtgtaattaaatagcatctacttttactacatggcatgaagtaatattttctattcctttaaaaaaacatgggccgggcgtggtggctcatggctgtaatcccagcactttgggaggcggaggcaggcggaccatgaggtcaggagttaaagaccagcatgaccagcatggtgaaaccccgtctgtactaaaaaatacaaaaattagccaggcttggtggcaygcacctgtaatcccagctaactcaggaggctgaggcaggagaattgcttgaacccaggaggtggaggttgcagtgagctgagattgtgccattgcactccagcctgggtgacagagcaagactccatctcaaaaaaacaaaacaaaacaaaacaaaaaaacacggtaggctgagtggagtggctcatgcctataatcccagaactttgggagtctgaactaggagggttgcttgtgcccaggagtttgagaccagcctggtcaacacagtaagaccttatctctacgaaaaaataaaaat

SEQ ID NO: 59096 - DNA, 601 bp, Human
agatataatagactgaaaacaaaaattctttatgttaacaaagtgcctttcaaacccttttgagtttggactgaaccaccatcagaaagaaatttctcactgctactcagtaaaaacatatgcacacaccccaaactgaaatatgggtgtaattaaatagcatctacttttactacatggcatgaagtaatattttctattcctttaaaaaaacatgggccgggcgtggtggctcatggctgtaatcccagcactttgggaggcggaggcaggcggaccatgaggtcaggagttaaagacmagcatgaccagcatggtgaaaccccgtctgtactaaaaaatacaaaaattagccaggcttggtggcatgcacctgtaatcccagctaactcaggaggctgaggcaggagaattgcttgaacccaggaggtggaggttgcagtgagctgagattgtgccattgcactccagcctgggtgacagagcaagactccatctcaaaaaaacaaaacaaaacaaaacaaaaaaacacggtaggctgagtggagtggctcatgcctataatcccagaactttgggagtctgaactaggagggttgct

SEQ ID NO: 59097 - DNA, 601 bp, Human
cgagaatagcttctcataattcaatttagatataatagactgaaaacaaaaattctttatgttaacaaagtgcctttcaaacccttttgagtttggactgaaccaccatcagaaagaaatttctcactgctactcagtaaaaacatatgcacacaccccaaactgaaatatgggtgtaattaaatagcatctacttttactacatggcatgaagtaatattttctattcctttaaaaaaacatgggccgggcgtggtggctcatggctgtaatcccagcactttgggaggcggaggcaggyggaccatgaggtcaggagttaaagaccagcatgaccagcatggtgaaaccccgtctgtactaaaaaatacaaaaattagccaggcttggtggcatgcacctgtaatcccagctaactcaggaggctgaggcaggagaattgcttgaacccaggaggtggaggttgcagtgagctgagattgtgccattgcactccagcctgggtgacagagcaagactccatctcaaaaaaacaaaacaaaacaaaacaaaaaaacacggtaggctgagtggagtggctcatgcctataatcccagaact

SEQ ID NO: 59098 - DNA, 601 bp, Human
gtcaagtgagtgattattcttgggggtaggagggagttgtgactgggaaggctcgagaatagcttctcataattcaatttagatataatagactgaaaacaaaaattctttatgttaacaaagtgcctttcaaacccttttgagtttggactgaaccaccatcagaaagaaatttctcactgctactcagtaaaaacatatgcacacaccccaaactgaaatatgggtgtaattaaatagcatctacttttactacatggcatgaagtaatattttctattcctttaaaaaaacatgggcygggcgtggtggctcatggctgtaatcccagcactttgggaggcggaggcaggcggaccatgaggtcaggagttaaagaccagcatgaccagcatggtgaaaccccgtctgtactaaaaaatacaaaaattagccaggcttggtggcatgcacctgtaatcccagctaactcaggaggctgaggcaggagaattgcttgaacccaggaggtggaggttgcagtgagctgagattgtgccattgcactccagcctgggtgacagagcaagactccatctcaaaaaaacaaaacaaaacaaaa

SEQ ID NO: 59099 - DNA, 601 bp, Human
aacatggacaaaagacaaacaggtattttacaaaaaataacccagttgcctgtaactatgtataaaagggcccaacttattatttatcggggaaatgcagattaaaactccagtgagctattgctacactcaccaggtggttaaaatttaaaaataattgatgttatcaaatgttggcaaggatacagagcaagaggaactcttattcactgcttgtgggagtgcaaattggtgtaaataatcttggaaaacagtttggcattgtccaatacaattgaatatatgcatagcctatgatccrgtgatgcaacttttcagcatgtagaaatagaggcataagggcacctactggccaatagaaatgtgtgcacaaaccaagctgtactattcaacctgaatattaattagtgtggcaaaagtgtaaatatgaaaagttaccaccataaaagtcaagtgagtgattattcttgggggtaggagggagttgtgactgggaaggctcgagaatagcttctcataattcaatttagatataatagactgaaaacaaaaattctttatgttaacaaagtgcctttcaaacccttttgagtttggactg

SEQ ID NO: 59100 - DNA, 601 bp, Human
ttgacaaaaggcttgcatagaaaatacataaagaactacaaaccaataagaaaagacagataatccaaaagaaaacatggacaaaagacaaacaggtattttacaaaaaataacccagttgcctgtaactatgtataaaagggcccaacttattatttatcggggaaatgcagattaaaactccagtgagctattgctacactcaccaggtggttaaaatttaaaaataattgatgttatcaaatgttggcaaggatacagagcaagaggaactcttattcactgcttgtgggagtgcaarttggtgtaaataatcttggaaaacagtttggcattgtccaatacaattgaatatatgcatagcctatgatccggtgatgcaacttttcagcatgtagaaatagaggcataagggcacctactggccaatagaaatgtgtgcacaaaccaagctgtactattcaacctgaatattaattagtgtggcaaaagtgtaaatatgaaaagttaccaccataaaagtcaagtgagtgattattcttgggggtaggagggagttgtgactgggaaggctcgagaatagcttctcataattcaattt

SEQ ID NO: 59101 - DNA, 601 bp, Human
gcagtaaccttacggaaaaagacatgacacattcgactacattgaaatcatgataaaagcctcttttctaggaaagtttccattaagagagtgaaaaatcaaaacacaaagcaagagaagatatttgtgatgtatataattgacaaaaggcttgcatagaaaatacataaagaactacaaaccaataagaaaagacagataatccaaaagaaaacatggacaaaagacaaacaggtattttacaaaaaataacccagttgcctgtaactatgtataaaagggcccaacttattatttatcrgggaaatgcagattaaaactccagtgagctattgctacactcaccaggtggttaaaatttaaaaataattgatgttatcaaatgttggcaaggatacagagcaagaggaactcttattcactgcttgtgggagtgcaaattggtgtaaataatcttggaaaacagtttggcattgtccaatacaattgaatatatgcatagcctatgatccggtgatgcaacttttcagcatgtagaaatagaggcataagggcacctactggccaatagaaatgtgtgcacaaaccaagctgtactatt

SEQ ID NO: 59102 - DNA, 601 bp, Human
ccacacacacacacacacacacacacacacacacacacacacaccccattgccagatggattataagtctaaatgtaaaaagaaaaaggataagcttttagaagacaatactggggactatcttcatgtctttgatgtaaagaaagtcttcttaaacaagatagaaagtgcagtaaccttacggaaaaagacatgacacattcgactacattgaaatcatgataaaagcctcttttctaggaaagtttccattaagagagtgaaaaatcaaaacacaaagcaagagaagatatttgtgatstatataattgacaaaaggcttgcatagaaaatacataaagaactacaaaccaataagaaaagacagataatccaaaagaaaacatggacaaaagacaaacaggtattttacaaaaaataacccagttgcctgtaactatgtataaaagggcccaacttattatttatcggggaaatgcagattaaaactccagtgagctattgctacactcaccaggtggttaaaatttaaaaataattgatgttatcaaatgttggcaaggatacagagcaagaggaactcttattcactgcttgtggg

SEQ ID NO: 59103 - DNA, 601 bp, Human
ggggctactagaggggaaggaggcagaggagtgtggaaaactaactgtggggtactatgctcattacctgggtgacaagatcacattccattcctcagcatctgagtgggtctgggttggggctgataatttgcattttaaaacaagctcctaggtgacactgaagcttctggtccagaggccatacttttacaacctttggtctggaatattgaggttccttcctgttggagcagtctatgctgctttcagtctaggggccttttaaaagcacttgcctttaacattttcatgacatttrccttcaccttgtgttcgatattgctgtgcctgtgtctgtttctcttacgtgcttcttaaggatgttagtgtaatctaaatgcttctgaaggtttttgttttccaataattgtggaccaggcagcccaaaaagaacagctagaatatctgacatacacacacacacacacacacacacacacgcacgcacatgtgcactttgtaggtattagagaaccaacagtaaagaattactaggtcaagatttgagagaaagaccgaaacaaaagcaggaacatcacatcctactaacataaaaaaa

SEQ ID NO: 59104 - DNA, 601 bp, Human
aaaagaaagccaagtaccacatgttctcagttataagtgggggctaaacactgagacactgggggctactagaggggaaggaggcagaggagtgtggaaaactaactgtggggtactatgctcattacctgggtgacaagatcacattccattcctcagcatctgagtgggtctgggttggggctgataatttgcattttaaaacaagctcctaggtgacactgaagcttctggtccagaggccatacttttacaacctttggtctggaatattgaggttccttcctgttggagcagtctwtgctgctttcagtctaggggccttttaaaagcacttgcctttaacattttcatgacatttgccttcaccttgtgttcgatattgctgtgcctgtgtctgtttctcttacgtgcttcttaaggatgttagtgtaatctaaatgcttctgaaggtttttgttttccaataattgtggaccaggcagcccaaaaagaacagctagaatatctgacatacacacacacacacacacacacacacacgcacgcacatgtgcactttgtaggtattagagaaccaacagtaaagaattactaggtc

SEQ ID NO: 59105 - DNA, 601 bp, Human
gccaatatcctaaacaaattaacacaggaaaagaaagccaagtaccacatgttctcagttataagtgggggctaaacactgagacactgggggctactagaggggaaggaggcagaggagtgtggaaaactaactgtggggtactatgctcattacctgggtgacaagatcacattccattcctcagcatctgagtgggtctgggttggggctgataatttgcattttaaaacaagctcctaggtgacactgaagcttctggtccagaggccatacttttacaacctttggtctggaatawtgaggttccttcctgttggagcagtctatgctgctttcagtctaggggccttttaaaagcacttgcctttaacattttcatgacatttgccttcaccttgtgttcgatattgctgtgcctgtgtctgtttctcttacgtgcttcttaaggatgttagtgtaatctaaatgcttctgaaggtttttgttttccaataattgtggaccaggcagcccaaaaagaacagctagaatatctgacatacacacacacacacacacacacacacacgcacgcacatgtgcactttgtaggtattag

SEQ ID NO: 59106 - DNA, 601 bp, Human
tgtgtgatcttttgcaaaccactcaacctctctaggcagcagcttctcaaatttaaaacggaggagactacgcagccataaaaaagaatgaaggtgtgtcctttgcagcaacacagatgcagctggaggccaatatcctaaacaaattaacacaggaaaagaaagccaagtaccacatgttctcagttataagtgggggctaaacactgagacactgggggctactagaggggaaggaggcagaggagtgtggaaaactaactgtggggtactatgctcattacctgggtgacaagatcayattccattcctcagcatctgagtgggtctgggttggggctgataatttgcattttaaaacaagctcctaggtgacactgaagcttctggtccagaggccatacttttacaacctttggtctggaatattgaggttccttcctgttggagcagtctatgctgctttcagtctaggggccttttaaaagcacttgcctttaacattttcatgacatttgccttcaccttgtgttcgatattgctgtgcctgtgtctgtttctcttacgtgcttcttaaggatgttagtgtaatctaaatgct

SEQ ID NO: 59107 - DNA, 601 bp, Human
aaaggaattgcagcaaagttagtgagagggtactttgattacattctgtgttccacatctaatctactgtgtgatcttttgcaaaccactcaacctctctaggcagcagcttctcaaatttaaaacggaggagactacgcagccataaaaaagaatgaaggtgtgtcctttgcagcaacacagatgcagctggaggccaatatcctaaacaaattaacacaggaaaagaaagccaagtaccacatgttctcagttataagtgggggctaaacactgagacactgggggctactagaggggaaggaggcagaggagtgtggaaaactaactgtggggtactatgctcattacctgggtgacaagatcacattccattcctcagcatctgagtgggtctgggttggggctgataatttgcattttaaaacaagctcctaggtgacactgaagcttctggtccagaggccatacttttacaacctttggtctggaatattgaggttccttcctgttggagcagtctatgctgctttcagtctaggggccttttaaaagcacttgcctttaacattttcatgacatttgccttcaccttgtgttc

SEQ ID NO: 59108 - DNA, 601 bp, Human
cagaccagaatggatgcctcctgatctcacttcagttctcattccacttcaccacactgctggttgactgtggtgtcacggtgcataaccagaactaatttctggcattaccttccaggatctagtacattatgggacacaaaaggaattgcagcaaagttagtgagagggtactttgattacattctgtgttccacatctaatctactgtgtgatcttttgcaaaccactcaacctctctaggcagcagcttctcaaatttaaaacggaggagactacgcagccataaaaaagaatgaargtgtgtcctttgcagcaacacagatgcagctggaggccaatatcctaaacaaattaacacaggaaaagaaagccaagtaccacatgttctcagttataagtgggggctaaacactgagacactgggggctactagaggggaaggaggcagaggagtgtggaaaactaactgtggggtactatgctcattacctgggtgacaagatcacattccattcctcagcatctgagtgggtctgggttggggctgataatttgcattttaaaacaagctcctaggtgacactgaagcttctggtcc

SEQ ID NO: 59109 - DNA, 601 bp, Human
cagatgaaggaacaaggtccagtgatgtccgcagagcatgtagctggtcaaagaccaaccccagaccagaatggatgcctcctgatctcacttcagttctcattccacttcaccacactgctggttgactgtggtgtcacggtgcataaccagaactaatttctggcattaccttccaggatctagtacattatgggacacaaaaggaattgcagcaaagttagtgagagggtactttgattacattctgtgttccacatctaatctactgtgtgatcttttgcaaaccactcaacctctstaggcagcagcttctcaaatttaaaacggaggagactacgcagccataaaaaagaatgaaggtgtgtcctttgcagcaacacagatgcagctggaggccaatatcctaaacaaattaacacaggaaaagaaagccaagtaccacatgttctcagttataagtgggggctaaacactgagacactgggggctactagaggggaaggaggcagaggagtgtggaaaactaactgtggggtactatgctcattacctgggtgacaagatcacattccattcctcagcatctgagtgggtctgg

SEQ ID NO: 59110 - DNA, 601 bp, Human
cctctccaagtgattatctgttattagagagatcaactgagcatataaatttgaaagcactttgaaatcgagaaggtttatacacctttgttcttgattgttcttctcagtaatcaaatggttgggtatatatatgctgagtaagcagaggaggcccaaatttaatatggatgtagctttttagagccaggatggacttcggaactcaattaattcaacctttctgtgatcctctccccagatgaaggaacaaggtccagtgatgtccgcagagcatgtagctggtcaaagaccaaccccrgaccagaatggatgcctcctgatctcacttcagttctcattccacttcaccacactgctggttgactgtggtgtcacggtgcataaccagaactaatttctggcattaccttccaggatctagtacattatgggacacaaaaggaattgcagcaaagttagtgagagggtactttgattacattctgtgttccacatctaatctactgtgtgatcttttgcaaaccactcaacctctctaggcagcagcttctcaaatttaaaacggaggagactacgcagccataaaaaagaatgaagg

SEQ ID NO: 59111 - DNA, 601 bp, Human
gcctactccaacccacgctgcgaaagatggaacctctccaagtgattatctgttattagagagatcaactgagcatataaatttgaaagcactttgaaatcgagaaggtttatacacctttgttcttgattgttcttctcagtaatcaaatggttgggtatatatatgctgagtaagcagaggaggcccaaatttaatatggatgtagctttttagagccaggatggacttcggaactcaattaattcaacctttctgtgatcctctccccagatgaaggaacaaggtccagtgatgtccscagagcatgtagctggtcaaagaccaaccccagaccagaatggatgcctcctgatctcacttcagttctcattccacttcaccacactgctggttgactgtggtgtcacggtgcataaccagaactaatttctggcattaccttccaggatctagtacattatgggacacaaaaggaattgcagcaaagttagtgagagggtactttgattacattctgtgttccacatctaatctactgtgtgatcttttgcaaaccactcaacctctctaggcagcagcttctcaaatttaaaacgga

SEQ ID NO: 59112 - DNA, 601 bp, Human
ttaataatctcgccataatgttgacctcaagtaagatcatgaccagctagactctgccaaagtctccactttctgctttagtctccctgcactggaggctcccagtgctggaaagatgcttagaggatgcctactccaacccacgctgcgaaagatggaacctctccaagtgattatctgttattagagagatcaactgagcatataaatttgaaagcactttgaaatcgagaaggtttatacacctttgttcttgattgttcttctcagtaatcaaatggttgggtatatatatgctgaktaagcagaggaggcccaaatttaatatggatgtagctttttagagccaggatggacttcggaactcaattaattcaacctttctgtgatcctctccccagatgaaggaacaaggtccagtgatgtccgcagagcatgtagctggtcaaagaccaaccccagaccagaatggatgcctcctgatctcacttcagttctcattccacttcaccacactgctggttgactgtggtgtcacggtgcataaccagaactaatttctggcattaccttccaggatctagtacattatgggacacaa

SEQ ID NO: 59113 - DNA, 601 bp, Human
attgtactatgttttaataatctcgccataatgttgacctcaagtaagatcatgaccagctagactctgccaaagtctccactttctgctttagtctccctgcactggaggctcccagtgctggaaagatgcttagaggatgcctactccaacccacgctgcgaaagatggaacctctccaagtgattatctgttattagagagatcaactgagcatataaatttgaaagcactttgaaatcgagaaggtttatacacctttgttcttgattgttcttctcagtaatcaaatggttgggtrtatatatgctgagtaagcagaggaggcccaaatttaatatggatgtagctttttagagccaggatggacttcggaactcaattaattcaacctttctgtgatcctctccccagatgaaggaacaaggtccagtgatgtccgcagagcatgtagctggtcaaagaccaaccccagaccagaatggatgcctcctgatctcacttcagttctcattccacttcaccacactgctggttgactgtggtgtcacggtgcataaccagaactaatttctggcattaccttccaggatctagtaca

SEQ ID NO: 59114 - DNA, 601 bp, Human
tatattctttttctctgactgattcctaatgaggctgtctgagattgtactatgttttaataatctcgccataatgttgacctcaagtaagatcatgaccagctagactctgccaaagtctccactttctgctttagtctccctgcactggaggctcccagtgctggaaagatgcttagaggatgcctactccaacccacgctgcgaaagatggaacctctccaagtgattatctgttattagagagatcaactgagcatataaatttgaaagcactttgaaatcgagaaggtttatacayctttgttcttgattgttcttctcagtaatcaaatggttgggtatatatatgctgagtaagcagaggaggcccaaatttaatatggatgtagctttttagagccaggatggacttcggaactcaattaattcaacctttctgtgatcctctccccagatgaaggaacaaggtccagtgatgtccgcagagcatgtagctggtcaaagaccaaccccagaccagaatggatgcctcctgatctcacttcagttctcattccacttcaccacactgctggttgactgtggtgtcacggtgcat

SEQ ID NO: 59115 - DNA, 601 bp, Human
tgagaggcactctggttctcccatcccagtactcagggaagcatcttgggccaaggccactcatttgttcatacaaaacacagtctcttgattgccagcttatattctttttctctgactgattcctaatgaggctgtctgagattgtactatgttttaataatctcgccataatgttgacctcaagtaagatcatgaccagctagactctgccaaagtctccactttctgctttagtctccctgcactggaggctcccagtgctggaaagatgcttagaggatgcctactccaacccacrctgcgaaagatggaacctctccaagtgattatctgttattagagagatcaactgagcatataaatttgaaagcactttgaaatcgagaaggtttatacacctttgttcttgattgttcttctcagtaatcaaatggttgggtatatatatgctgagtaagcagaggaggcccaaatttaatatggatgtagctttttagagccaggatggacttcggaactcaattaattcaacctttctgtgatcctctccccagatgaaggaacaaggtccagtgatgtccgcagagcatgtagctgg

SEQ ID NO: 59116 - DNA, 601 bp, Human
caatatggcagccacatgctccctgtggctgttctcttttaggttaattgaaatcaccctagccgcattgcaagtgctcacgagcactatgtggctagtgggtgctgcattcattgaacagcagatatagaatctttttaccactgcagaacgttttattgaacttcgtttcaatagaaggtactctgtattgataccaggcttcaaacgttgggaagtctattggccaacttaaacacatccacaggagaatgaagaggtttgggaagggcccggaaaccaggcattgaggagaatgagraaagaagagtttttttgtgttgctgtggagatggaagggaattgagaggcactctggttctcccatcccagtactcagggaagcatcttgggccaaggccactcatttgttcatacaaaacacagtctcttgattgccagcttatattctttttctctgactgattcctaatgaggctgtctgagattgtactatgttttaataatctcgccataatgttgacctcaagtaagatcatgaccagctagactctgccaaagtctccactttctgctttagtctccctgcactggaggctcc

SEQ ID NO: 59117 - DNA, 601 bp, Human
agagacattgccctccactgctgacgcaattgtaatgatcagatctgtggccaaggcctgtgagaaagttaccacctgtaaggagggaacacaaacacttcagactcatggcttgtagctgcaacgatttgagaacatctcgcgaaagcagaacaaataactgcaaaacaccggagagtcttctcttccaagaaattggcccatgattgatctttggggctactcatgaaatgaggtgtctgaagagcttactcagtctggggctatgccagctgtggccaaatacaagccaaggaatgarcagtggggttctgagtggggttttcttctgctgagagattttaaatgtgcagggaattcaagttatttttccaaacaagttttctgccttgtctcaacacaccccaaaatcacatcctgtgttttagaaatgtggaagcagctgccactcttcaaacacagcctacacttccctccttccatgccttcagttacgctgttccctctgccttgaatcccggccccctcacttcccacatcactatttcagctgaaatctaggatcgtttcacatcgggctgaaattatggttactctctaa

SEQ ID NO: 59118 - DNA, 601 bp, Human
ggccttccctctgtaacaggtgccttgaattttggtaaagatcgggcaggcagaatagagacattgccctccactgctgacgcaattgtaatgatcagatctgtggccaaggcctgtgagaaagttaccacctgtaaggagggaacacaaacacttcagactcatggcttgtagctgcaacgatttgagaacatctcgcgaaagcagaacaaataactgcaaaacaccggagagtcttctcttccaagaaattggcccatgattgatctttggggctactcatgaaatgaggtgtctgaasagcttactcagtctggggctatgccagctgtggccaaatacaagccaaggaatgaacagtggggttctgagtggggttttcttctgctgagagattttaaatgtgcagggaattcaagttatttttccaaacaagttttctgccttgtctcaacacaccccaaaatcacatcctgtgttttagaaatgtggaagcagctgccactcttcaaacacagcctacacttccctccttccatgccttcagttacgctgttccctctgccttgaatcccggccccctcacttcccacatcactat

SEQ ID NO: 59119 - DNA, 601 bp, Human
ccttccctgtcacacacacatctgaatgcacccatatgactgtctccagtttccaacggttcctataaaagtcagattaaaaaacattcctttagcagctggatgtggtggcttacgcctgtaatcccagcactttgggaggccaaggtgggtttatcacaaggtcaggagttcaagactagcctggccaagatggtgaaaccccgtctctactgaaaaaaaaaaaatacaaaatttagccaggcttggtgtctggtgcctgtaatcctagtgacttgggaggctgagggagagaattgcktgaacccaggaggcagaggttgcagtgatctgagatagtgccactgcactccagcctgggtgacagagcgagactccatcaaacaaaacaaaacaaaacaaagcaaaacaaaacattcctttaaaattaggctctcttccttgaagtagagactcctcaatacatttctacatggcaaaaaattagaaaatttcatagacttatcatagaattaaaaaatctttagagaaaagtcatgccttgaatatcactgattcttccttttcagtacaaacataaagtaattgaggcctggggagg

SEQ ID NO: 59120 - DNA, 601 bp, Human
atctgctccttccctgtcacacacacatctgaatgcacccatatgactgtctccagtttccaacggttcctataaaagtcagattaaaaaacattcctttagcagctggatgtggtggcttacgcctgtaatcccagcactttgggaggccaaggtgggtttatcacaaggtcaggagttcaagactagcctggccaagatggtgaaaccccgtctctactgaaaaaaaaaaaatacaaaatttagccaggcttggtgtctggtgcctgtaatcctagtgacttgggaggctgagggagaraattgcgtgaacccaggaggcagaggttgcagtgatctgagatagtgccactgcactccagcctgggtgacagagcgagactccatcaaacaaaacaaaacaaaacaaagcaaaacaaaacattcctttaaaattaggctctcttccttgaagtagagactcctcaatacatttctacatggcaaaaaattagaaaatttcatagacttatcatagaattaaaaaatctttagagaaaagtcatgccttgaatatcactgattcttccttttcagtacaaacataaagtaattgaggcct

SEQ ID NO: 59121 - DNA, 601 bp, Human
ttctgcaatggcaagtgaaagcccttgttgagcctggggacagagagagagagcatcagaaattgagcaccagggtcagcagcgggcagtaaagagaatcttcaggaagttgcatgcttgctgacatgtaatgctggctgcattacagccaatagcatgatcacaccatcaataggaataaatacgcagagcagtgttggtcacacacaggattagagacccattctgatatgctgtacttatctgctccttccctgtcacacacacatctgaatgcacccatatgactgtctccagtttscaacggttcctataaaagtcagattaaaaaacattcctttagcagctggatgtggtggcttacgcctgtaatcccagcactttgggaggccaaggtgggtttatcacaaggtcaggagttcaagactagcctggccaagatggtgaaaccccgtctctactgaaaaaaaaaaaatacaaaatttagccaggcttggtgtctggtgcctgtaatcctagtgacttgggaggctgagggagagaattgcgtgaacccaggaggcagaggttgcagtgatctgagatagtgccactgcactcc

SEQ ID NO: 59122 - DNA, 601 bp, Human
tccctcagaggcagcagaatctgtggttaatacccatgacagtgcaggtcccataggaatattctgttgaataacaggaccttctgcaatggcaagtgaaagcccttgttgagcctggggacagagagagagagcatcagaaattgagcaccagggtcagcagcgggcagtaaagagaatcttcaggaagttgcatgcttgctgacatgtaatgctggctgcattacagccaatagcatgatcacaccatcaataggaataaatacgcagagcagtgttggtcacacacaggattagagasccattctgatatgctgtacttatctgctccttccctgtcacacacacatctgaatgcacccatatgactgtctccagtttccaacggttcctataaaagtcagattaaaaaacattcctttagcagctggatgtggtggcttacgcctgtaatcccagcactttgggaggccaaggtgggtttatcacaaggtcaggagttcaagactagcctggccaagatggtgaaaccccgtctctactgaaaaaaaaaaaatacaaaatttagccaggcttggtgtctggtgcctgtaatcctagt

SEQ ID NO: 59123 - DNA, 601 bp, Human
gcaggtagggggtgtcatcttgttggcatgagaccaatctccctggcctgaggcctctcacgtacagagcccgagtcttctggattcctggcttgggcctggggagccaagtatgccaaataacctctgctaaagatgaaccttgcatgctccccatagtgacagtatctccaggtaccaaggaagtaccctctcccctggcttctccaagcccttcatttttaccaagagggaaggtgaacatggggagttcgtgatgaaaggcaccaaatcaaggtctcttccctccctgtctggcccraccccagaccccttcttctccttttcattctatatgaagttctccgatggcctacatggggctccagggaaggggtccgtgaatagagaagacatattgaagatgatgtcccaccccagctagcccagaagcactgaggttccccccatcctctctcttcctacacacatactgagagccacaggtcctcctagatgccacccccaggccagatacttcaaattccccctccctgctggatgtctcagaaggcggtagcagcctgggggcatcggcacctggcagcggcaatgcgaacat

SEQ ID NO: 59124 - DNA, 601 bp, Human
tggaggagcagatgagtgcatccagaacctttctccctcccccaattgaagatgccatcttcaaggtttcctggaactatgggaggccagactcctcttaatagggagtggagtgcagatgcatgagcagaaacgtcgcttttgaaagacagctatgggctgggtaggacaagaataggtggctgcttaggacaccagtggatgtgcttgtgctgtaatggaccccagagcccagcagctccatggtagtgggcaccatattgtttaggctggacaggctggggatggaggggcatctggrgctctcttccacagatctagcagaaaccagaagaaacatctgcccagggtgcttgaggtacactgcaatttggaggcagggagctggctaaaatgacctccagaaatccattctcactcaaggctcatctgaaaccctttgtattatctcagagccagaggcatcatgtggtgcctgggcagagcaagatcctgggtgcaggtagggggtgtcatcttgttggcatgagaccaatctccctggcctgaggcctctcacgtacagagcccgagtcttctggattcctggcttgggcctggg

SEQ ID NO: 59125 - DNA, 601 bp, Human
gaagcgttcaagaagaagataggtggttggtttggaggagcagatgagtgcatccagaacctttctccctcccccaattgaagatgccatcttcaaggtttcctggaactatgggaggccagactcctcttaatagggagtggagtgcagatgcatgagcagaaacgtcgcttttgaaagacagctatgggctgggtaggacaagaataggtggctgcttaggacaccagtggatgtgcttgtgctgtaatggaccccagagcccagcagctccatggtagtgggcaccatattgtttagrctggacaggctggggatggaggggcatctggggctctcttccacagatctagcagaaaccagaagaaacatctgcccagggtgcttgaggtacactgcaatttggaggcagggagctggctaaaatgacctccagaaatccattctcactcaaggctcatctgaaaccctttgtattatctcagagccagaggcatcatgtggtgcctgggcagagcaagatcctgggtgcaggtagggggtgtcatcttgttggcatgagaccaatctccctggcctgaggcctctcacgtacagagcc

SEQ ID NO: 59126 - DNA, 601 bp, Human
ggtggagaaaaggcgttgggggtggttaatagcagccctgagtccctgctgcagccagacaaaaggtgccgtatgcagggaacgcaccctttgggggagccggggggtgggggaatgctgccacccagttcagatagccacctgctgagagggcagaagcgttcaagaagaagataggtggttggtttggaggagcagatgagtgcatccagaacctttctccctcccccaattgaagatgccatcttcaaggtttcctggaactatgggaggccagactcctcttaatagggagtggagwgcagatgcatgagcagaaacgtcgcttttgaaagacagctatgggctgggtaggacaagaataggtggctgcttaggacaccagtggatgtgcttgtgctgtaatggaccccagagcccagcagctccatggtagtgggcaccatattgtttaggctggacaggctggggatggaggggcatctggggctctcttccacagatctagcagaaaccagaagaaacatctgcccagggtgcttgaggtacactgcaatttggaggcagggagctggctaaaatgacctccagaaatccattc

SEQ ID NO: 59127 - DNA, 601 bp, Human
ctgcagcccagcagagcgggagctttggtcctcggcagctggcagacccgacttcaaccagaggagccccagcctctccagacaagatgctgtcaggtggagaaaaggcgttgggggtggttaatagcagccctgagtccctgctgcagccagacaaaaggtgccgtatgcagggaacgcaccctttgggggagccggggggtgggggaatgctgccacccagttcagatagccacctgctgagagggcagaagcgttcaagaagaagataggtggttggtttggaggagcagatgagtgsatccagaacctttctccctcccccaattgaagatgccatcttcaaggtttcctggaactatgggaggccagactcctcttaatagggagtggagtgcagatgcatgagcagaaacgtcgcttttgaaagacagctatgggctgggtaggacaagaataggtggctgcttaggacaccagtggatgtgcttgtgctgtaatggaccccagagcccagcagctccatggtagtgggcaccatattgtttaggctggacaggctggggatggaggggcatctggggctctcttccacagatct

SEQ ID NO: 59128 - DNA, 601 bp, Human
cccaagccgcaggtgccaggggaagaagggctgtttctccgggaaagttggagctcagttccatttcgctgacaggcagacccagcagcatgtagaaagcccggaccctgagttccagtaaagtggagatggctaggccaagagcaagcatccaaatgaaagcaattaatcttaaaacccgaagtttaaccgtttgcaaaacagatctttccgtctctgtggtgacccttcactgctcgacctaatggattactttattaataatgcactgtgcttaaaagcaaaaaaaaattttttttttctgacgattcaatacttcagaaagtctcttaaacccgttgctacggcaaaacgattgatattttattatctttcagaagtgcaacatgaaagccctgcagcccagcagagcgggagctttggtcctcggcagctggcagacccgacttcaaccagaggagccccagcctctccagacaagatgctgtcaggtggagaaaaggcgttgggggtggttaatagcagccctgagtccctgctgcagccagacaaaaggtgccgtatgcagggaacgcaccctttgggggagccggggggtggg

SEQ ID NO: 59129 - DNA, 601 bp, Human
agcagaaaggagggctgccgctggggctggtcatggtagatgcagatggtaaccctcccgctcccctgcttctaggcactgggcaagtgcacaatttggtccccaccctgccagactcacaaggcctttaccaggcctcagcaggcagcagtgtccacttggctccgccttcctgctgatgggctggggtctctggcatggaacagcatcagggcctgcctccctctccagggttgggacggtcatgagcacactctgccaggagaggcccctgggattctctgtggtctagaacatgagwgtctatcctaggaaatcctactggtggcccagcaagggctggttggtacccaagcatagccatgcgccggctctggtggattaactgagtcggctgtggaatttgtgctcctagcagtcattaacaattgaagactccgctgtctggtcctcctcagtccagcttcactctcttgggcatttttacttattaaaaatgccctaggaatcatgtctggtgtttagttccacaacccgcctgctgcttcctgtggtcacccccaccttcctgctgggcctttgcaaaggccgtttataccca

SEQ ID NO: 59130 - DNA, 601 bp, Human
atccaaatcatgaatcatatgggaaacttttagcaagacaccgccatccaaggagacaatttacagttgagttaatctgggtacattagcgagacatggattccggacgacagaccaatttatgttgtttccctgtccccccttagtgctgctctgtgtgagcaaatgaatggaagagcagggaacagagagaagcacctgcttcttcacccaaggctcgggtgtgtgtgtggggttggggggcgggttacccatctttacagacactctgcctggctaagtttgggcaggaaggggaagyggctgtatgtgcagctcaggatgtgatgcctcattcccagcagaaaggagggctgccgctggggctggtcatggtagatgcagatggtaaccctcccgctcccctgcttctaggcactgggcaagtgcacaatttggtccccaccctgccagactcacaaggcctttaccaggcctcagcaggcagcagtgtccacttggctccgccttcctgctgatgggctggggtctctggcatggaacagcatcagggcctgcctccctctccagggttgggacggtcatgagcacactctgccag

SEQ ID NO: 59131 - DNA, 601 bp, Human
cagaggccaagtgagtggtcatgccagcactgagccccggcatccaaagggtgaagcttttaggcgagcagcggccagtgatctcagcttcccccagtcctaatgctcctgaaaggctctctcctgctccctgtaattgggcatcagtagttaatgcagtattgactgcattacacgctcccgtgcctcccctcgctaatgccaattgcatcaccttgtacagtcactggcttgcttagccaatagccgttaaaagcaatccaaatcatgaatcatatgggaaacttttagcaagacaccgccatccaaggagacaatttacagttgagttaatctgggtacattagcgagacatggattccggacgacagaccaatttatgttgtttccctgtccccccttagtgctgctctgtgtgagcaaatgaatggaagagcagggaacagagagaagcacctgcttcttcacccaaggctcgggtgtgtgtgtggggttggggggcgggttacccatctttacagacactctgcctggctaagtttgggcaggaaggggaagtggctgtatgtgcagctcaggatgtgatgcctcattcccagca

SEQ ID NO: 59132 - DNA, 601 bp, Human
tgtagtccaatcccaaatatgggcctgctgggaaaactcactctagcagcaccacaaagagctaagcctggaaatgggaggacaccttgcatgtctcagtgtcctccaactccagacaggacaggcaagcaagatgggacacatgccataggaacctctggggcttctccacttccaaaggcccaggacaggtgagtgtccctcagcacctttcaccttacatctgaggatagaactgcatcttctgggctgtcagtaggctggcaaggggcataactgggacacccaagcacgtggtccrtggtcccagtccagctgatgtttgctgtaatcagagttttctaccacctagcctcatcacgcctcagggctagggcagaaggcatggcaaaaagatgctgatgctctaggctccaattccccatggaaccctaggcagcccttttgccctgtttaaacctcaaccttccccctataaatggaggaacttgcaaagagtggtcctagagacctcttcccaaggtgccacctgtcttggtgatctggacgtgggcgagtagtgaggtcagcctgcctcccaggcagcaatgattaaggacca

SEQ ID NO: 59133 - DNA, 601 bp, Human
gtgtgctgatgcatgcttaacgaccaagtctttgggaaaatgccctgatttgtagtgtttgccaacatccatggtacaaatactcccattgtggctgacttcaagctaccaatgcagtgtctctgaactcagagttgggaacagatgtacagaatctcttgcaagccaggacaagttgactccactggtgtagtccaatcccaaatatgggcctgctgggaaaactcactctagcagcaccacaaagagctaagcctggaaatgggaggacaccttgcatgtctcagtgtcctccaactccagacaggacaggcaagcaagatgggacacatgccataggaacctctggggcttctccacttccaaaggcccaggacaggtgagtgtccctcagcacctttcaccttacatctgaggatagaactgcatcttctgggctgtcagtaggctggcaaggggcataactgggacacccaagcacgtggtccgtggtcccagtccagctgatgtttgctgtaatcagagttttctaccacctagcctcatcacgcctcagggctagggcagaaggcatggcaaaaagatgctgatgctctaggct

SEQ ID NO: 59134 - DNA, 601 bp, Human
aataaatgcttattgtgttaaggctctacattttagggtaactgattacacagcaataactaattgatacatacagatagcacaatgccgcactttttttttttttttttttttttgagacggagtctcgctctgtcgcccaggctggagtgcagtggcgggatctcggctcactgcaagctccacctcctgggttcacgccattctcctgcctcagcctcctgagtagctgggactacaggcgcccgccaccacgcccggctaattttttgtatttttggtagagacggggtttcaccgkgttagccaggatggtctcaatctcctgacctcgtgatcctcccgcctcggcctcccaaagtgctgggattataggcgtgagccaccgcgcccggccaatgctgcacttttaagtacgggttcagtataatgatagctatagtgttttatgactcctaaagactgagaggccaaagccaaaagatgatactgtaactgtacagagagcaatgtcaattcatacaagcatgaaactttctggtttatcaagtgtgtgcttggacataaagtgccagttaggtgtttcaccctttgtagggat

SEQ ID NO: 59135 - DNA, 601 bp, Human
cttgtaatcccagcactttgggaggctgaggcaggtggatcgcttgaccccaggagttcaagaccagtctgggcaacgtaatgaaatctcatctctacaaaaaatacgaaaattagctaggcatggtgatatggacctatagtctcagcttgggagactgaagagggaggatcacttgagcccaagaggtcaaggctgcaggaagctgtgattgtgccactgcactccagcctgggcaacagagtgagatgtctcaaaaaagagaaggcttttgtgcttccacaccttccggaccggtctytgccataagaacaagtcggacaagccttctggctaatgagggccatgcagtcttgtcacgcccagcatccaactgatcagccatcctccatcctccagatgtgagtgagcccagctgagaccagaaaaactgctcagccaagccctgcttaaatcactgacccacagatttttgagttaaataaatgcttattgtgttaaggctctacattttagggtaactgattacacagcaataactaattgatacatacagatagcacaatgccgcactttttttttttttttttttttttgagac

SEQ ID NO: 59136 - DNA, 601 bp, Human
taggctgggtgtggtggtgcgcagtggcacaagcttgtaatcccagcactttgggaggctgaggcaggtggatcgcttgaccccaggagttcaagaccagtctgggcaacgtaatgaaatctcatctctacaaaaaatacgaaaattagctaggcatggtgatatggacctatagtctcagcttgggagactgaagagggaggatcacttgagcccaagaggtcaaggctgcaggaagctgtgattgtgccactgcactccagcctgggcaacagagtgagatgtctcaaaaaagagaagscttttgtgcttccacaccttccggaccggtctctgccataagaacaagtcggacaagccttctggctaatgagggccatgcagtcttgtcacgcccagcatccaactgatcagccatcctccatcctccagatgtgagtgagcccagctgagaccagaaaaactgctcagccaagccctgcttaaatcactgacccacagatttttgagttaaataaatgcttattgtgttaaggctctacattttagggtaactgattacacagcaataactaattgatacatacagatagcacaatgc

SEQ ID NO: 59137 - DNA, 601 bp, Human
gtacacaggcctctcaccagcccacttaccaccccattttgaggctaggggccaaccaatgaattgattctcacctggctgcatctgcatatatgctcaggtctaagtcagctcagggaacacagaacatcacatcctttcaagccgtctagtggctttgcaggacagagaggaaaacctgaaagaggcaacggggactgacctgattatggtccctccccaccgaggctggccctgggaggaatggagctgggctcccatggcagccccactcaaactgcccacagcaaccttcctcccwccccaagtcatcttctcacaggttcgtcacccttccttgaactctgagtgtctttctctccatccccacgtctgacagctggaaaagggagcagacagagcagagagagtgagcgcactgactctgcagtcagcctgcttgggttcacagcccagccctggcattcttgagctgtgggagctggaaccaattactcaatctctttgtacaataattttctcatctgtaaaatgagggtaatagtagcttcttcctaaggttcttatgggtattaaatgagattatacatggaagatgctt

SEQ ID NO: 59138 - DNA, 601 bp, Human
tattgcttttcaatcagctggtttatgaatgtacacaggcctctcaccagcccacttaccaccccattttgaggctaggggccaaccaatgaattgattctcacctggctgcatctgcatatatgctcaggtctaagtcagctcagggaacacagaacatcacatcctttcaagccgtctagtggctttgcaggacagagaggaaaacctgaaagaggcaacggggactgacctgattatggtccctccccaccgaggctggccctgggaggaatggagctgggctcccatggcagccccmctcaaactgcccacagcaaccttcctcccaccccaagtcatcttctcacaggttcgtcacccttccttgaactctgagtgtctttctctccatccccacgtctgacagctggaaaagggagcagacagagcagagagagtgagcgcactgactctgcagtcagcctgcttgggttcacagcccagccctggcattcttgagctgtgggagctggaaccaattactcaatctctttgtacaataattttctcatctgtaaaatgagggtaatagtagcttcttcctaaggttcttatgggt

SEQ ID NO: 59139 - DNA, 601 bp, Human
ttagaatttactcatcagaatgacttagcagcagaggcaggatttgaacccgtgtgactcaaagcccacttcctatttgttttacaaataggaaaactgagaatcagagagtttgaacattctgatggcacccgcaggtagccccacacagtccttcctggatactgtcgtcaggattggggtttttaaagatcgaggggagaggacacgcaggatggagcaggactgtaggagcccaggccagcactgctcccacttgtctggcaagagtgggtctccctcctgctctctatcaagtcaycgtgccaaccagcaaagttgaattattaaaactcctttctggggtaccccacgaatttttccccgccgagactcagagaagaggggcagccactcccgccacacaatattaaaatgtcaggagtttaaggcctgcgttggttgagtcataagttatcagcacccagtgagggccgacagaatgcctcccctaaattattaagcagaatgcgtcagactgtaatattttgctaaaccaaagtacagacacagacaaagatgtcatttcaatatttgaaaccagcaagtttaatttaaaata

SEQ ID NO: 59140 - DNA, 601 bp, Human
caaagcacatccacttcccctgtctcccctgctctcaccagtaccccagggaggacagagaaatggcaccagtcatctacaagactctcagaagctttgcctgttcaagtttcaacagacctaaaaggtaaacgtgatcatacccattttactacttggaattattattagaatttactcatcagaatgacttagcagcagaggcaggatttgaacccgtgtgactcaaagcccacttcctatttgttttacaaataggaaaactgagaatcagagagtttgaacattctgatggcacccrcaggtagccccacacagtccttcctggatactgtcgtcaggattggggtttttaaagatcgaggggagaggacacgcaggatggagcaggactgtaggagcccaggccagcactgctcccacttgtctggcaagagtgggtctccctcctgctctctatcaagtcaccgtgccaaccagcaaagttgaattattaaaactcctttctggggtaccccacgaatttttccccgccgagactcagagaagaggggcagccactcccgccacacaatattaaaatgtcaggagtttaaggcct

SEQ ID NO: 59141 - DNA, 601 bp, Human
cagacgaggaaagtgggagaagctgcctcacgtcctcaaggagccacagccgtggatcctttccaaagagcaatcctcccaaagctgggaactccaggcctgtctggagcagggcaagctttccaaagcacatccacttcccctgtctcccctgctctcaccagtaccccagggaggacagagaaatggcaccagtcatctacaagactctcagaagctttgcctgttcaagtttcaacagacctaaaaggtaaacgtgatcatacccattttactacttggaattattattagaatttaytcatcagaatgacttagcagcagaggcaggatttgaacccgtgtgactcaaagcccacttcctatttgttttacaaataggaaaactgagaatcagagagtttgaacattctgatggcacccgcaggtagccccacacagtccttcctggatactgtcgtcaggattggggtttttaaagatcgaggggagaggacacgcaggatggagcaggactgtaggagcccaggccagcactgctcccacttgtctggcaagagtgggtctccctcctgctctctatcaagtcaccgtgccaacc

SEQ ID NO: 59142 - DNA, 601 bp, Human
acagcaacgagagaataagtaggtattgtttctagctgctaattttggaatgtgtgttggaatgtgttacgcagctgtagataattaatacactgccacagtggcatatatactctgcagagaagggtcctctcctcaggccattgagagggggccctgcagacagctctctgcctgacaacccgtgttgttgtgaacttcctcctagagcacaggccttgatgtggagtgtttcgaggagaggagcccagaggacagagccctgtctccaactgccctacccaggccccctgccctcagytgggcagacgaggaaagtgggagaagctgcctcacgtcctcaaggagccacagccgtggatcctttccaaagagcaatcctcccaaagctgggaactccaggcctgtctggagcagggcaagctttccaaagcacatccacttcccctgtctcccctgctctcaccagtaccccagggaggacagagaaatggcaccagtcatctacaagactctcagaagctttgcctgttcaagtttcaacagacctaaaaggtaaacgtgatcatacccattttactacttggaattattattagaa

SEQ ID NO: 59143 - DNA, 601 bp, Human
gctttcaggaagcaggcagccacgttggagaggcccatacggcatggccaccatggccagcaaggcgtggaggccctcagtccagcagcccgtgaggaaccgcattctgccagccaccaaatgactgagcttgaaacaaccccacatgaatcttgagatgaacccacagccccaggtgacacaccttgatcacagtctgagagaaatcccggagcagagaaccaagtaaagattcctggtccacagcaacgagagaataagtaggtattgtttctagctgctaattttggaatgtgtgttrgaatgtgttacgcagctgtagataattaatacactgccacagtggcatatatactctgcagagaagggtcctctcctcaggccattgagagggggccctgcagacagctctctgcctgacaacccgtgttgttgtgaacttcctcctagagcacaggccttgatgtggagtgtttcgaggagaggagcccagaggacagagccctgtctccaactgccctacccaggccccctgccctcagctgggcagacgaggaaagtgggagaagctgcctcacgtcctcaaggagccacagccgtg

SEQ ID NO: 59144 - DNA, 601 bp, Human
atggaatgtcacatctgtgattcatagacagacttccttcttgtaagcagacactgtctttcaatggctttcaggaagcaggcagccacgttggagaggcccatacggcatggccaccatggccagcaaggcgtggaggccctcagtccagcagcccgtgaggaaccgcattctgccagccaccaaatgactgagcttgaaacaaccccacatgaatcttgagatgaacccacagccccaggtgacacaccttgatcacagtctgagagaaatcccggagcagagaaccaagtaaagattmctggtccacagcaacgagagaataagtaggtattgtttctagctgctaattttggaatgtgtgttggaatgtgttacgcagctgtagataattaatacactgccacagtggcatatatactctgcagagaagggtcctctcctcaggccattgagagggggccctgcagacagctctctgcctgacaacccgtgttgttgtgaacttcctcctagagcacaggccttgatgtggagtgtttcgaggagaggagcccagaggacagagccctgtctccaactgccctacccaggccccctg

SEQ ID NO: 59145 - DNA, 601 bp, Human
gtgtctgcctgtgcaggtaggtgtgcgtgtggtgtgtatggggggggtataggggtgtggtatgtgtgtgtggtgtgtgtggaggggtggaggggtgtggagtgcgtgtgtgagtgtgtgtgagagtgcatgtgtctgcctgtgtggtgggtgtgcgtgtgtgtgtgaatgtgtgtgagtgtatgtgtgtgtataggtgtgtatgggagtgtgtggtgggtgtgtaatgtgtgtgaatgtatgtgggagtgtgtgtttgtgtgtgggggtgtgcgtgtgtgggggtgtgcgtgtgtgtgttaatgtgtgtgagtgtgtgtgtgagcatgtgtgtgtgtccacacatattcagcaccatccctcccacagctacagccaaggagggcctgtgagtgtctttaccgccacctccccaggctcatggcaggcggggcctgtttctcgcctaaactcttcaacatgccaacttgctggggtatcccagccaagtgtcttttcctctctggacacaacctagtcctctgcaaaatggggctagtatttgtcctcttagcctcccaagggtgttgtgaagatgaaatgaaagactccgagacatctg

SEQ ID NO: 59146 - DNA, 601 bp, Human
agagagtgcatgtgtctgcctgtgcaggtaggtgtgcgtgtggtgtgtatggggggggtataggggtgtggtatgtgtgtgtggtgtgtgtggaggggtggaggggtgtggagtgcgtgtgtgagtgtgtgtgagagtgcatgtgtctgcctgtgtggtgggtgtgcgtgtgtgtgtgaatgtgtgtgagtgtatgtgtgtgtataggtgtgtatgggagtgtgtggtgggtgtgtaatgtgtgtgaatgtatgtgggagtgtgtgtttgtgtgtgggggtgtgcgtgtgtgggggtgtgygtgtgtgtgtgaatgtgtgtgagtgtgtgtgtgagcatgtgtgtgtgtccacacatattcagcaccatccctcccacagctacagccaaggagggcctgtgagtgtctttaccgccacctccccaggctcatggcaggcggggcctgtttctcgcctaaactcttcaacatgccaacttgctggggtatcccagccaagtgtcttttcctctctggacacaacctagtcctctgcaaaatggggctagtatttgtcctcttagcctcccaagggtgttgtgaagatgaaatgaaagactc

SEQ ID NO: 59147 - DNA, 601 bp, Human
ccaacagtcatgtctccatatatggcaccacaaggtatgaagccagcagccaccctgggaatgcaaatggggaaaccaagacccagaaaggggaagggaccagcctaaggacacactgtgaggtggtggcagagctgggatgtggatgcagcagttctggctcccagccccgtgctcaccagcctgtttatgggagtgctccagcccacaggagagcctcctccaccctgctcccacgtgaggaactgccgacactacctttacccagcctgcctcaaaaatgccgcctccaccgccccgwaacagccaggaaagaagcggggccctcaatccaacagcagcggggaggctggctcaggaaggaaccaccctcacctcctctgcgggtatcatccctgcggactgagaagagaggccctggggtgagagaccccactggggtggctttgtagggccctcccagccttggaaaactgaccatctgtgagaaaaaaatccagcagcccccggcgctggtccaggggtgtgtgtttgtgtgtgagagagagagagtgcatgtgtctgcctgtgcaggtaggtgtgcgtgtggtgtgtatggggg

SEQ ID NO: 59148 - DNA, 601 bp, Human
ctccttcacctgtaaactcattcattcattatccgctcaacaaatatttactaagcatctaccagcaggggctagcccttaacatctacattttgataaaaattataccaaaactgaggatttttcatcaagaaagtaactcttaatgagcttcattaagtcaatttaattccttgatcacttttctattcattcatgttaaaccatttcttcacctttccccatttttttttatttttgtggagattattttcatcgggatcaattatttttaaattgttgaaggtgactattggcttaygatcagcttttggctcactatagatctcacaaattagagtttttgccactgtcgggatttcttttctggcaattatttctaccagaaaatgtttcctgagccaacttctgcagatctaaactttgtcaggaagatttgattcttctgtcaatttttagtcaataacatactttaccaggtgcagtcttagttgtcgccagttttactttgtgttaattatttcaaccaattttaatttcttcctggatcttttttttgagaataatatctcaataatactaatgagatcttatgctcatg

SEQ ID NO: 59149 - DNA, 601 bp, Human
acttggggttccttgtcctctctctgagacaaaggaatccttatgattctctccaatcctctcctgacctccttcacctgtaaactcattcattcattatccgctcaacaaatatttactaagcatctaccagcaggggctagcccttaacatctacattttgataaaaattataccaaaactgaggatttttcatcaagaaagtaactcttaatgagcttcattaagtcaatttaattccttgatcacttttctattcattcatgttaaaccatttcttcacctttccccatttttttttatttttgtggagattattttcatcgggatcaattatttttaaattgttgaaggtgactattggcttatgatcagcttttggctcactatagatctcacaaattagagtttttgccactgtcgggatttcttttctggcaattatttctaccagaaaatgtttcctgagccaacttctgcagatctaaactttgtcaggaagatttgattcttctgtcaatttttagtcaataacatactttaccaggtgcagtcttagttgtcgccagttttactttgtgttaattatttcaaccaattt

SEQ ID NO: 59150 - DNA, 601 bp, Human
ccccgaacctcagcatcatgcagtatgcccatgtaacatgtaacaaacctgcacatgtgccccaaggatgtggagaaactggaactcctacccacggcctgcaaggctctgcacaatgtagcgctgccaaccctgaccaccctgcagcctcactgatgatgccccaagctccagtcacaatggcctctgcagtcttgaacttggggttccttgtcctctctctgagacaaaggaatccttatgattctctccaatcctctcctgacctccttcacctgtaaactcattcattcattatccrctcaacaaatatttactaagcatctaccagcaggggctagcccttaacatctacattttgataaaaattataccaaaactgaggatttttcatcaagaaagtaactcttaatgagcttcattaagtcaatttaattccttgatcacttttctattcattcatgttaaaccatttcttcacctttccccatttttttttatttttgtggagattattttcatcgggatcaattatttttaaattgttgaaggtgactattggcttatgatcagcttttggctcactatagatctcacaaat

SEQ ID NO: 59151 - DNA, 601 bp, Human
taaagctgaaaaagaacccctccctccccatcatatgctgctttctctgcctctagttttatcccctcccatttgctctccacagagtaaaccaaatggtcttaataaaatgtaaatttgagcatgagtcttgcttctacctaaagccattcaaaggtgtctcgttgtacacatggacataaagatgggaacaacagacactgatgggtgacaggatctgtcataccccgaacctcagcatcatgcagtatgcccatgtaacatgtaacaaacctgcacatgtgccccaaggatgtggagraactggaactcctacccacggcctgcaaggctctgcacaatgtagcgctgccaaccctgaccaccctgcagcctcactgatgatgccccaagctccagtcacaatggcctctgcagtcttgaacttggggttccttgtcctctctctgagacaaaggaatccttatgattctctccaatcctctcctgacctccttcacctgtaaactcattcattcattatccgctcaacaaatatttactaagcatctaccagcaggggctagcccttaacatctacattttgataaaaattatacca

SEQ ID NO: 59152 - DNA, 601 bp, Human
aggaaactgaagggaggcagacaggagtgtggggccgtctgaagccagagggatgaggagaggtccatctgtaaagctgaaaaagaacccctccctccccatcatatgctgctttctctgcctctagttttatcccctcccatttgctctccacagagtaaaccaaatggtcttaataaaatgtaaatttgagcatgagtcttgcttctacctaaagccattcaaaggtgtctcgttgtacacatggacataaagatgggaacaacagacactgatgggtgacaggatctgtcataccccraacctcagcatcatgcagtatgcccatgtaacatgtaacaaacctgcacatgtgccccaaggatgtggagaaactggaactcctacccacggcctgcaaggctctgcacaatgtagcgctgccaaccctgaccaccctgcagcctcactgatgatgccccaagctccagtcacaatggcctctgcagtcttgaacttggggttccttgtcctctctctgagacaaaggaatccttatgattctctccaatcctctcctgacctccttcacctgtaaactcattcattcattatccgctca

SEQ ID NO: 59153 - DNA, 601 bp, Human
ccagactgcgagctctggaggaaactgaagggaggcagacaggagtgtggggccgtctgaagccagagggatgaggagaggtccatctgtaaagctgaaaaagaacccctccctccccatcatatgctgctttctctgcctctagttttatcccctcccatttgctctccacagagtaaaccaaatggtcttaataaaatgtaaatttgagcatgagtcttgcttctacctaaagccattcaaaggtgtctcgttgtacacatggacataaagatgggaacaacagacactgatgggtgayaggatctgtcataccccgaacctcagcatcatgcagtatgcccatgtaacatgtaacaaacctgcacatgtgccccaaggatgtggagaaactggaactcctacccacggcctgcaaggctctgcacaatgtagcgctgccaaccctgaccaccctgcagcctcactgatgatgccccaagctccagtcacaatggcctctgcagtcttgaacttggggttccttgtcctctctctgagacaaaggaatccttatgattctctccaatcctctcctgacctccttcacctgtaaactcat

SEQ ID NO: 59154 - DNA, 601 bp, Human
cagacccagactgcgagctctggaggaaactgaagggaggcagacaggagtgtggggccgtctgaagccagagggatgaggagaggtccatctgtaaagctgaaaaagaacccctccctccccatcatatgctgctttctctgcctctagttttatcccctcccatttgctctccacagagtaaaccaaatggtcttaataaaatgtaaatttgagcatgagtcttgcttctacctaaagccattcaaaggtgtctcgttgtacacatggacataaagatgggaacaacagacactgatgsgtgacaggatctgtcataccccgaacctcagcatcatgcagtatgcccatgtaacatgtaacaaacctgcacatgtgccccaaggatgtggagaaactggaactcctacccacggcctgcaaggctctgcacaatgtagcgctgccaaccctgaccaccctgcagcctcactgatgatgccccaagctccagtcacaatggcctctgcagtcttgaacttggggttccttgtcctctctctgagacaaaggaatccttatgattctctccaatcctctcctgacctccttcacctgtaaa

SEQ ID NO: 59155 - DNA, 601 bp, Human
ttcgggagaaagaacactggcccagagtgggagggccaagaaacactttacagacagatcagaggaggtcagaggagtcagggactgatccatgggtggctggataggtctagacttgctgcctcccagtcctagtgtcctcctacctgcctcaggcccacagtctttggctccctccctcagagcctagaaagccaggattgtggtccagtcatgacagcagcagagggggaagtgaagggtcagggaagccttcaggccaaagctgggctgggcaagcaagggcctcagggacaaagcwgggcaaggacaggcttgcagccaggggctctggtctaccttccctggagctcaactccagctctggccacaagttcaagccctgctacggggagctgagcagctccagccaggatcttgaccaccagtagacctcagatgagctcccattcccaaggccacagcttcagcacagtttctctcctagacctcaactgcctcctctgaccaacccagacccccacctgcctcaccctgcacagacccagactgcgagctctggaggaaactgaagggaggcagacaggagtgtggggccgtc

SEQ ID NO: 59156 - DNA, 601 bp, Human
ggtctccaggccctgggcagccaggcaggagtggtgcccatgcaccacatagacacctgagtctacagacagaccactatacagacctctcccctgagggacagctcattgcagaggcaagaccttaggcatagttcccagactccacggaggtgctctgcagcctcagacaagttctgctcttctctggactgatcttagttgaatataactgggggtggactggagtagaaataggtaagggtagggagaccgtgagccacgcctctttcccagaatcagcagctttcatgaaagccaytcgggagaaagaacactggcccagagtgggagggccaagaaacactttacagacagatcagaggaggtcagaggagtcagggactgatccatgggtggctggataggtctagacttgctgcctcccagtcctagtgtcctcctacctgcctcaggcccacagtctttggctccctccctcagagcctagaaagccaggattgtggtccagtcatgacagcagcagagggggaagtgaagggtcagggaagccttcaggccaaagctgggctgggcaagcaagggcctcagggacaaagct

SEQ ID NO: 59157 - DNA, 601 bp, Human
catttgagttctgtgcagggggcagggaggatgttctgggtcttaacttacgtgaccagggctcagaaaagttaagtggtttgcccaataacacacagcagtgggtggtagagcaagattgcccgtgatctcacagtcagaggaccacagtccatgcttgttacctcccaagtcaaaagacagctacccctgcagcaagcggtcaggccctcatgccgctgccatcaatttcaaagaattctaaagatttcacatctgcatgtatctgagctggtgctcttgggggttctctctccttggragagtgagtccgaagcctttgccatggaagggagggcaggattcctggtagtatggaccacagggagaagagtgtgtgcccttgagacagcatggagtgggctggtgggtctccaggccctgggcagccaggcaggagtggtgcccatgcaccacatagacacctgagtctacagacagaccactatacagacctctcccctgagggacagctcattgcagaggcaagaccttaggcatagttcccagactccacggaggtgctctgcagcctcagacaagttctgctcttctctggact

SEQ ID NO: 59158 - DNA, 601 bp, Human
cactgtgttctcaccaacacctcctcgggtgggcacagtgctgcctggctggcaaaacacatgaaaacattttctgtcatttgagttctgtgcagggggcagggaggatgttctgggtcttaacttacgtgaccagggctcagaaaagttaagtggtttgcccaataacacacagcagtgggtggtagagcaagattgcccgtgatctcacagtcagaggaccacagtccatgcttgttacctcccaagtcaaaagacagctacccctgcagcaagcggtcaggccctcatgccgctgccrtcaatttcaaagaattctaaagatttcacatctgcatgtatctgagctggtgctcttgggggttctctctccttggaagagtgagtccgaagcctttgccatggaagggagggcaggattcctggtagtatggaccacagggagaagagtgtgtgcccttgagacagcatggagtgggctggtgggtctccaggccctgggcagccaggcaggagtggtgcccatgcaccacatagacacctgagtctacagacagaccactatacagacctctcccctgagggacagctcattgcagag

SEQ ID NO: 59159 - DNA, 601 bp, Human
ctgagagtagtcacagcggctcaggcctcatctccgcagaggcgaccagcctccaatcctcccacaatggagagagccctatggaggggacaggacaggtctggtcacttgaaaggactatctgggccttgaagcaagtggacacatgctcgttttctagtcattaggtcagttccctgagtctacatggattcaacatgaaatgctgtcttgggaagctgccccttagggaaactacccttggaacttctctaaatttctcccccaaagttctatgaggcccagggatgagaagacttckcaaggtaaggggtggcaggagtacatgttgcaagtaccttccctttatgtagccactgtgttctcaccaacacctcctcgggtgggcacagtgctgcctggctggcaaaacacatgaaaacattttctgtcatttgagttctgtgcagggggcagggaggatgttctgggtcttaacttacgtgaccagggctcagaaaagttaagtggtttgcccaataacacacagcagtgggtggtagagcaagattgcccgtgatctcacagtcagaggaccacagtccatgcttgttacctccca

SEQ ID NO: 59160 - DNA, 601 bp, Human
agcatcctggccagcagggggagctggggccgcactggggcaggggcatttgcctgccccagagttgggaatgagcagggatagactgagagtagtcacagcggctcaggcctcatctccgcagaggcgaccagcctccaatcctcccacaatggagagagccctatggaggggacaggacaggtctggtcacttgaaaggactatctgggccttgaagcaagtggacacatgctcgttttctagtcattaggtcagttccctgagtctacatggattcaacatgaaatgctgtcttgggmagctgccccttagggaaactacccttggaacttctctaaatttctcccccaaagttctatgaggcccagggatgagaagacttctcaaggtaaggggtggcaggagtacatgttgcaagtaccttccctttatgtagccactgtgttctcaccaacacctcctcgggtgggcacagtgctgcctggctggcaaaacacatgaaaacattttctgtcatttgagttctgtgcagggggcagggaggatgttctgggtcttaacttacgtgaccagggctcagaaaagttaagtggtttgcc

SEQ ID NO: 59161 - DNA, 601 bp, Human
gaggtgataaaaatgtttttcaattagataatggtgatgactgcataactctgtgaatataccaaaaaccactaaagtatctattttaaaaaggttaattttgtggtatgcaaatgataaatcaataaagctattataaaacaaaacaaacaaaaacaaataaatattcctttgagaacaggagaaaccagttcataaaatattcagtcctggggtcagcatagggggggaaataacctgtggcagctagaagctgccaggtggggggacctgggaggccccatggccagcctcacagggsgcaggccctggtcacctcatccccctgctgggatgaaagggatgaaagggctccagagcacccccttacctccttccccagacccccacatccagaaatctgactccatccacttttccagccctgctccccaggaaactcaaaccttactggatccatcactctccttggcccatctgcttccacaactgcattctcattttgtcttcccaggtctctctttgttgaaatttctgcatccttcaaggactatgccctacctgcaaactgagcatgcccatggcaggggggtccctcttt

SEQ ID NO: 59162 - DNA, 601 bp, Human
aaaaatgaaaatataggtcttaacaaaaacttgtacatgaacgttcctagcagcattactcacaacagccaaaaaacagaaacaacccaaatgtccatcaattgacaaacgaataaataaaacatggtatatacatacaatggaatatgatttggccacaaaaagaaatgaagtactgacatatgctacatcatgaaggaaccttgcaaacattatgccaagaaagaaggcagatacaataaccacatattgcatgattccatttatatgaaatgtccagaataggcaaagctatacagamagaaagtagtttagtggttgccagggagggaggaatggggagtgactgctaatgggctgaaggttctttttgaggtgataaaaatgtttttcaattagataatggtgatgactgcataactctgtgaatataccaaaaaccactaaagtatctattttaaaaaggttaattttgtggtatgcaaatgataaatcaataaagctattataaaacaaaacaaacaaaaacaaataaatattcctttgagaacaggagaaaccagttcataaaatattcagtcctggggtcagcatagggggg

SEQ ID NO: 59163 - DNA, 601 bp, Human
agtcacatggtgagactgggagcaagggagatgggggaggtgccacactcttttaaacaacaagattttgagtgaactgaacaagaactcactcatcaccaagcggatagtgctaagccattcatgagggagccatccccgtgatccaatcacctcccacctgtccccacctgcaacactgggaatctcatttcaacatgagatttggaggggacaaacatcgaaaccatatcacccagcaactcccctcctaagtatatccccaagaaaaatgaaaatataggtcttaacaaaaacttgyacatgaacgttcctagcagcattactcacaacagccaaaaaacagaaacaacccaaatgtccatcaattgacaaacgaataaataaaacatggtatatacatacaatggaatatgatttggccacaaaaagaaatgaagtactgacatatgctacatcatgaaggaaccttgcaaacattatgccaagaaagaaggcagatacaataaccacatattgcatgattccatttatatgaaatgtccagaataggcaaagctatacagaaagaaagtagtttagtggttgccagggagggagg

SEQ ID NO: 59164 - DNA, 601 bp, Human
caagcatggttccagcctctgctcctggtgagtcctcaggaagcttccaatcatgacagaagaggaaggggaaaaagcaagtcacatggtgagactgggagcaagggagatgggggaggtgccacactcttttaaacaacaagattttgagtgaactgaacaagaactcactcatcaccaagcggatagtgctaagccattcatgagggagccatccccgtgatccaatcacctcccacctgtccccacctgcaacactgggaatctcatttcaacatgagatttggaggggacaaacatygaaaccatatcacccagcaactcccctcctaagtatatccccaagaaaaatgaaaatataggtcttaacaaaaacttgtacatgaacgttcctagcagcattactcacaacagccaaaaaacagaaacaacccaaatgtccatcaattgacaaacgaataaataaaacatggtatatacatacaatggaatatgatttggccacaaaaagaaatgaagtactgacatatgctacatcatgaaggaaccttgcaaacattatgccaagaaagaaggcagatacaataaccacatattgcat

SEQ ID NO: 59165 - DNA, 601 bp, Human
ccggcacttcatgtacagcatcttcccaagtccttgttgtggtgctgtaagttgtaattattgcttccattttgtggatggggaaactgaggctcagagaggtggaacaacttatctaaagtcacacagctcaaaatggacttttgtagcatcctttgccctcctacagcatgctccgcttcagagcctacaactggccatgtctgggccctgccttgcttagagacacatctgaggcaagggttcaggccagggacttggactctggtgagcctgggttcaagttcaggctctgccatcracccatattgtgaactccggcaagtcatttagcctctctgagcttcagcttcctcatcagcaaaactagagcaataacattcaacttgtagggctgaagaatgaaagtacctaaagcaagcagaagtcctttgctatccttgatatgctaggcaagtagtagctatttacagaagcccttgaggtgagcaaagatccgtactaaccccacttcatagatcagaaaactgaagccagcaggcaaaagatttatccaaagtgccaatgaaccccaggatctcactggggaagtaccaggcta

SEQ ID NO: 59166 - DNA, 601 bp, Human
gagaaccctggaaacccctcatggttttcagcagcaccaggtcagtaaacactgggccttcccaggggactctccaccttctgctcaccttcctggccagcccaagcaaggtctcctccttaaagcctgctctgaccagcccagaagccagccacttctccccgacagttccacagtaccctgcatcctcttcacccctcctcgtgtgccctataaccttctaccaactaccttctgtgtgcctggtatcatgcccggcacttcatgtacagcatcttcccaagtccttgttgtggtgctrtaagttgtaattattgcttccattttgtggatggggaaactgaggctcagagaggtggaacaacttatctaaagtcacacagctcaaaatggacttttgtagcatcctttgccctcctacagcatgctccgcttcagagcctacaactggccatgtctgggccctgccttgcttagagacacatctgaggcaagggttcaggccagggacttggactctggtgagcctgggttcaagttcaggctctgccatcgacccatattgtgaactccggcaagtcatttagcctctctgagcttc

SEQ ID NO: 59167 - DNA, 601 bp, Human
ctggcctgggggtaagggctgggggcaccagcagaggctgtccacaaactcccaacatgggagatctcttgagaaccctggaaacccctcatggttttcagcagcaccaggtcagtaaacactgggccttcccaggggactctccaccttctgctcaccttcctggccagcccaagcaaggtctcctccttaaagcctgctctgaccagcccagaagccagccacttctccccgacagttccacagtaccctgcatcctcttcacccctcctcgtgtgccctataaccttctaccaactaycttctgtgtgcctggtatcatgcccggcacttcatgtacagcatcttcccaagtccttgttgtggtgctgtaagttgtaattattgcttccattttgtggatggggaaactgaggctcagagaggtggaacaacttatctaaagtcacacagctcaaaatggacttttgtagcatcctttgccctcctacagcatgctccgcttcagagcctacaactggccatgtctgggccctgccttgcttagagacacatctgaggcaagggttcaggccagggacttggactctggtgagcctgg

SEQ ID NO: 59168 - DNA, 601 bp, Human
cttaaagtgttttattaccactcgggctaactgaggcagtcatgtgagcccccctctcaggcatctgcaggctggcctgggggtaagggctgggggcaccagcagaggctgtccacaaactcccaacatgggagatctcttgagaaccctggaaacccctcatggttttcagcagcaccaggtcagtaaacactgggccttcccaggggactctccaccttctgctcaccttcctggccagcccaagcaaggtctcctccttaaagcctgctctgaccagcccagaagccagccacttctmcccgacagttccacagtaccctgcatcctcttcacccctcctcgtgtgccctataaccttctaccaactaccttctgtgtgcctggtatcatgcccggcacttcatgtacagcatcttcccaagtccttgttgtggtgctgtaagttgtaattattgcttccattttgtggatggggaaactgaggctcagagaggtggaacaacttatctaaagtcacacagctcaaaatggacttttgtagcatcctttgccctcctacagcatgctccgcttcagagcctacaactggccatgtctg

SEQ ID NO: 59169 - DNA, 601 bp, Human
acagaggatgttcctggcagcttcggctgcagccccccactcctgcctgggtccctgttgagccccatttgtgcctcccagcctatcatcagctcacagtgcatgtgttccccatctctgggtggggaagctggtctatgacaagattctttgagatcactgactccctcagccccagccccagagttttccaaacccctggctagctcccaactttaagccatactcctgacacataaacatgaatgagtgtgaaccaccctgtgggtaagagacaacagaatacagccaccgtggcctygggcctgcaggggcttcacagggagccctttctggaataaggagcaccgggaaaggaggctggggtcaccagatcacatataggagaggaggcagggactccccagcccctcctagcccccagcttgggagtgggctgctggctttgcaaggaaattacaacatgggcctgggtaaggctcctcttagttacagcataaactgcagcaataaagcgtacctggggaatgtttagagaaagcactaatgatttcttccctagtggttaataaattcacttccagatcaatttgttcacgat

SEQ ID NO: 59170 - DNA, 601 bp, Human
aggaagggctgggggttaagagggagaatccaggccccacccccaagagcggcagggatggaaacccctttggctggggctgagacagcactgcctctgggatgcctgcctgaggcattgccccggggcttcctattgaggccctgggggttgcttcagcccttctttgcagacctggataagagagagagacgctgaaagcaaggcccacgtgagccagatttcccttcagccccccgcatggctgaggaggttcagggagcatccgtagatgaagctgtttagaatacaagctttggartcagacagtttgggatctgtatcctaaaccagccatgggctcccaggcagaagatccttgttcagaagtgaatgtctcttccggaaacctggtgggagaaagcctgctgtgagtgtcttgcagtgcagcccctgtgaagtgagagtggtctgaagcccccaagtgcaaagggaaagtgtcatcccgtgtgagagtcagcagggtgggccggctgctgggcaagctggtatggccgcaggctgcattatccagagcacagagtctgcagccagggagctgacagccatgctgtctgtcatc

SEQ ID NO: 59171 - DNA, 601 bp, Human
gggtatctctgtaattccagcagctctggctgtcacctctggcacagacctagcctccccagctccctgcctgagggtctttttggcttacaaaaatgactactcttccctgtcagcatagtctgtgtctctgggggccagtgggaggaagcgacccctggagtttgctacagaaaagccccaggcccaagcctttctcagtctgtagcttccaccaacccccatcccatcctgggctgctggagccagcccctgtgttccttaacaggatgccgcttgaagctgcacagctgtggggacyggtggagagcatctggaagctgtgttcccctgacggcaactcagctgctccctgggcacccgcaaagcccgcgtcacccatctaatgaaacagggctcccaagaggcctgcagtctccacagaggaggaggacatggactctcagacgagtctcaatttcacagcatcagggacgtgagcaccagcgcgctgaaccagaaaacgagagtctggcaggagctgcagacacaccatgagcaccaggggatgggagattagggcccttcaaaatcaattttgaattcaaacttttaaatgtgt

SEQ ID NO: 59172 - DNA, 601 bp, Human
acataaatacccatctcagccctcagggggtagcgggtatctctgtaattccagcagctctggctgtcacctctggcacagacctagcctccccagctccctgcctgagggtctttttggcttacaaaaatgactactcttccctgtcagcatagtctgtgtctctgggggccagtgggaggaagcgacccctggagtttgctacagaaaagccccaggcccaagcctttctcagtctgtagcttccaccaacccccatcccatcctgggctgctggagccagcccctgtgttccttaacrggatgccgcttgaagctgcacagctgtggggaccggtggagagcatctggaagctgtgttcccctgacggcaactcagctgctccctgggcacccgcaaagcccgcgtcacccatctaatgaaacagggctcccaagaggcctgcagtctccacagaggaggaggacatggactctcagacgagtctcaatttcacagcatcagggacgtgagcaccagcgcgctgaaccagaaaacgagagtctggcaggagctgcagacacaccatgagcaccaggggatgggagattagggcccttc

SEQ ID NO: 59173 - DNA, 601 bp, Human
ctccctcccacactatcatccacccagcactctggccagaaactaagtgtcgtcttcagacttccatccccctcacccctttccctgccaactcttgctcctcatcccacctgcatcttgcatttccacagccatcaccgtctctcgatgcactgccagcatggcatgatgtctggtacccacagccaattcttcacacggcagctggagagatcttccagatgaaccagggcaggtcactgctcaacttgaaacccttccataacatccaatggcctgagaataacacccagactcttcrtccagcctgtaacatcttcatgtggtctggtgtctgccttcccctcccacactgtgctccagccatactccaaactccttcctgcctcagggcctttgcacatgctattaccttcccagaacacccttccctgcctctgcctctgcatatacttggctccttctcatcttcaagcttcagcttaaatgtcatctcctcagagaagcctttcttgacctccttatttcattatttaaatgagctccccacacttcagtaatttccttctgagtttttcatcacaatttgtaattgttttac

SEQ ID NO: 59174 - DNA, 601 bp, Human
tcactggagtttgtcacttggaatgaggcttacgttaattgcatagttatctgtaatgtgttctccttctccaggatgggtattggcattttctttccattctttggttgtctctagaaagtctcagacatagctcaaaaacaacaggtccaaagcaggattcctgatttcttccccaaacctggcccctgtaccctcaccccagacttcctccctcccacactatcatccacccagcactctggccagaaactaagtgtcgtcttcagacttccatccccctcacccctttccctgccarctcttgctcctcatcccacctgcatcttgcatttccacagccatcaccgtctctcgatgcactgccagcatggcatgatgtctggtacccacagccaattcttcacacggcagctggagagatcttccagatgaaccagggcaggtcactgctcaacttgaaacccttccataacatccaatggcctgagaataacacccagactcttcatccagcctgtaacatcttcatgtggtctggtgtctgccttcccctcccacactgtgctccagccatactccaaactccttcctgcctcag

SEQ ID NO: 59175 - DNA, 601 bp, Human
ataattttctgtggttctttagtggggggaatttagaaacatcagaagctgcatgtgctcactggagtttgtcacttggaatgaggcttacgttaattgcatagttatctgtaatgtgttctccttctccaggatgggtattggcattttctttccattctttggttgtctctagaaagtctcagacatagctcaaaaacaacaggtccaaagcaggattcctgatttcttccccaaacctggcccctgtaccctcaccccagacttcctccctcccacactatcatccacccagcactcyggccagaaactaagtgtcgtcttcagacttccatccccctcacccctttccctgccaactcttgctcctcatcccacctgcatcttgcatttccacagccatcaccgtctctcgatgcactgccagcatggcatgatgtctggtacccacagccaattcttcacacggcagctggagagatcttccagatgaaccagggcaggtcactgctcaacttgaaacccttccataacatccaatggcctgagaataacacccagactcttcatccagcctgtaacatcttcatgtggtctggtg

SEQ ID NO: 59176 - DNA, 601 bp, Human
tccttaggaatactgcatctaaagcctgaactcaccatgacataaagggactgaggagtttccacacatcccccacagatcttccttgttgagggaagctgactctggtttggggcaacagcaacagcctaaggggactgtcttagtcggttcaggctgccataacagaataccacagactgggtggcatataaacaattgaaatttatttctcacagttctggaggctgggaaatccgagagcaaggcaccaacagattctgtgtctggtgagagttgcttcttggatcattagatggcsatcttcttgctgcatcctcacgtggcagaaggggcaagggagttctctgtggtcccttttaagaaggcaccaatcccattcatgagggttctgccctcatgacctaatcacccccaaacggccccatctcctaacactatcacattgggtgttgggatttcaatataagaattttgggaagacacaaacactcagatcatagagagcttgcaggaaggcctggatgtaattctggagcatagtgattctggagcaggtgtagatgcagtctgctctcacagcctcacataattttctgtg

SEQ ID NO: 59177 - DNA, 601 bp, Human
ctctggtgctgctcacccctcaagggagcttgtgagaagaggtggggtagtgtaggccctgagactgtgggccctgcagacacacagcctcggcttgaattctggctttggtgcttcccagctctgcctcaatttactaacctgctaaatgaggacagcctactttaaaggattgaggattaaattggataatcaacatgaagtacttataacaatgtttggcatagtagcataaagcaattagctgagaaaatttagttgtatcttatgacccaacaattatattcctaggtatatgccyaacagaaatgagagcttatgtccatcaaaacagatgcacaaaaatgttcatagacgttttcttcttagtagccccacactgaaaacaacataaatgtccatcaacagtaaaacgaaataaattatggtatattcgtacaatggaatagtatgtagcaattaaaaagaatgaattactaatatatactacctggatgaatcagacaatataatattgaatgaaagaagctagacacaaaaaggtacatactgtataatttcatttatatgtagttcccaaacaggcaaaaccgatctgatg

SEQ ID NO: 59178 - DNA, 601 bp, Human
agcatttcctactcatttggaatcaaaagccaacgagaacaactgttgaaacgcgcggctacagccacccagagcacgctcattaccgcccctctgcacaccctcttgcaggcagcgtgttcactgtgaggatgagggagagaggcaggggctcctatggcctccagctccccacgagggcagggagaggaaggctgagaggctaggctccgcccatggggtggcagtcagctcagtagagggactggcagctttgactctggtgctgctcacccctcaagggagcttgtgagaagaggtsgggtagtgtaggccctgagactgtgggccctgcagacacacagcctcggcttgaattctggctttggtgcttcccagctctgcctcaatttactaacctgctaaatgaggacagcctactttaaaggattgaggattaaattggataatcaacatgaagtacttataacaatgtttggcatagtagcataaagcaattagctgagaaaatttagttgtatcttatgacccaacaattatattcctaggtatatgcccaacagaaatgagagcttatgtccatcaaaacagatgcacaaaa

SEQ ID NO: 59179 - DNA, 601 bp, Human
atgagacaggatagtgagagacacttattttgaggagcaacgaactgatttgattgttctactgtggttaaagtcaccctggcactggccatagtccagctccacccaaaggccagtctagtggtcagtgcaagtatgtgtagaaggaagccaccctatctgtccaacaggctgttccagtgaccagccacatgggaagcagttgctgtggcaactcagagggtgacagctccaggaccctctggctgctctggaaagagccctggaggcaagtgtagccttggtatttttttttttttttaaagacagggtcttcctctgtctcccatgctggagtgtagtgatgtggtcacagctcactgcagcctcaacctcccggcttaagcgatcctcctacctcagcctcctgcatcggtgggaccacaggcacataccaccaagccaggctaatttttggggggaggaatttttttttttttcagagacaaggtctcaactatgttgcccaggctggtctcgaactcctgggctcaagcaatcctcccacctcaacttcccaaagtgctggggttagtaggagaaagagctggcctgtgaaccc

SEQ ID NO: 59180 - DNA, 601 bp, Human
tttgtcctgcccatccccactctcccaaaaaggtcagagtcaagagtgagactgaggctaagagttcagaccttgaaatcagggagcctagtttcaagtcggaactgctccaaggagctggggggcctggattaaatccccccacctttctgactggcatgtgtgtactgggagccacagtggtctttccgctcagaatgtggtgaggatagaatgaggttcttctgcacatgaggccatagcacagagtctggtgcccagggcacagtgaacaggaactgatagtattaacagtcaccccaggataccatccctgctcgggcacttgctttctttttcttttaactttttgtctcttgacataatttcaaactttcagaacacttgcaagaatagtagaaaaaattcctgtaagcccttcacccagattccctacatataacattttaccacatttgatttaacctccatctttctacctacttctacctacttacctataattttttccctaaatcatttgagagttggtttcaaacaggaagcctctataccccctaatactttcggtttgcaaatgctttgctgaaaacaaggacat

SEQ ID NO: 59181 - DNA, 601 bp, Human
gggaaagccagacagtccaggtgacggggacgcactgccagaggtcatcccgcccctcccactctctccctccagcccggaggagaaatgccctcatcttcacatggaccccagagcagtccactaggccagacccaagtccccagcaactcctgcccacctgtcccagcccagctgcccctcagctccagcacgtggactttcccaaactgccaagcccacaggctccagtactaccagtgcccctggtttggatggcagcctgggggatgcttaccccagtgagctcctccaaggccastcttccagcccagaacgtctacctcacccagctccaggtcactccaggctcttccccgtggctcccctgctggaagccactgtggccacctcctggcaactccactgggcatctgcagcccctcccacacgccagtgtgtcctgcttggcactgctggctctgccccctgcaggatcctggaacacagctcctctccctcccgcaaatggatcttgttagcttgtgtcccggggccttcactctgctactactccaggaagaaacgcctttgtcctgcccatccccactctcccaaaaag

SEQ ID NO: 59182 - DNA, 601 bp, Human
ggctggaacctccgtactcaggggagaccctagcccactaaattatagcccaaaatgaagggagacagtgagaggccccagcacgtgaagcagctgtcccactctctcttccatctaccctggctcttggacgggctggtcttccgagctcagaccccagcatgtttgtcctggctcccgcagggttgtaaactccagcactggtcgacaatctcttcactggaggcatctggcacctagaggaccctgtggaagccatgaggggtgaagctgccagctgccgcaggtccccctccccackgcccgtgcccaggctggcctctgcacaggcaggttaccttaagacctggacacccctccctcttctggggtgctgaactgattcctggctctggagaactcttatagaagccacacagcttctgccaaagtgtcccatgtccaccaagacatggaacaccagggtcagcctggctgagaaggccccagagcatctagagacccttgggtctagagacctcccacgagaaaggctggcatcctgggggaagcctgagccagggcagccccatgggaggggcctgggaccagactccaggtc

SEQ ID NO: 59183 - DNA, 601 bp, Human
atgggtgaatggctggaacctccgtactcaggggagaccctagcccactaaattatagcccaaaatgaagggagacagtgagaggccccagcacgtgaagcagctgtcccactctctcttccatctaccctggctcttggacgggctggtcttccgagctcagaccccagcatgtttgtcctggctcccgcagggttgtaaactccagcactggtcgacaatctcttcactggaggcatctggcacctagaggaccctgtggaagccatgaggggtgaagctgccagctgccgcaggtccmcctccccactgcccgtgcccaggctggcctctgcacaggcaggttaccttaagacctggacacccctccctcttctggggtgctgaactgattcctggctctggagaactcttatagaagccacacagcttctgccaaagtgtcccatgtccaccaagacatggaacaccagggtcagcctggctgagaaggccccagagcatctagagacccttgggtctagagacctcccacgagaaaggctggcatcctgggggaagcctgagccagggcagccccatgggaggggcctgggaccag

SEQ ID NO: 59184 - DNA, 601 bp, Human
tgctcagccaggcttgcagcaggcctggctcccttcccagtggtcctgagcccctcccagggctctatatttgggctattaccagaacatgggtgaatggctggaacctccgtactcaggggagaccctagcccactaaattatagcccaaaatgaagggagacagtgagaggccccagcacgtgaagcagctgtcccactctctcttccatctaccctggctcttggacgggctggtcttccgagctcagaccccagcatgtttgtcctggctcccgcagggttgtaaactccagcactkgtcgacaatctcttcactggaggcatctggcacctagaggaccctgtggaagccatgaggggtgaagctgccagctgccgcaggtccccctccccactgcccgtgcccaggctggcctctgcacaggcaggttaccttaagacctggacacccctccctcttctggggtgctgaactgattcctggctctggagaactcttatagaagccacacagcttctgccaaagtgtcccatgtccaccaagacatggaacaccagggtcagcctggctgagaaggccccagagcatctagagacc

SEQ ID NO: 59185 - DNA, 601 bp, Human
actcaaacaccgactgggaaaatcttgggccaggcccccgctacagcccctacaaggctcacgttccttttgctcagccaggcttgcagcaggcctggctcccttcccagtggtcctgagcccctcccagggctctatatttgggctattaccagaacatgggtgaatggctggaacctccgtactcaggggagaccctagcccactaaattatagcccaaaatgaagggagacagtgagaggccccagcacgtgaagcagctgtcccactctctcttccatctaccctggctcttggacrggctggtcttccgagctcagaccccagcatgtttgtcctggctcccgcagggttgtaaactccagcactggtcgacaatctcttcactggaggcatctggcacctagaggaccctgtggaagccatgaggggtgaagctgccagctgccgcaggtccccctccccactgcccgtgcccaggctggcctctgcacaggcaggttaccttaagacctggacacccctccctcttctggggtgctgaactgattcctggctctggagaactcttatagaagccacacagcttctgccaaagtg

SEQ ID NO: 59186 - DNA, 601 bp, Human
tcagcccagctggctcctcagacttctcctggacaggtgagtctggggagctggcgcccacccacaggctacagtgtgcagggccagtggctccctcctccttctcctccctgcagtcccggcagggcctgtctgttagctggtgagtgtgctgcctaatttccttaatgcagctctaaaggttaattggtctgagagagggatggggcacaggatgactctgtcctcgggcctgcctgtgtctcttctagcagggcccagcctggcacagagctctgaaagagcccaaggagggcagctrgggagcagatacccctgagaactgaaggggtcttgtgaggctccttccaagtcctggcctacagggaggtgtggggaaatgggagaggagttaaaatagctggatggggaaatgaggggcctcccagagtgggacctggaccagggtagggctccaagggcatgaccttgtccttaggccctgtgcagggagcatgcagccagcagaggtacgcactcaaacaccgactgggaaaatcttgggccaggcccccgctacagcccctacaaggctcacgttccttttgctcagccaggcttg

SEQ ID NO: 59187 - DNA, 601 bp, Human
cctcattctaccaggattaggatctctcagccatcagtccctcccagggcccataccagcttcccaacatacacacaggcaccaagtacaaagggcccaatgtgatgttcaccacagggcagagcctcccgtcgcggcaggcgagcatgtgcgctcacacacacccctcacacacaggcacgacgtgcaggtgtgggcatgaagtgacagaggcacgggttcctagtcccttctcctggaaccacagggaccgttgaggaggagatggggacatatgtcgtccagtagcctggacatccaygtggacccgtgaggctgggagggaagtgcagaggacctcagaagccctgctctgtgacttgacagggcgggagcctgtggcagttgcctgagaacccttgtgaagacagggagcgtgtgcatgctccgttcctgaccaaggcgcagctggataggggcccacccctccccacctccccggctttccaacactcccctggagtctgtccttctactggccccgtcctctccaaaggacccctgctctctccagggctctggccttcctcccatcccctggtgtccctcccattcccagccc

SEQ ID NO: 59188 - DNA, 601 bp, Human
gagggagcagaggctctggggctcctggcaggtaagcggaggcagctggcagggcctggctggggctccccttgggaatgcttcaggcggtgtcacacctcacctgccctggcctgggggagggcaggctctgagcctctggatccttcctcattctaccaggattaggatctctcagccatcagtccctcccagggcccataccagcttcccaacatacacacaggcaccaagtacaaagggcccaatgtgatgttcaccacagggcagagcctcccgtcgcggcaggcgagcatgtgcrctcacacacacccctcacacacaggcacgacgtgcaggtgtgggcatgaagtgacagaggcacgggttcctagtcccttctcctggaaccacagggaccgttgaggaggagatggggacatatgtcgtccagtagcctggacatccacgtggacccgtgaggctgggagggaagtgcagaggacctcagaagccctgctctgtgacttgacagggcgggagcctgtggcagttgcctgagaacccttgtgaagacagggagcgtgtgcatgctccgttcctgaccaaggcgcagctggat

SEQ ID NO: 59189 - DNA, 601 bp, Human
ctgtgatggcatcaagaaggaagtgagacgcccctgggacactcccaggagggagcagaggctctggggctcctggcaggtaagcggaggcagctggcagggcctggctggggctccccttgggaatgcttcaggcggtgtcacacctcacctgccctggcctgggggagggcaggctctgagcctctggatccttcctcattctaccaggattaggatctctcagccatcagtccctcccagggcccataccagcttcccaacatacacacaggcaccaagtacaaagggcccaatgtgrtgttcaccacagggcagagcctcccgtcgcggcaggcgagcatgtgcgctcacacacacccctcacacacaggcacgacgtgcaggtgtgggcatgaagtgacagaggcacgggttcctagtcccttctcctggaaccacagggaccgttgaggaggagatggggacatatgtcgtccagtagcctggacatccacgtggacccgtgaggctgggagggaagtgcagaggacctcagaagccctgctctgtgacttgacagggcgggagcctgtggcagttgcctgagaacccttgtgaa

SEQ ID NO: 59190 - DNA, 601 bp, Human
ttggtctatccatgtagagctgtgatggcatcaagaaggaagtgagacgcccctgggacactcccaggagggagcagaggctctggggctcctggcaggtaagcggaggcagctggcagggcctggctggggctccccttgggaatgcttcaggcggtgtcacacctcacctgccctggcctgggggagggcaggctctgagcctctggatccttcctcattctaccaggattaggatctctcagccatcagtccctcccagggcccataccagcttcccaacatacacacaggcaccaastacaaagggcccaatgtgatgttcaccacagggcagagcctcccgtcgcggcaggcgagcatgtgcgctcacacacacccctcacacacaggcacgacgtgcaggtgtgggcatgaagtgacagaggcacgggttcctagtcccttctcctggaaccacagggaccgttgaggaggagatggggacatatgtcgtccagtagcctggacatccacgtggacccgtgaggctgggagggaagtgcagaggacctcagaagccctgctctgtgacttgacagggcgggagcctgtggcagtt

SEQ ID NO: 59191 - DNA, 601 bp, Human
ttctctctgctgccccctctaggtttggggctcccaggagccctcgctttctccccaataacctcctcccctggctccgggtcctgccctttgggctacatggcacagcctgtttccctggccctgtgaaggtccctccagaggctgctctgctccaaggcacacacagaccccaggcctggcctccctgagttgttcctccctaccatggcctctatcccctgtgcggtctcatccggagtaagcctgaagctcgtcttgtgaagccaccatcacattggctctttcagcaataagcctragaaatgtagtctcctcaggcccacgaggtcctctagaacccccagatctttgtgccaactcgtctttctccagctgaagtgctacagcctcttggtctatccatgtagagctgtgatggcatcaagaaggaagtgagacgcccctgggacactcccaggagggagcagaggctctggggctcctggcaggtaagcggaggcagctggcagggcctggctggggctccccttgggaatgcttcaggcggtgtcacacctcacctgccctggcctgggggagggcaggctctgagcctctg

SEQ ID NO: 59192 - DNA, 601 bp, Human
gtgctgggtaccgagtccaagggcataacgacctgggccttcccctcaggtgacttctcaggtatctggggcaagcagggcaggggcaggacagtcaagaatgagaggacacacagggtactgggtctagggccgggggcacagtcacgctggggctgaggatggggagctttctgagcaggacaagggcttgggaggccagggtttggcagcccacctcaggtagtcgcgtcggcacaggatgaggttggccttggtgtagagggtggagcccacctcgcccaggcggcagtcacagcasgcacacttgaggcagtcttcgtgccagtacttgtccaatgccttcagcagatagcggtccttgatcttgcggttacagcccgcacagcccttctgcttccctttgggctggacggagagcatcggcacgcctgcagacggacagacagacagcaacgcaggatgggccccgtagctctgggcctcaaggaatatcccccaagaatggggagctcactgcttctctctgctgccccctctaggtttggggctcccaggagccctcgctttctccccaataacctcctcccctggctccggg

SEQ ID NO: 59193 - DNA, 601 bp, Human
cagattccagatcaggtgggtcagaagcacctggccaaggcaggggggcggagccagactggggccctcggaaagcttaacttaggggccccaggttacaaatgcctgccctggacttgtgctgggtaccgagtccaagggcataacgacctgggccttcccctcaggtgacttctcaggtatctggggcaagcagggcaggggcaggacagtcaagaatgagaggacacacagggtactgggtctagggccgggggcacagtcacgctggggctgaggatggggagctttctgagcaggrcaagggcttgggaggccagggtttggcagcccacctcaggtagtcgcgtcggcacaggatgaggttggccttggtgtagagggtggagcccacctcgcccaggcggcagtcacagcacgcacacttgaggcagtcttcgtgccagtacttgtccaatgccttcagcagatagcggtccttgatcttgcggttacagcccgcacagcccttctgcttccctttgggctggacggagagcatcggcacgcctgcagacggacagacagacagcaacgcaggatgggccccgtagctctgggc

SEQ ID NO: 59194 - DNA, 601 bp, Human
tgctcctaggatatggctgcctgccagtttccctgggcaaatggatgcctgctcccaaggaccatctagaaaggaaagttggacactgggagatggaaagagactgcattagggaggagggtcctgaggaagtcaaagcttccacacctgttctcaaagcccctctgaggtatcccctcccagattccagatcaggtgggtcagaagcacctggccaaggcaggggggcggagccagactggggccctcggaaagcttaacttaggggccccaggttacaaatgcctgccctggacttgtrctgggtaccgagtccaagggcataacgacctgggccttcccctcaggtgacttctcaggtatctggggcaagcagggcaggggcaggacagtcaagaatgagaggacacacagggtactgggtctagggccgggggcacagtcacgctggggctgaggatggggagctttctgagcaggacaagggcttgggaggccagggtttggcagcccacctcaggtagtcgcgtcggcacaggatgaggttggccttggtgtagagggtggagcccacctcgcccaggcggcagtcacagcacgc

SEQ ID NO: 59195 - DNA, 601 bp, Human
atctgggctcaagcaatccttccacttcagcctcctgagtagttgggactacaggcatgcagccactacacctggctaattttttttttttttagaaacggggtttcaccatgttgcccagggttggtctcgaactcctgagctggagtgacgtgcctgcctcggcctcccaaagtgctggagttacaggcataagccaccgcgcctagcctgaacattcttccttaacccctgcttctggtctcagcctctcccctccagccctggcaaggagcactaagtcacagattctgttttactrcatcacttttaaatgcaggtgttaaaaggggcaggcaggtcagtcaaaggatctttggggaattgagggagcttccactgataacctcccccttgcaacatgcccagacctgggcagagggagccccatgaagcccttgccccgacctgttaattaatgcgatgagccctccttccccacaagcccggcaaccatccagcagcctgcgacagagccaaatgcaggtgctgggtctcagccaaggccctgctttgtggcctccttccagccttgctgatgtcataaatggcctcagggagg

SEQ ID NO: 59196 - DNA, 601 bp, Human
tgcagcctcaaacatctgggctcaagcaatccttccacttcagcctcctgagtagttgggactacaggcatgcagccactacacctggctaattttttttttttttagaaacggggtttcaccatgttgcccagggttggtctcgaactcctgagctggagtgacgtgcctgcctcggcctcccaaagtgctggagttacaggcataagccaccgcgcctagcctgaacattcttccttaacccctgcttctggtctcagcctctcccctccagccctggcaaggagcactaagtcacagmttctgttttactgcatcacttttaaatgcaggtgttaaaaggggcaggcaggtcagtcaaaggatctttggggaattgagggagcttccactgataacctcccccttgcaacatgcccagacctgggcagagggagccccatgaagcccttgccccgacctgttaattaatgcgatgagccctccttccccacaagcccggcaaccatccagcagcctgcgacagagccaaatgcaggtgctgggtctcagccaaggccctgctttgtggcctccttccagccttgctgatgtcataaat

SEQ ID NO: 59197 - DNA, 601 bp, Human
agccacgctcgcatcccagcccactggtctagctggtcctacagtcactccttgcctctgccagagcaaaaaaaaaaaaaaaaattaccttccatccctagtagctggcagggccctatatgcttgagggtgctttttcctgataagcccatcctacactgtgggcctctctctccaagtcctgtgaacccatcagatggtctgccacatcgtcctaacctggtagagtcagcccccaggtgatgccctaaacctccagacatggaggccccttctaggtcctcaaggggtgaatccccargaacattcttttcttttttgagacagggtcttgctctggcacccaagctggagtacagtggcgcaatcacagctcactgcagcctcaaacatctgggctcaagcaatccttccacttcagcctcctgagtagttgggactacaggcatgcagccactacacctggctaattttttttttttttagaaacggggtttcaccatgttgcccagggttggtctcgaactcctgagctggagtgacgtgcctgcctcggcctcccaaagtgctggagttacaggcataagccaccgcgcctagc

SEQ ID NO: 59198 - DNA, 601 bp, Human
ccccgatttgtccagctcaaactcaggcgcctgcagatgagcttggctccattattcatcagcttgagctgcctggtggctcagattaaggcagacaaaggctaggccacagcatctgcctgccaagaggggcttttcttgccatcggcccaggaacagttgctgcagagggcgcaggctctggacagccattctccaggcctgagcagctcaaggaagccacgctcgcatcccagcccactggtctagctggtcctacagtcactccttgcctctgccagagcaaaaaaaaaaaaaaaaattaccttccatccctagtagctggcagggccctatatgcttgagggtgctttttcctgataagcccatcctacactgtgggcctctctctccaagtcctgtgaacccatcagatggtctgccacatcgtcctaacctggtagagtcagcccccaggtgatgccctaaacctccagacatggaggccccttctaggtcctcaaggggtgaatccccaggaacattcttttcttttttgagacagggtcttgctctggcacccaagctggagtacagtggcgcaatcacagctcactgcagc

SEQ ID NO: 59199 - DNA, 601 bp, Human
tttcctgcacacagacagagcaagccccaagtgaggcaaggaggctgagaagagggtggggggcccctttaatccccgatttgtccagctcaaactcaggcgcctgcagatgagcttggctccattattcatcagcttgagctgcctggtggctcagattaaggcagacaaaggctaggccacagcatctgcctgccaagaggggcttttcttgccatcggcccaggaacagttgctgcagagggcgcaggctctggacagccattctccaggcctgagcagctcaaggaagccacgctcscatcccagcccactggtctagctggtcctacagtcactccttgcctctgccagagcaaaaaaaaaaaaaaaaattaccttccatccctagtagctggcagggccctatatgcttgagggtgctttttcctgataagcccatcctacactgtgggcctctctctccaagtcctgtgaacccatcagatggtctgccacatcgtcctaacctggtagagtcagcccccaggtgatgccctaaacctccagacatggaggccccttctaggtcctcaaggggtgaatccccaggaacattctt

SEQ ID NO: 59200 - DNA, 601 bp, Human
caaagatgctgtaaaacagaactgatgcccaaaggaagcgccaaggacatctggcacaaatgcctctttgaggcaggcacccctcctcttagctgctggctgtaaagctctagggacagggagtttactccctccccatgcaggccagcccttggctggatgtcccaatggtctgagccatcccggctcctccttgcttctttcctgcacacagacagagcaagccccaagtgaggcaaggaggctgagaagagggtggggggcccctttaatccccgatttgtccagctcaaactcaggygcctgcagatgagcttggctccattattcatcagcttgagctgcctggtggctcagattaaggcagacaaaggctaggccacagcatctgcctgccaagaggggcttttcttgccatcggcccaggaacagttgctgcagagggcgcaggctctggacagccattctccaggcctgagcagctcaaggaagccacgctcgcatcccagcccactggtctagctggtcctacagtcactccttgcctctgccagagcaaaaaaaaaaaaaaaaattaccttccatccctagtagctggcag

SEQ ID NO: 59201 - DNA, 601 bp, Human
ctggcctcaactgatcctcctgccttggcctcccaaagtgctgggactacaggtgtgagccactgtgccttgccaaaattaaagtgttttattaaatcttttttccatgacaaactcactgtgttacttgcctaagtccctttttttctttctctgaacctcagtttatccttctgtaaaatagggatggatgatcctattcaaagatgctgtaaaacagaactgatgcccaaaggaagcgccaaggacatctggcacaaatgcctctttgaggcaggcacccctcctcttagctgctggytgtaaagctctagggacagggagtttactccctccccatgcaggccagcccttggctggatgtcccaatggtctgagccatcccggctcctccttgcttctttcctgcacacagacagagcaagccccaagtgaggcaaggaggctgagaagagggtggggggcccctttaatccccgatttgtccagctcaaactcaggcgcctgcagatgagcttggctccattattcatcagcttgagctgcctggtggctcagattaaggcagacaaaggctaggccacagcatctgcctgccaag

SEQ ID NO: 59202 - DNA, 601 bp, Human
acacatgcacatactatacactgggtacgggggtgggaggatacgttatcccatgcacatgcacgtttcaaacacgtatacaggctgggcgcggtggctcacacctgtaatcccagcaatctgggaggctgaggtgggcagataacctgagatcaggagttcaagaccagcctggccaacatggtgaaaccccgtctctactaaaaatataaaaataaaaataaaaattagccaggcgtggtggcacacgcctgtagtcccagctacttgggaggttgaggcaggagaatcacttgaaccygggaggcagaggttgccgtgagccaagattgtgagatcacaccactgcaccccagcctgggcaacagagtgagactatctcaaaaaataaaatatgtatacacacatgcatactcacctcatcatgcatgcacgttgcacatacacatacacccccagacatttaaaaacacatgtacaaatgcatattaattccatcatgcacatgtgcccacttgtacatttccaaatacacatgcatgcacatgcacactcaactatgcatacacagtaaactcatgcacgccttcattatattcac

SEQ ID NO: 59203 - DNA, 601 bp, Human
accagaatcacaagggctgggtgaggagagagtggccactccctgaggggactttgccctccagatttgggaaccccttctcactggaacatacatgcacacacatgcacatactatacactgggtacgggggtgggaggatacgttatcccatgcacatgcacgtttcaaacacgtatacaggctgggcgcggtggctcacacctgtaatcccagcaatctgggaggctgaggtgggcagataacctgagatcaggagttcaagaccagcctggccaacatggtgaaaccccgtctctaytaaaaatataaaaataaaaataaaaattagccaggcgtggtggcacacgcctgtagtcccagctacttgggaggttgaggcaggagaatcacttgaacctgggaggcagaggttgccgtgagccaagattgtgagatcacaccactgcaccccagcctgggcaacagagtgagactatctcaaaaaataaaatatgtatacacacatgcatactcacctcatcatgcatgcacgttgcacatacacatacacccccagacatttaaaaacacatgtacaaatgcatattaattccatcat

SEQ ID NO: 59204 - DNA, 601 bp, Human
gttctaatgtggcaggagagcggctggccagcctgcactggtagagtggctggctggccggccaggcaggtgggcaggcgggcagatggacagacgggcctggaggccaggcgccgggcgttactgaacttgggattcaaaggtgccattgagctgcccttcctcatagtccatctgacacaagatcatgttgttcttcaggaagaatttgtctcccacacaaaatctagaaaatccaagcgagagagagaagccatgggaaggtcccagtgggtaaggggggggctgcagacagaagccrgcctggcctatgaggtgagctatgtgggaggtggtggggggagtttgttccttgaaccttccagagggaactgccaaaagtccccacagcacacctgggcaattcccccaggccagccccaaccttggccaggccctgtagcctgaggtggtaggacagacagacagttgggccacaggcttccatagtcaggtctcctgtgttggtgagtgtagggttaggggggttggtggagaggtgcaggaacagcctaccccagtcccagagagggagaaagggaaagcacaaacagaaaaagac

SEQ ID NO: 59205 - DNA, 601 bp, Human
ccatcgaggacggagaagttctaatgtggcaggagagcggctggccagcctgcactggtagagtggctggctggccggccaggcaggtgggcaggcgggcagatggacagacgggcctggaggccaggcgccgggcgttactgaacttgggattcaaaggtgccattgagctgcccttcctcatagtccatctgacacaagatcatgttgttcttcaggaagaatttgtctcccacacaaaatctagaaaatccaagcgagagagagaagccatgggaaggtcccagtgggtaaggggggrgctgcagacagaagccggcctggcctatgaggtgagctatgtgggaggtggtggggggagtttgttccttgaaccttccagagggaactgccaaaagtccccacagcacacctgggcaattcccccaggccagccccaaccttggccaggccctgtagcctgaggtggtaggacagacagacagttgggccacaggcttccatagtcaggtctcctgtgttggtgagtgtagggttaggggggttggtggagaggtgcaggaacagcctaccccagtcccagagagggagaaagggaaag

SEQ ID NO: 59206 - DNA, 601 bp, Human
cccaagaggcagaggatgcagtgagccgagatcgcaccactgcactccaacctaggcgacagagcaagactccgtctcaaattaattaattaattaattaattaattaaaaggtaatgaggctgggcactttgggatgcccaggcaggcagatcacttgagttcacaagttcaaggccagcctaagcaacatgatgaaaccctgtctctacaaaaattagacaaaaatacaaaaattagtcactacaggtgcacacctgtagtcccagatactcaggaggctgaggtcagaggatggcttsagcccaggaggcggaggttgcagtgagctgagatcacaccactgcactctagcctgggtgttagagccaggccttgcctctaaataagtaagtaaataaataaataggtaatctgtagaagtaattaaaagtaattttccaaatttttctctcccctatccatgccagccaaggtttgtaaaattccacttcaaattttttatctctgggaataacaatgttgtctctaactccgtattttcaaaaccaacactaagttacagcctggtgtgtaagtattcctataatttcttaaatata

SEQ ID NO: 59207 - DNA, 601 bp, Human
aaaatgtccccagttgccctagtaacagcttctatagattcttttttaacccatgatccaatcaagcaccatacactgcatttagttgtcactctttgctcttctttaaatacagactagtcttccattttgtagtctttcctgacaccaggttaattttgcaaagtaatgttttgttttaataatctaaataatacatagatgtataaagaaatagtttcgattgcaaaagatttccatggcctgacaaatagctgtttaaattcttgccagcccatgctgaattaagccctttgacacsaggcacttttaaaaagcttacttgctggccgggcgcggtggtccacgcctataatcccagcactttgggaggccaaggcgggcggatcacctgaagtcaggcattcgagaccagcctagccaagatggtgaaacctcctctccagtaaaaatacaaagttagccaggtgtaatggcgcacgcctctagtcccagctactcaggaggctgaggcagaactgcttgaacccgggaggccaaggctgcagtgagccgagatcacgtgccactgcactttagcctgggcaaagagcaaaactca

SEQ ID NO: 59208 - DNA, 601 bp, Human
ttgcccctagtagtatgtttaaacagaacaatgttatactgttacttttctagtataaaaagtacaactgtttgggaggccaaggtgggagaatggcttgagtgtaggagttttgagactagcctaggcaacagagacccagctgggcaaggtggctcacatctataatcccaacactttgggaggccgaggcaagggactaattgagcccaggagttcaagaccagcctgggcaacatggtgaaactctgtctctaccaaaaaaaatacaaaaattagccaggcgtggtggtgtgcataygtagtcccagctactcaggaggctgaggtgggaaaattgcttgatctcgggaggcgaaggctatagtgaggcatgatctggccactgcctttggtctgggcaacagagcaagactttgtctccaaaaaacaaaaccacatacatagtgagatctcatctctattgtaataaaaataaataaaaaataaaaagtgcaacacggggtaattctccagatcttaacacctcacttattttatttaaagataaagtgacaatttccccctcagcttctgaaacctatagctatcactttctttt

SEQ ID NO: 59209 - DNA, 601 bp, Human
atttgataactacagcttattttagaactttctactttctttttttaactcatgttttttaacacaatttaacaaccatagaaacaaatatttaattttaaatttatttgcccctagtagtatgtttaaacagaacaatgttatactgttacttttctagtataaaaagtacaactgtttgggaggccaaggtgggagaatggcttgagtgtaggagttttgagactagcctaggcaacagagacccagctgggcaaggtggctcacatctataatcccaacactttgggaggccgaggcragggactaattgagcccaggagttcaagaccagcctgggcaacatggtgaaactctgtctctaccaaaaaaaatacaaaaattagccaggcgtggtggtgtgcatacgtagtcccagctactcaggaggctgaggtgggaaaattgcttgatctcgggaggcgaaggctatagtgaggcatgatctggccactgcctttggtctgggcaacagagcaagactttgtctccaaaaaacaaaaccacatacatagtgagatctcatctctattgtaataaaaataaataaaaaataaaaagt

SEQ ID NO: 59210 - DNA, 601 bp, Human
tttctagcaatgattaaatattttcaagtgctttctaaaaaatcaattttaaagacctttctattcaggataatgacaaacataataaaggcacatatgacagtttaacataattagctacttttatgcagcacttatatcttttagtctgcaagtatattattaaatgatagaaaacatctaatacaaccatttctacagaactaggaaatacatttctaagaaagattttacagatgccatcgttttgtttttttgagacagggtcttactctgtcaccaggctggaatgcagcggcaygatcatagctcactgcaacctctacctccggggatcaagggatcctcccacctcagcccccaccaccccccataccccagtagctgggactacaggcatgcaccactatgcccagctaatttttttttttttttttgtaaagacagggtctccctctgttgcccaagctggtctcaaactccttgagctcaaccaatcctcccacctggacccccaaagtgctgagattataggcatgagccaatgcattcagcctccaaaacaaatgtttaaaaaaaaaaaaaggtaggagagtagact

SEQ ID NO: 59211 - DNA, 601 bp, Human
aagatatagaaacaggattgtagctgaatgcggatgtgaatggggttaagagatgttttctgcaggttttttgttgctgttattaagacaaagcacgataaaacatgtttgctggtgctgataatctagtatggagaaaaaaattaatggtacatgatgagagtctccaagaggggaagggaaatggtgcataagcaaaagagtagctttaattatttatttatttattttgagacaaagtctcactctgttgcccaagctggaacacattggcgtaatctcagctcactacaacctccamctcccaggttcaagtgattctcctgtctcagcctcccaagtagctggtactacaggcacacgccaccatgcccagctaattttttttgtatttttagtagagacagggtttcactacgttggccaggctggtcttgaactcctgacctcaagatccgcctgccttggcctcccaaaatgctgggattacaagcgtgagccaccgcacccagccgctttatttttctagcaatgattaaatattttcaagtgctttctaaaaaatcaattttaaagacctttctattcaggataatgacaa

SEQ ID NO: 59212 - DNA, 601 bp, Human
aaggttacagcctactaactttacttttacctaaggttcttccttaaatcttaaaccacttcaagaagtggaaaaaattaggcatatgaactgttctattcttaatctgtcccccaaaagcagctggttatttatacgtgtccacccaggaataaacagaacacatttcagtctgtaaacatatcactcaacatttcacccacacacccatactccactagaagtacctctctctgttttgggggtttcatcccatctgtttttacgagcactggaagttgcgcctccatggcctggtgtygcatggcctggtgtatcacctcgtccaggagtagcagctcccgctggtgtgtggctaggtgtaggatcccatatttttgagcctggggttgctccaggagtctcgcttccctttgcacgacctggtgtctcatcccatcttaaggaaggagtatgcccaggggtcttaaaaaagcaaaaaaattttatttcacacacccacacagaaataattagaaaatttccataaaataaaaaactttaaacgaaaaatgttttagttctatgcactataattaatgaaaagttagaagacactacc

SEQ ID NO: 59213 - DNA, 601 bp, Human
gttgatatgataaaaaggccaggcacggtaactcacgcctgtaatcccagcactttgggaggctgagagggacggatcacttgaggtcaggagttcaagatcagcctggccagcatggcgaaaccctgtctctactagaaatacaaagatgagccgggcatggtggtggacacctgtaatcccaggtacctgggaaactcaggcaagagaatcgcttaaacctgggaggcggaggttgcaatgagccgaaatcacgccactgcacttcagcctgggcaacagagtgagactccatcttttwaaaaaaaaaaaaaaaaaaaattctttgtgtccactgacaatccataaacttaagtatataaaatcttggtgaagcaccaagtaaaataaccacaatctcaacgagcttattcctgggactgctagaaaactgaagcaccagcagttctcaaagtataaccgatagacccatacacaagtctttgagatgtctttcaaaaagtaataaaagtttcatgttgttcatttcttttcatctctatatggaactgaaatatacctggaaatagctaagagaatggaatgacaatagtaaatttgg

SEQ ID NO: 59214 - DNA, 601 bp, Human
ctacaacagcaaaagctctagctgttgtgttacggacatactcatccatgttatctatatcaggtctcatggtagagatcatagtagccagaccagcagcctaaaatgtaaacaaagaaaggacagtcatgagttggtaatattaatcttcaaccatttctttccataatcaattccataaacagatataaattttcttctctagaaattaaatgtaaatacctttgccaaattagaaatgatctctcggccttccactctagcatagtaatcttcatcaatcaatagcggttcaatgacyacgaggatctgaaaaagagaaaagagaagaagctacactttcacatcaattactgatgaaatgctcatgtacagaattaaacatacataagaaatttagaattatcaggacttttgttaatcaagggacgaactgtttaagaattttaattatacaagttcaaactccagacagagatgaaaatttaagagagctattagtgacacactaatattcaatattttttaaagaaataacttatacaccctatgaacatactgcaccataattaccatcggtgaaaaaactggttcttaatac

SEQ ID NO: 59215 - DNA, 601 bp, Human
gagtcaaccttttctaaccacccaaacatctgttgctgtttttttacatcaaatcttaaaacttgaggtagaataatatcgtttggtaaccccctgagcattttaaaaattacttcaaattcaattgcattctagaaaaatttgcttgacaactaatatgcttttctacaaatattaaagttagtagcaatgtgccataatagttttcattacctctgtagtctgttcttggaaagcataaagaataccatcaatcagttgttcttcaagtttatgatcaatatctgctgctcccaaattrcccataattttctcaattgtctccatcaccatttttctgtactgttcggcttcatctttcagatcatccacaatcctggatataatttctgctgcacctactttgtttgccaactccacagtagtatcaactaactaaaaagaacagaaaaacaaaaaaccttttagactgcttttccaaggaaataaagcaacatcatgaaaaccaaatactctaaatatactacttatttagctaataaacatggtaagaatgattcattgctacttattaaagttgaagagaaaagtgaccaaacat

SEQ ID NO: 59216 - DNA, 601 bp, Human
tgttatttaaacgccacaaaactgtaccacagatctgaggcaagtatggtttgactcgtttgccaagagcattaaccactgtgccaaagccgttcaacattactgagtcctaaaaaataaatttaaaaaaaagacatattcatttggtttatgactgcacagttgaaatacactaagagtcaaccttttctaaccacccaaacatctgttgctgtttttttacatcaaatcttaaaacttgaggtagaataatatcgtttggtaaccccctgagcattttaaaaattacttcaaattcaaytgcattctagaaaaatttgcttgacaactaatatgcttttctacaaatattaaagttagtagcaatgtgccataatagttttcattacctctgtagtctgttcttggaaagcataaagaataccatcaatcagttgttcttcaagtttatgatcaatatctgctgctcccaaattacccataattttctcaattgtctccatcaccatttttctgtactgttcggcttcatctttcagatcatccacaatcctggatataatttctgctgcacctactttgtttgccaactccacagtag

SEQ ID NO: 59217 - DNA, 601 bp, Human
gtgtcccatcaatttttcctataataaaacaaataatgttaaaatgttactatttacattaaactatttggggaagaagtaagaatttgatgcaaaagtttacctcttgacaagtcttcatgacaacagcagttcgagaaatcaagtcagctgcctgttgcctaactttagcagatttgttatttaaacgccacaaaactgtaccacagatctgaggcaagtatggtttgactcgtttgccaagagcattaaccactgtgccaaagccgttcaacattactgagtcctaaaaaataaattwaaaaaaaagacatattcatttggtttatgactgcacagttgaaatacactaagagtcaaccttttctaaccacccaaacatctgttgctgtttttttacatcaaatcttaaaacttgaggtagaataatatcgtttggtaaccccctgagcattttaaaaattacttcaaattcaattgcattctagaaaaatttgcttgacaactaatatgcttttctacaaatattaaagttagtagcaatgtgccataatagttttcattacctctgtagtctgttcttggaaagcataaagaatac

SEQ ID NO: 59218 - DNA, 601 bp, Human
atgattaactcattttaagcattaaataaaacttactactcttcagaaaggctgaagagttagtcttacaggtttagtcctaaaattacattgccacccccattaccatccaaattgaaatttgactgaaaatattaatactggatagcctaatcttttacacttatattagtgacattaaggaaattttgctaattgaatacaaagtggccaaatttgaaaattgatactgcttataaaaatgtgtgggtaatctgcttacctgtcagcaatacgaccaacaagatcaatacaattctcytgtactttttcatgtctgttctttaagatgggggtgagtctaggcagcagatctttaattggtggagtcatcttatgcatacctatttaatagaagtcaataaactatcaacatttgaattgcaacttttgttcactttccttttacttagcaatgtcatatatgactatgtataaatataaacttacagctgcctagggaaagagaaagccccagattctgaccagactcagaatcgtttttaacttttattaacaatttttgattatgtatagaaatgaaagaaatcagtgaagtgat

SEQ ID NO: 59219 - DNA, 601 bp, Human
atgggtatgaaaatgagtttccaggccgggcacggtggctcacgcctgtaatcccagcactttgggatgccaaggcgggtagatcacgaggtcaggagatggagaccatcctggctaacacggtgaaaccctatctttgccaaaaatacaaaaaattagccggccatggtggcacacgcctgtagtcccagctacttgggaggctgaggcagaagaatcacttgaacctgggaggcagaggttgcagtatgccgagatcatgccactgcactccagactgggtgacacagcaaaactccgyccaaaaaaaaaaatgagtttccacactttgctccaaagatagtaacacagaccatatcaaagagaaaagagaaaaatacttgtatttactaatattcttgtttttcctatttattttaataatgtcattcagcataagaatgaagcagtattcctcattaataaaatttccaactgaagtattcttttcatttagtaattttcaatggaattactcccttaacttcttagtacacagaaaaaagtttttaactgcaggtgacatacattaatgactgcactatggtgctcaggcacttct

SEQ ID NO: 59220 - DNA, 601 bp, Human
aaaggggagggagagcattaggacaaatacctaatgcatgcagggcttaaaacctagatgacaggttgataggtgcagcaaaccaccatggcacatatatacctatgtaacaaacctgcacgttcagcacaagtatcccagaacttaaagtattatttaaaaaaaaaaaatcaccgattaaaaaaaaaatctttaacttacctgtaaacaatattgcaacattctacatggtccaatagcaactctcaggccctctagggctcccataactgcctgaattacatgaggagatgtctcaaayacattgggccatacatagttcaacaagtgattcagcgaatcttcacaaccaaatccataaaccccaagtgacatgtgctgtaccactgcactagccgtctgtctgtgtacaaggtctctacaacggaagggaaaaaagtcctttaagatgcggtcttataagaaagggggaaaaatccttaaagatacagtcttagttttacaggaaatattcaccggcccattagaaactaaattactaattcagtgcactgaatagatgtgaagtcatctaacatttcatatatctaatatatccttt

SEQ ID NO: 59221 - DNA, 601 bp, Human
tcactcccctgtcaccacacaattgttctaccatatggcacaatataccctaatgataatcaggaaaagtaacttaattcaatacactacttttcttgctaagtaatcttttaaaaatctttaacttacaggcagtggggggaaaggggagggagagcattaggacaaatacctaatgcatgcagggcttaaaacctagatgacaggttgataggtgcagcaaaccaccatggcacatatatacctatgtaacaaacctgcacgttcagcacaagtatcccagaacttaaagtattatttaaaaaaaaaaaatcaccgattaaaaaaaaaatctttaacttacctgtaaacaatattgcaacattctacatggtccaatagcaactctcaggccctctagggctcccataactgcctgaattacatgaggagatgtctcaaacacattgggccatacatagttcaacaagtgattcagcgaatcttcacaaccaaatccataaaccccaagtgacatgtgctgtaccactgcactagccgtctgtctgtgtacaaggtctctacaacggaagggaaaaaagtcctttaagatgcggtctta

SEQ ID NO: 59222 - DNA, 601 bp, Human
aacagaaagatgagtttggagtgtttaattttactacatagtgacatatattcagaaagttgtcatacaaggaatgatgaggagttacaaatccaacttggaaacccttaatgctcactatcaatttgttgaaagtcaattttttttttttttttgagacggagtctctgtcgcccaggctggagtgtagcagcgctatctcggctcactgcaagctccgcctcccgggttcaagccattctcctgcctcagcctccctagtagctgggactacaggcgcccgccaccacgcctggctaatttttgtatttttagtagacgggacttcaccgcgttagccaggatggtctcgatctcctgacctcgtgatccgcccgcctcagcctcccaaagtgctgggattacaggcatgagccaccacacccggccacaagctgtttcttaactaagcttctgaagcaggaactcctaaagtgtcaataggcagttttacttacagtagtagttatatactaatgctgcttgcagaattttttttccctttagagttcacagaagtactaccacatggagacaaaacaaaacagtaaaaatagtatag

SEQ ID NO: 59223 - DNA, 601 bp, Human
tgattacacaagaaaaagcgccaggtgctgggcctggctgaggctggggtgcaaaaatggaccgggaaggctgcgggaggaggggacgcctgcactgcttctggaaggagctgtctggacagcggtcctccagtgcctggaacaaacatccaaaatccagagagttcacagggccagagtacaaagtgggtatgcgggaggggggcaagagatggcgctgcagaggtgagaagggcctcccaggggtcttaccatcccagggagtctcattctcctctcccaggatatcctcacccacccyaaccaggtatgtcctctctccttcccaggggcttcttcactttcccgcatcccccctctccccaggatgtatcagcccctgtcaggggctctctctctccctccccacccaggagagtcctcaccctcttcccaggagtgctggaactgcaggggccagggctggggaaatgtgtcaccatccccagtccctgacccacccaccctgtctctccacaggccctgggtgccaggccctgtggatgcacaaggtcccagcatcattgatggtgagcctgggggaagacgcccacttccaatg

SEQ ID NO: 59224 - DNA, 601 bp, Human
gcccttcctggacatgggggagggcaccaagaaccgaatcatcacagccgaggggatcatcctcctgttctgcgcggtggtgcctgggacgctgctgctgttcagggtgagccccctcggacctctgagtcagccgggcgagggcctgggccgagggacccccaatacccaggtagccctctagagcctgaggttccccatccaaaacttgggagaatgaaagcacccaccatataggggctgtgggagttaaatgaatgaatataaagaagggacttgaactggcgctgagcccaggggktgtcttcaatttagtttccccttctgggctgtcctcacgtccacctccccccaagaagagtctcattcttctccctaagagtgtcctcactcccctcctgccctcacccaggagtgtggttaccctccaggtgtagccaagaccagggaaggtggggcctggtcctcccagaatctctgatctgtaccagcctctccttaggcactacagaaagtgtgactgttattgttattattcatggagaatagtaagggagtggagactcaagaagacgctagcttgggaggccgaggcaagagg

SEQ ID NO: 59225 - DNA, 601 bp, Human; identical to SEQ ID NO: 59223

SEQ ID NO: 59226 - DNA, 601 bp, Human; identical to SEQ ID NO: 59224

SEQ ID NO: 59227 - DNA, 601 bp, Human
cagacccctggggaagagcattccacacagggaaatgccaaggtcaaaggtgctgaaggaatgggggtgtcacactgctgactttgactcagtaggacacacacacacacacacacacacacacacacacacagctccaacgtggaggggtgaagagacctgctcaggacccagggccctgtttttccaccctaatgcataggtcccaatattgaccgatgctctctcctctctcctagcctcacttctaaccttctggaacccacccaccactgccaagctcactattgaatccacgccrttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtataccgt

SEQ ID NO: 59228 - DNA, 601 bp, Human
agagcctcatctagctgaggatagggcctcctccttcacttgaggctcagcatggaaaggacagatggaaaaaattactagtgcatgagcccactgccctgggggacacaggttactccctgggaagttcagagtccccaaggggaggaacagagaagagaggatgctcctggcagctccatgtccaccagggatcaggcccagggccctctgtcttggaagcaaataatcatagataactgttcacttgggcagctcctctgtgcagagctgagatcaagtaattgtaaatattttgagrttaactcacaaacaacctcacagccaaatagcacttatcctacttatagaaaggaaattgagggacagggagacagtcactaacaagggtcacacaggccataggtggcagattagagacatatgaggtctgtctgcagccacagccccctcctctcctcaaccgggggtgatggggctgtttgttgttaggcatctgcatctgaggccagtcatgggttcacttccttttgtcttgtgcatccgcagctcagaagtggagattctggtctggaaagtaagaagcaaacagagaattaat

SEQ ID NO: 59229 - DNA, 601 bp, Human
cctcctctcctcaaccgggggtgatggggctgtttgttgttaggcatctgcatctgaggccagtcatgggttcacttccttttgtcttgtgcatccgcagctcagaagtggagattctggtctggaaagtaagaagcaaacagagaattaatcagttttactctagaactaaatcacctgcctcaaataacagagtcagtgctgggattgtccaggcctctcccttcgatccacagtcccctcactgcacctgaaatcctgtttcccgatgtgtgggtgtcactcccatgggaggataaargagaggactttgctttctctccccactcacaccctgcaccagcacaggcccaaagtgagacacacgctcgctcaggagttctctcttgaaaaagggaagaaaggaagaaggaatgaaaaaaggatccataacctctttagagaccggctcctggatgcagaatcctatgaggttctggccacacctgtttcttgtccctcaggggctgacacccatgttccatccctctgaacccctgtccctaaacctaccccatctcatgtgactctggggttccttggtcattagagggttttcagg

SEQ ID NO: 59230 - DNA, 601 bp, Human
ttgtgcatccgcagctcagaagtggagattctggtctggaaagtaagaagcaaacagagaattaatcagttttactctagaactaaatcacctgcctcaaataacagagtcagtgctgggattgtccaggcctctcccttcgatccacagtcccctcactgcacctgaaatcctgtttcccgatgtgtgggtgtcactcccatgggaggataaaagagaggactttgctttctctccccactcacaccctgcaccagcacaggcccaaagtgagacacacgctcgctcaggagttctctcwtgaaaaagggaagaaaggaagaaggaatgaaaaaaggatccataacctctttagagaccggctcctggatgcagaatcctatgaggttctggccacacctgtttcttgtccctcaggggctgacacccatgttccatccctctgaacccctgtccctaaacctaccccatctcatgtgactctggggttccttggtcattagagggttttcaggtctccctggtcctggtctggggcagccaagaggctcctggtccctggggtctctgaggtcactgtatcccccactgctcactgcca

SEQ ID NO: 59231 - DNA, 601 bp, Human
acctctttagagaccggctcctggatgcagaatcctatgaggttctggccacacctgtttcttgtccctcaggggctgacacccatgttccatccctctgaacccctgtccctaaacctaccccatctcatgtgactctggggttccttggtcattagagggttttcaggtctccctggtcctggtctggggcagccaagaggctcctggtccctggggtctctgaggtcactgtatcccccactgctcactgccatgggtatctctggctctttctgctcctctctgtccctcattttcytcccctttcattctagctgggatgccctgccctgcacagcttcctccacccttaggccttccccagaaaacccctctaacaaggctggctgtcctgttcccttcctgctcacactgtgtcctggcccacatcccaggcaacagagaaggcacagaaatcagccggagcagccgcccctgccgggctccatcacgagccaatgtccccaagtcaacaggagaatgagcttccactgtgtccccatccagggctctttcccccagtgaggccgacatgtggaacaggccacgggacagggac

SEQ ID NO: 59232 - DNA, 601 bp, Human
ctcattttcctcccctttcattctagctgggatgccctgccctgcacagcttcctccacccttaggccttccccagaaaacccctctaacaaggctggctgtcctgttcccttcctgctcacactgtgtcctggcccacatcccaggcaacagagaaggcacagaaatcagccggagcagccgcccctgccgggctccatcacgagccaatgtccccaagtcaacaggagaatgagcttccactgtgtccccatccagggctctttcccccagtgaggccgacatgtggaacaggccacgkgacagggacaagcgactcctccatacagtctctactgactcaccaggcagtcagaggcaggatgacaggtctgctttccccaaggcccagaggctaatttcatccattgacttccgtcctcatcttggtgtgaggctcacatcctccagtcattccccaggaccttccccaggtggagccggccaggcaggtgctgtctgatgggtttgctgcccattccacatacactactgtgtcctcatgatgatgccattgtcataaggtggggtcccttggactgagaagtgcaccagccactgg

SEQ ID NO: 59233 - DNA, 601 bp, Human
atccagggctctttcccccagtgaggccgacatgtggaacaggccacgggacagggacaagcgactcctccatacagtctctactgactcaccaggcagtcagaggcaggatgacaggtctgctttccccaaggcccagaggctaatttcatccattgacttccgtcctcatcttggtgtgaggctcacatcctccagtcattccccaggaccttccccaggtggagccggccaggcaggtgctgtctgatgggtttgctgcccattccacatacactactgtgtcctcatgatgatgccrttgtcataaggtggggtcccttggactgagaagtgcaccagccactggagtctcacatagactctgcccagtttagatgaacttaaactctcattgtgttttctcaggttaacaggagaggaagaaagcatttcacatgactgtttggggctccttccctatttgcctaactgcacaggaattaggggcagggagctctttctaaatttactaacataacacacgttgcttctaatttggcatcgttccttcctttatgtaactgacacacacctaagacttcctctcctactggttcta

SEQ ID NO: 59234 - DNA, 601 bp, Human
accagccactggagtctcacatagactctgcccagtttagatgaacttaaactctcattgtgttttctcaggttaacaggagaggaagaaagcatttcacatgactgtttggggctccttccctatttgcctaactgcacaggaattaggggcagggagctctttctaaatttactaacataacacacgttgcttctaatttggcatcgttccttcctttatgtaactgacacacacctaagacttcctctcctactggttctatcctcctaagaggactcatatgcctctctctactcarggagttgctaatttcaaaccaacttcagcatcttcatttgacgacaatatgatcctgctggaattcacagcacacctaaaccttagtatgttatcaagaaaaatactacttccagcccttgatctttgatctttaggacattagtaacgatctccacttatggaaaaaattaaatgtttcccccaaagttcttttattttttactatattcagaacataacatgaggtctaaactcctgacaaacttttcaaagcaaattacaacactacaggtcaagcatcccacatccaataatccaa

SEQ ID NO: 59235 - DNA, 601 bp, Human
tgagcaaacctgggcagaccaggccttgaccaagaatgggaggggaggggctgtctcctgtgctacttctgctcaaacacccattcccatcatcactcatctccaggatgtccttaaggctcagggttcacattttctgatgggagaaacaggtgaatgtctcagactttggctcaggggacatagcgggggtttggttgagacttcagggttgtgacatggctcagggggacaccgtggcccttccacagaccaggaacttatgcttccctctgacaacatcacctgtggctttattctstttcctccagatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggtaagtggatccatgaagcactagcatcacatttt

SEQ ID NO: 59236 - DNA, 601 bp, Human
ccttgaccaagaatgggaggggaggggctgtctcctgtgctacttctgctcaaacacccattcccatcatcactcatctccaggatgtccttaaggctcagggttcacattttctgatgggagaaacaggtgaatgtctcagactttggctcaggggacatagcgggggtttggttgagacttcagggttgtgacatggctcagggggacaccgtggcccttccacagaccaggaacttatgcttccctctgacaacatcacctgtggctttattctctttcctccagatggcccagatgkccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggtaagtggatccatgaagcactagcatcacattttcaggtggagtctggctctcagag

SEQ ID NO: 59237 - DNA, 601 bp, Human
agatacagaccatcctggataacacagtgaaaccccgtctctagtaaaaatacaaaaaattattcaggcatggtggcgagcacctgtagtcccagctactcgggaggctgaggcaggagaatggcgtgaacctgggaggtggagcttgcagtgagccgagatcgtgccactgcactccagcctgggcgacagtgcaagactccgtctcaaaaaaaaaaaaaaaaaaaaagaagccaaaggaacctgctctggcctactagttaagttcaaatttcttctctttactaattcttcttacttyctttccctctacttcccagtataattcctccatcttaattagaatctgactctctacacatccctgcccctttaccccggatgcacatagaattcttagtttcaatgttacacctaaaaacagggtgatctcccctccactacctgccctgtggacttactcacacccttcatcacaagcaacctcttatttcatggagaacacagactgtgtagtattaatatgtgaactttggacacatcctgcatgtggctgagaaccttttcctgacaatcaattcatgtgttcataacagataca

SEQ ID NO: 59238 - DNA, 601 bp, Human
acccaggctttgattgggatgttatatttgggaatatacatagatgaacccataggcactgctggcaaagtctgaagtcggccttggtttggcttcctcatgtcaagaggtttctaaaagtttaatctgagattccttataaaaacttcctgtaaaacaaacttgaaaagaccccaggctgggcacagtagctcacgtcgataatcccagcactttgggaggccgaggtgggtgaatcatgagatcaggagttcaagaccagcctggccaacatggcaaaacctcgtctctgctaaaaatmcaaaaaaaaaaaaaaaaaaaaagctaggtgtggtggcgggctcctgtaatcccagttactcgggaggctgaggcaggagaatcacttaaacctgggaggtagaggctgcagtgagctgcgctccagcctgggagtgcatacataggcctatactattcatgtgcgtacatgggcctatactattcatgtgcatacatagggctatacataggcctatactcctattcaaggagaatcgcttgaacttgggaggtggaggttgcagtgagctgcactccaacctgggcaacagggcaagac

SEQ ID NO: 59239 - DNA, 601 bp, Human
tattacactccgggagaaggaaacgcgggaggaaacccaggcctccacgcgcgaccccttggccctcccctttacctctccacccctcactagacaccctcccctctaggcggggacgaactttcgccctgagagaggcggagcctcagcgtctaccctcgctctcgcgagctttcggaactctcgcgagaccctacgcccgacttgtgcgcccgggaaaccccgtcgttccctttcccctggctggcagcgcggaggccgcacggtaagcgggggctccgagctggaccgggcgcgaggyggcagggccggacgccgaagcctcagagcgcgtgcctgagggccccgaggcgcccggcgcgggcccgtcccgccccctagagccgcggccacgtgcgagcggcaggcccggacatgcccggtcagcgccgtccgggaaccgagcgtgggccccggggggcagcggcggggtgcgtggggcgtccggagtcccggggctggggagtggggtcgcgcaggatcctcacacgcaggggccgggctctgttagtgcgatccagagaggccgtgggcgtcggtgagctccttcagacccgcagga

SEQ ID NO: 59240 - DNA, 601 bp, Human
ctgcctgtgcactctctcatccccaaaatgggactaattattgtaccagtactagagtattgcaaggattgaatgaatttaaagcagagtgtttagaacgtgtctgttgcacagtagttattcaggaaaaagccagttgtctttactattgctcagatcatcaagttagccttctccatatctctaacaggctgtttctaactaaatggttggagatctggccaggtcagtccctgctttaaatcttgacttctgatcttatggacaccctgcaacctcgtgccagccccgtctcttttcratcttccaataataatttacgtacagtccctgactagtgttagttctcacgtgtcttaatatttcagtactcactaaatcttcactttcaggaagatgtaacagggtgggcggtggcagtgccgtgttatgtcaaggtgacagccttagcaccgaccttcactaataaggggcctcggcctctccaatcttaaaccttctctctctgtgaagtggggactccatcctgaccacaacttgtctccagataagaagtaggtgggaagcagggtttggaaatcggcaaaactcctccatgacc

SEQ ID NO: 59241 - DNA, 601 bp, Human
ccccaaaatgggactaattattgtaccagtactagagtattgcaaggattgaatgaatttaaagcagagtgtttagaacgtgtctgttgcacagtagttattcaggaaaaagccagttgtctttactattgctcagatcatcaagttagccttctccatatctctaacaggctgtttctaactaaatggttggagatctggccaggtcagtccctgctttaaatcttgacttctgatcttatggacaccctgcaacctcgtgccagccccgtctcttttcgatcttccaataataatttaygtacagtccctgactagtgttagttctcacgtgtcttaatatttcagtactcactaaatcttcactttcaggaagatgtaacagggtgggcggtggcagtgccgtgttatgtcaaggtgacagccttagcaccgaccttcactaataaggggcctcggcctctccaatcttaaaccttctctctctgtgaagtggggactccatcctgaccacaacttgtctccagataagaagtaggtgggaagcagggtttggaaatcggcaaaactcctccatgaccctgaaaagagttggccttgg

SEQ ID NO: 59242 - DNA, 601 bp, Human
tcttccaataataatttacgtacagtccctgactagtgttagttctcacgtgtcttaatatttcagtactcactaaatcttcactttcaggaagatgtaacagggtgggcggtggcagtgccgtgttatgtcaaggtgacagccttagcaccgaccttcactaataaggggcctcggcctctccaatcttaaaccttctctctctgtgaagtggggactccatcctgaccacaacttgtctccagataagaagtaggtgggaagcagggtttggaaatcggcaaaactcctccatgaccckgaaaagagttggccttggtacaggttgcttggcccttcagaatatgaagcattttgtagatttgtggtacacttgtgcctcaaatgtctattggggcccactctttcaggccatggagtgagcacagaggaccagcataactcagccgcggcctctgaggactgaaagatgaacttgctgaggtgggtcgggttgctggcataccacctacccaccgtttgttttagacagaaaatggggcggatgaagagaagctgacttccctgggcgcacagcagtgacaagccctggaagttacat

SEQ ID NO: 59243 - DNA, 601 bp, Human
ctgaaagatgaacttgctgaggtgggtcgggttgctggcataccacctacccaccgtttgttttagacagaaaatggggcggatgaagagaagctgacttccctgggcgcacagcagtgacaagccctggaagttacatatctcctccacctgtccccccatcttgctttggcagtgcctcaagggtcagttggtcagagcagctttggatctgggattagcctttctcatttgctggggtgaagacacgttctgcacataccaaatacctccaaagtaggactgtatgtgtcttgtacatttttttttttttttttaacatggggagggattaacaagagatggcattaagaccttggataataaacctagttgcatctgctggtcatggtagagctgctgtggtcccttgcagcccacagtggccctgcctggaaacctcaagcaggatgtgcatcttctgcctgcctactgatctccatcacttggagtaccccaaaggcctctttttcacctcacttgcccagctgtcctagcggcataggatggttgtgtggtagaccagaggcctgttgtgtatatttttgttgggttatagcca

SEQ ID NO: 59244 - DNA, 601 bp, Human
cccgcctcagccttccaaagcactgggattacaggcaaagttgaccagcctctattctagagtttaacatgttccacccagtttggcagtcagcttatactgatcatgggagtgatcttgttttaccaaagaggaagctgtggtgcagacgggcgaagggacttgctgcaagttaccctgggagggcttggcagggtggctctgtccaaaactaggttccctgctatattcccttttttctactcataagagtctggcctattttgcctcctcagatttgaggctaaagtgtgctaaagcwgcgcccttgctgagcagggccaaattgtggagacctataggaatgagtgtgaggtagacaggtcttaatcctggggtttgggggtaaagaggcccatggtagaagatggggccctcttgagggtggtctggaaatggagcagagctgtaggagtaagcagtcccaaggcagtggtgtaggaggcagggcaaggtagaggaagaacccgcaaagacttgctctcactggacgttcaagggatggccgccatgggtctttatgaagggggtggtgcagtgtagccccggacaggcttttttt

SEQ ID NO: 59245 - DNA, 601 bp, Human
aaagtgtgctaaagcagcgcccttgctgagcagggccaaattgtggagacctataggaatgagtgtgaggtagacaggtcttaatcctggggtttgggggtaaagaggcccatggtagaagatggggccctcttgagggtggtctggaaatggagcagagctgtaggagtaagcagtcccaaggcagtggtgtaggaggcagggcaaggtagaggaagaacccgcaaagacttgctctcactggacgttcaagggatggccgccatgggtctttatgaagggggtggtgcagtgtagcccyggacaggcttttttttttttttttttttaaacagagttgcactgtcaccaggctggagtacactggtgccgtctcggctaactgcaacctctgcctgccgggttcaagcgattctcctacctcagcctcccaagtacctgggactacaggtgcccgccaccacgcccagctaatttttctatttttagtagagacgggttttcaccatgttggctgggatgctctcgatctcttgacctcgtgatccgcccgcctcggcctcccaaagtgctgggattacaggcatgagctcccgcaccc

SEQ ID NO: 59246 - DNA, 601 bp, Human
taaagcagcgcccttgctgagcagggccaaattgtggagacctataggaatgagtgtgaggtagacaggtcttaatcctggggtttgggggtaaagaggcccatggtagaagatggggccctcttgagggtggtctggaaatggagcagagctgtaggagtaagcagtcccaaggcagtggtgtaggaggcagggcaaggtagaggaagaacccgcaaagacttgctctcactggacgttcaagggatggccgccatgggtctttatgaagggggtggtgcagtgtagccccggacaggcttttttttttttttttttttaaacagagttgcactgtcaccaggctggagtacactggtgccgtctcggctaactgcaacctctgcctgccgggttcaagcgattctcctacctcagcctcccaagtacctgggactacaggtgcccgccaccacgcccagctaatttttctatttttagtagagacgggttttcaccatgttggctgggatgctctcgatctcttgacctcgtgatccgcccgcctcggcctcccaaagtgctgggattacaggcatgagctcccgcacccagctggaca

SEQ ID NO: 59247 - DNA, 601 bp, Human
catggtagaagatggggccctcttgagggtggtctggaaatggagcagagctgtaggagtaagcagtcccaaggcagtggtgtaggaggcagggcaaggtagaggaagaacccgcaaagacttgctctcactggacgttcaagggatggccgccatgggtctttatgaagggggtggtgcagtgtagccccggacaggcttttttttttttttttttttaaacagagttgcactgtcaccaggctggagtacactggtgccgtctcggctaactgcaacctctgcctgccgggttcaagcrattctcctacctcagcctcccaagtacctgggactacaggtgcccgccaccacgcccagctaatttttctatttttagtagagacgggttttcaccatgttggctgggatgctctcgatctcttgacctcgtgatccgcccgcctcggcctcccaaagtgctgggattacaggcatgagctcccgcacccagctggacaagcctcttgctgtcttaattctttaaaggacctgctgaagatggagatgtgggagtccagtttggtgtcctggtgtgcgtctgagagcagctgctgaattg

SEQ ID NO: 59248 - DNA, 601 bp, Human
gggaggagcttgtaatatctgaccaaggttctccatgccaaaaggtttttatacagccttaagaaaaatttaagcctccattgaagaacctaataggcctttgggaggccaaggcaggcggatcacctgaggtcaagagtttgagaccatcctgaccaatgtggtgaaaccccgtctctactaaaaataaaaattagccaggcgtggtagcaggcgcctgtagtcccagctactggggaggctgagacagaagaattgcttgaaccccggaggcagaggttgcagtgagtctgagatcacrccactgcactccagcctgggcaacagagtgagactgtctcaaaaaaaaaaaaaagcacctaataggccttatgggagcttgttctctaccagtcactgtgctcaaggtttaagtaaagtgtctcctttagtaccgcagcacaaaccacctggaggataggtgggtcctgtgtccctcctgaggaggaacggtgtcaggattcaagctcctgtctgactgctctgggcgctagtcccaacccaacaagactgaggttgagtgtcccatttctggtgtacagccgctttgggcatctctgcg

SEQ ID NO: 59249 - DNA, 601 bp, Human
aaaaagcacctaataggccttatgggagcttgttctctaccagtcactgtgctcaaggtttaagtaaagtgtctcctttagtaccgcagcacaaaccacctggaggataggtgggtcctgtgtccctcctgaggaggaacggtgtcaggattcaagctcctgtctgactgctctgggcgctagtcccaacccaacaagactgaggttgagtgtcccatttctggtgtacagccgctttgggcatctctgcgcttaggagtgtgtgccttattcttaaaaagcaagataacagaggcccggygcggtggctcacacctgtaatcccagcactttcggaggccgaggcgggcggatcatgaggtcaagagatcgagaccatcctggctaacatggtgaaaccccatgtctactaaaaatacgaaaaaattagccgggcgtggtggcgggcgcctgtagtcccagttactgtagaggctgaggcaggagaatagcatgaacccgggaggcggagcttgcagtgagctgagatcacgccactgcactccagcctgggcgacagagtgagactccgtctttaaaaaaaaaaaaaaaaaaaaaaagg

SEQ ID NO: 59250 - DNA, 601 bp, Human
aaaagcaagataacagaggcccggcgcggtggctcacacctgtaatcccagcactttcggaggccgaggcgggcggatcatgaggtcaagagatcgagaccatcctggctaacatggtgaaaccccatgtctactaaaaatacgaaaaaattagccgggcgtggtggcgggcgcctgtagtcccagttactgtagaggctgaggcaggagaatagcatgaacccgggaggcggagcttgcagtgagctgagatcacgccactgcactccagcctgggcgacagagtgagactccgtctttaaaaaaaaaaaaaaaaaaaaaaaggccgggcgcggtggctcatgcctgtaatcccagcactttgggaggccgaggcgggcggatcaggaggtcaggagtttgagaccagcctggccagcatggtgaaaccccatctctactaaaaatacaaaacattagccaggtgtggtggcgtgtgcctgtagtcccagctactcgggaggctgagacaggagaattgcttgaacctgggaggcggagctagcagtgagcccagatggcaccactgcactccaacctaggcaacagagaaagactccgt

SEQ ID NO: 59251 - DNA, 601 bp, Human
acagcagggctgtgctcttggcccccagcagagcatggttgtatagtatcagctgaggattggttccaggatgaaccccaatacccaagtccacagatgctcacccttactataaaatggtgtaatatcggggccaggggccgggtgcggtggctcaaccctgtaatcccagcactttgggaggccaaggcaggtggattacgaggtcaggagattgagaccatcctcgctaacacggtgaaaccccgtctctactaaaaatacaaaaaaattagccaggcgtggtggcgggcccctgtartcccagctactctggaggctgaggcaggagaatggagtgaacccggaaggcagagcttgcagtgaaccgagattgcgccactgcactccagcctgggcgacagagcgagagactccatctcagaaaaaaaaaatatcggggccagcacagtggcacacacctgtaatcccagcactttgggaggccaagatgggtggttcacttcactccaggagttcagccagagcaacatggcaaaaccgggtctcttcagaaattatctgggcgtggtggcttgcacctgtagtcccaactattcag

SEQ ID NO: 59252 - DNA, 601 bp, Human
aattatctgggcgtggtggcttgcacctgtagtcccaactattcaggaggtcaaagctgcagtgagctgttaccactgcactccagcctgggtgacagaatgatgccctgtctccaaaaaaaaaaaaaagtataatatttgcatatatcctatgtagatgttttacttttgagacagagtctcactctgtcacccagtctggagtgcagtggcatgatcttggctaactgcaacctctgcctcccaggttcaagtgattctcctgccctgcctcagcctcccaggtagctggggttacagsgggtgtgccaccacacctggctaattttcttgtaatttcagtagagatggggtttcaccatgttggccaggctggtctcaaactcctgacctcaggtgattctcccgcctcagcctcccaaagtggtgggattacaggcgtgagccactgcgcccggcctgatcccatatattttaaatcatctgtagattacttatagattaatacaggccagacatggcacatacttatagtcccagctacttaggaggctgaggcaagaggattgcttaagcccaggagttcgaggctgcagtgagc

SEQ ID NO: 59253 - DNA, 601 bp, Human
gctaattttcttgtaatttcagtagagatggggtttcaccatgttggccaggctggtctcaaactcctgacctcaggtgattctcccgcctcagcctcccaaagtggtgggattacaggcgtgagccactgcgcccggcctgatcccatatattttaaatcatctgtagattacttatagattaatacaggccagacatggcacatacttatagtcccagctacttaggaggctgaggcaagaggattgcttaagcccaggagttcgaggctgcagtgagctatgatcacaccacagcacyccagcctgggtgacagaatgaggccctttttttgtgttttaagaaaaaagaaaaagcactaatacggtgtaaataattgttacactgttttgaattgtagtttttttcccctaaatatttttgatccacccttggttgagtctgtggatatgaagggctggctgtatctggacctgatctcagggcaggagtgggctgggaacaagcggtgtgtaagaactgtttctgggcagaagcagcccaccccacacagactactgcctggcacttggcagttatggaagaacccccaattccccc

SEQ ID NO: 59254 - DNA, 601 bp, Human
actagaggaaagaaatcactagagcagactcagaccaacttgctgatctctgggtcccaggaacaaaccagactctgctctgagctccagagctaggcaggaccatgtgatggctgaaatctgggtgcttcctgcatgtgggccccggtgccatcacagtggcaggacagggcagttcctccagagctgtgtgacacggagccagtgagtaccctctggcacctcagtttcactctttaaaggagagtagcacttgacacacctgttgagtcctcagagtaacccggccctcaggtgaagmagggtggagagatcgaaaagcatttggcacagggcctggcagatgtgtgctccagttaatagaagcgtgcaagcgtttctggggaggctggtgtgtcgactggattttacggagctttttttgcaggcaaggaggctggctggggtggaccagggacttgcccaagccagccttccctgtgtctgcagaggggctggtacacattccaagcagggggcacccactgcacagagtgtctgccctgcccttgttatcctgagctctccagactgaggtggcccggagagtggcaataggtcc

SEQ ID NO: 59255 - DNA, 601 bp, Human
tcccttcttataaaacagtgagaattagctgtttacacacaaggaattgtttacctgagaccttgatcaagacccttaaatctccctctcacactacccccagcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatgggtaagcagggtagrgggggctgcattgatggagtagccttgaggcccggtcatcaattccccaacgaatggtcctgcatagtctgcccagcccctcaggcccctcctatcagaggcaggcaggaggggattctgcagaaaagcaaacagcacggggcctcaccccgacctctctggctgactagcccaggctccaggagggtaatttagcgactatctgctttcattagcctgctcgttaacttttcccaattgatttttcggggcttttgatctaaatgcttgcacaaacaacaccccgtcagctcccagggg

SEQ ID NO: 59256 - DNA, 601 bp, Human
tttttgagacagagtcttgctctgtcgcccaggctggagtgcagtggtgcaatgtcagctcactgcaacctctgccacctgggttcaagcaattctcctatctcagcttcccgagtagctgggactacaggcacacaccaccacacctggctagtttttatatttttagtagagacagggtttcaccatattggtcaggctggtctcgaactcttgacctcaggtgatccacctgcctcggccttccagagtgctgggattaaaggtgtgagccactgtgcctggccactcccttgagacycagtttccacgtctgtgaaatgggggaatacccacagtgagaattagatgagatagatgcatttgaaaccacaaatcggggtgcccacctgtggtgggtagttaggtagctgttacaaagtgccccagcagagacccccttgactaacttttattcttccatcttttcccacaggtggcagctgccaacaagaagcattagaacaaaccatgctgggttaataaattgcctcattcgtaatcctggtctgggtctcttttttgagtctcttgctctgtcgcccaggctggagtgcagtgg

SEQ ID NO: 59257 - DNA, 601 bp, Human
agccttttctttttttgagacaaggtctcactctgtcacccaggctggagtgagtgcagtggtgtgatcatggctcactgcagcctcaacctcctgggctcaagcaatccccccacctccacctcctaagtagctgggaccacaggcacgtgctactacgcctggctaatttttaatttttttttttttttttgagacggagtcttgctctgtcacccaagctggagtgcagtggcacgatctcggctcactgcaacctccacttcccaggttcaagtgattctcctgcctcagcctcccraatagctgggactactggcgtgcgccaccatacccagttaatttttgtatttttagtagagatggggtttcaccatgttgaccaggctggtcttgaactcctgacctaaggtgatctgcccgcctcggcctcccaaagtgctgggattacaggcataagccactgcgcctggctgcgcctggctaatttttaaatctttgtagagatggggttttgccatgttttccaggctggtcttgaactcctggactcaagcgatcttcctgcctcagcctcccaaagtgcaggatgacaagcgtg

SEQ ID NO: 59258 - DNA, 601 bp, Human
aatccccccacctccacctcctaagtagctgggaccacaggcacgtgctactacgcctggctaatttttaatttttttttttttttttgagacggagtcttgctctgtcacccaagctggagtgcagtggcacgatctcggctcactgcaacctccacttcccaggttcaagtgattctcctgcctcagcctcccgaatagctgggactactggcgtgcgccaccatacccagttaatttttgtatttttagtagagatggggtttcaccatgttgaccaggctggtcttgaactcctgayctaaggtgatctgcccgcctcggcctcccaaagtgctgggattacaggcataagccactgcgcctggctgcgcctggctaatttttaaatctttgtagagatggggttttgccatgttttccaggctggtcttgaactcctggactcaagcgatcttcctgcctcagcctcccaaagtgcaggatgacaagcgtgagccaccttgcctggccatattattaaattatcatgagtttaagtttaagtagccacaagtgggctgggtgcggtggctcatgcctgtaatcccagcattttgag

SEQ ID NO: 59259 - DNA, 601 bp, Human
taatttttaatttttttttttttttttgagacggagtcttgctctgtcacccaagctggagtgcagtggcacgatctcggctcactgcaacctccacttcccaggttcaagtgattctcctgcctcagcctcccgaatagctgggactactggcgtgcgccaccatacccagttaatttttgtatttttagtagagatggggtttcaccatgttgaccaggctggtcttgaactcctgacctaaggtgatctgcccgcctcggcctcccaaagtgctgggattacaggcataagccactgygcctggctgcgcctggctaatttttaaatctttgtagagatggggttttgccatgttttccaggctggtcttgaactcctggactcaagcgatcttcctgcctcagcctcccaaagtgcaggatgacaagcgtgagccaccttgcctggccatattattaaattatcatgagtttaagtttaagtagccacaagtgggctgggtgcggtggctcatgcctgtaatcccagcattttgagaggccaaggtgggcgggttgcctgaggccaggagttcaagaccagcctggccaacatggtg

SEQ ID NO: 59260 - DNA, 601 bp, Human
ggcatgatcttggctcaccacaacctcctcttcctgggttcaagcgattctcctgcctcagcctcccgagtagctgggattacaggcatgcaccaccatgcctggctaattttgtatttttagtagagacagggtttctccatgttgatcaggctggtcttgaactcccgacctcaggcgacccacccacctcggcctcccagagtgctgggattacaggtgtgagccaccatgcctggctaagatgatgcagttttatccaggtggagatgaagaaatagtcagggaaaggttgagaggstgcatattgtagacagattggattactgggttcactggggaagattggattagaaggaggagtggggctgctttacttgtccccgacttcttgcccctgctctgcccactccttcattgaataccctgctgccctgcagatgtgtttgcctgattttcacctcccttcctgtctctgttatcatagcagacgttttagtgctcagggaaaggaggaggaaggaaactcagattgtcaaggaattgtgagtcagtttctcagccactaccccaggcctgggcttggctaagtcatttcacc

SEQ ID NO: 59261 - DNA, 601 bp, Human
tacctgcctaatctgcacgcctttcccttctcacgagatattctgggaagggggactcaactctttgctctgtttgagggcagagtgcctttgagctcaggagagagtgggtttgggtggccttagctaccctagatacggaggacttggagttaactggcaccatccacaaagccttgcatgcactggacctgaacaagttgcttagcccttgaggcggcgcctcagctaccacctgtctttgatggagttatgataacagtgcctgccccgtctggatgccttatgggttcagtgagcrcataggtgtaaataaagtgctttgagtggcacctcagcatgtagttattctctgattgacctatagcagccatgccagtcttcagggtcccagggcgccaggctttcttctcttgccttggagccttggtttttccctaggactgaagtgttctgaccccttggctgaactcccccttctttaggaagctttccctggtgtgccatctgatgctggtgcttcctggaggggtactatctgatcctagctggtgaggcattcctgccagagctgcggcaggtgctttccccgcctctccac

SEQ ID NO: 59262 - DNA, 601 bp, Human
tgccagtcttcagggtcccagggcgccaggctttcttctcttgccttggagccttggtttttccctaggactgaagtgttctgaccccttggctgaactcccccttctttaggaagctttccctggtgtgccatctgatgctggtgcttcctggaggggtactatctgatcctagctggtgaggcattcctgccagagctgcggcaggtgctttccccgcctctccaccagcctgtgaggtggatgccatccccacgagggcacgcaggttcacagagactggctcctgtccaaggccgcrtggctggaaagagacagaaccagattcaaacaccagcagtttaaccctagagaccctcatcctacctcctatgtgggtaaccactatacatcctgcctcctctgaaatctcccgtttttttttattttaaaattttatgtgagtatttacttatttatttgctgctgttgttattgttttgagacagagtcttgctctgttttcacccaggctggagtgcagtggtgcgatcttggctcactgcaacctctgcctcctcggctcaagcgattctcgtgcctcagtctcccgagtagctgg

SEQ ID NO: 59263 - DNA, 601 bp, Human
caggctggagtgcaatggtgccatcttggctcactgcaacatccgcctcccaggttcaagccattctcctgcctcagcctcccaagtagctgggattacaggcacctaccatcatgcacggctgttttttgtatttttagtagagacagggtttcactatgttggccaggctggtcttgaactcctgacctcaggtgatctgcctgcctcggactcccaaagtgctgggattacaggcatgagccaccacgcccagccttcctggctaatttaaaaatttttcagagacgggggttttgcytaggctggactcactatgttgcctaggctgatctcgaaccactggccttaagtgatcctcccacctcagcctcccaaagtactgggattacaggcatgagccgctgcacatcgccacagtttgattttagtatccactttaaggtgcagttagttcttcccagctcctcttttccctatctcatacagtgtagtcacttccctttctcccacttctcaccttcctagattttgtttttctctctcttaccaagttttgagtatgtaatacgtcccagatcggtgctgaacccctggtgtg

SEQ ID NO: 59264 - DNA, 601 bp, Human
cactttgtcccccaggctggagtgcagtggcacagtctcagctcactacagcctcatccttccaggttcaagcagtcctcctgcctcagcctcccaagtagctgggaccacaggcatgtgtcaccatgcctttctaatgtttgtatttttttgtggagacagggtttctcactgttgcccaggctggtctcaaactcctgagctcatgtgatcctcctgccttggccttccaaagtgctaggattacaggcgtaagccactgcccagcatccagcatccccacctttttttttttttttttaaatttgtggtttggtgcaggttattttacctccccaggcctcggtttcctcatctactcaagggcaatggcagataatcaacctcacaaattccccgaggagttagtaggcttgtgcctgccaggctcagctggcttacagcaggtgcttcataagggggagctattgcaacgcctcggctggttctaggctgcctagctccagagctaagagtcccagtgggttcatatccctttgagcatttataggcttctcacaggtctcctgggctttctcagccattcctcatccgacctgag

SEQ ID NO: 59265 - DNA, 601 bp, Human
gacaaggatccagtcaagccagtgtcaacaaagagggaagttattgactccaatgaccatacatccagagggtcctgttttggggcacagctagatccagggggctcttccaggcaggaagtagagggaaggcggaaggccagacatggcacatcccagctatcccacacccccacctttatagagctttctgggtagtcccacctagtgacatctgcatacatttcctgggccactcctagctgcaggggagactgagaaatgtattaataatactttagtcccggcagttgctgcctgygggagattgagacctctgttaacagaggaggggaatagtatactgggaaggcaaccaggagcctctgccagtagccccgagtcctgatcctcagggggctggttgcaggctcttacccacgctaacctggacagtcctgccaggccctcagtactcagcaccgcccactcacttggcactggaatgtgcattaacttttaattggctccccacttagaagaaagcacacattcatcagtttcccccacagcaatgggaaagccaggcctgggaacacatggaggagggcaccgccgagcc

SEQ ID NO: 59266 - DNA, 601 bp, Human
ctgagaaatgtattaataatactttagtcccggcagttgctgcctgcgggagattgagacctctgttaacagaggaggggaatagtatactgggaaggcaaccaggagcctctgccagtagccccgagtcctgatcctcagggggctggttgcaggctcttacccacgctaacctggacagtcctgccaggccctcagtactcagcaccgcccactcacttggcactggaatgtgcattaacttttaattggctccccacttagaagaaagcacacattcatcagtttcccccacagcaaygggaaagccaggcctgggaacacatggaggagggcaccgccgagccgcgaggagctctggccccggggtgtccctcagggtgctggccaggctgcctttgttccgctttacacatggccctgtgtgatctcatgtccatctgtatgccagggctgcccagagccccagccagactgcttgtcagagccctgcttggcttctcgccctggatgtcccacagcaaactaatcctgtctgaacttgacctcgacatcttcctcccaggcgtgctcctttgcctcacctagtccgtttctcagt

SEQ ID NO: 59267 - DNA, 601 bp, Human
ggggctggttgcaggctcttacccacgctaacctggacagtcctgccaggccctcagtactcagcaccgcccactcacttggcactggaatgtgcattaacttttaattggctccccacttagaagaaagcacacattcatcagtttcccccacagcaatgggaaagccaggcctgggaacacatggaggagggcaccgccgagccgcgaggagctctggccccggggtgtccctcagggtgctggccaggctgcctttgttccgctttacacatggccctgtgtgatctcatgtccatcygtatgccagggctgcccagagccccagccagactgcttgtcagagccctgcttggcttctcgccctggatgtcccacagcaaactaatcctgtctgaacttgacctcgacatcttcctcccaggcgtgctcctttgcctcacctagtccgtttctcagtgaagagcaccaccatccacctgcttgcccacaccagaaacctcatctcatccctgtctcctccctcccccttgctatccctttctcccctctcattccctctgtctgtagatatttcttttttttttttttttttactttt

SEQ ID NO: 59268 - DNA, 601 bp, Human
ctatcattccctctgcctggaaccctccacccaccccatctttgcgcactggtcctcaccgatgcccttccgtggtggaacaggtgcttcctttgggcttctatcacagcaactcgatccctctggcagttctaagcagtctggcagcgtcttcttaaaggcaggaaccccagcatggcctggcccaggactggccttcaggaggactgtgaattcatggaggtgttggaagctgggcaggatttggatggctctctgtcattgcccagcataaccaattgtgggaccccggtcccctctmcacccccagggccggatctccttctacatgaccaactatggtgaggagggcacgcacgtggggagtgccgccgccctggacaacacggacctggtgtttggccagtaccgggaggcaggtacgtctgtccgtggtttggccctgtggtccccattgaagtgtacactttagtttttctgagtgttcttccaggagcagcatagtgccaggaaggtctaaggagctggaagaagagctttccaagcaagaaagagacaagccagggtcaggactctggagggggcagtcttcccactctga

SEQ ID NO: 59269 - DNA, 601 bp, Human
agcataaccaattgtgggaccccggtcccctctccacccccagggccggatctccttctacatgaccaactatggtgaggagggcacgcacgtggggagtgccgccgccctggacaacacggacctggtgtttggccagtaccgggaggcaggtacgtctgtccgtggtttggccctgtggtccccattgaagtgtacactttagtttttctgagtgttcttccaggagcagcatagtgccaggaaggtctaaggagctggaagaagagctttccaagcaagaaagagacaagccagggtyaggactctggagggggcagtcttcccactctgaaggccagaaagtgtagtggctcagggtctgtgctcttaaccctttgttaccagttgtcaggttttgggcaagtcacttcccttctctgagcctcagttttctaatctccagaagagggattatgacggtacctgcatccaagggtcgctgggaggatgcagtgaagtcaacgttcgctgtgggtgtggcctgtgctggagaccctgtctccctggtgcagtgatcccctggcccctcctcaggtgctgtatccttcggggagcagga

SEQ ID NO: 59270 - DNA, 601 bp, Human
tgatcccctggcccctcctcaggtgctgtatccttcggggagcaggagcaggtggaagaaccttgacagacctgagtgcggtgcaagattagaggggcccggcaagcccagatgagtgaaaggaaggaagggtcaaagaccaggaatgaagaaaatcattgagcaggaatgagtgcctgggagcgaaggagtgagcccagggagcagtgagtggggtcttccagggagcttgttggtgtggggccctgcatggggactaccctcagagtgtcagcgagcactgatagggccaggaaggcayatcttaaccctttgtcttagatgcttggggcaagttgcttaactgccctgtgcctctgtttcctcattcgtaagggggatggtagcccttcccaagacagctgttgagggcagtcttggggcagttggcaaagtgccctcagcacagagtaagcgctcagggccaggggttggtgtcatgatcggggactcgccctgggacagcccttcagcagggccagaccacgtggctgtccagagcccccatggaccagcatggcttgcagcctgctcctggactgtctactgctcacagctggac

SEQ ID NO: 59271 - DNA, 601 bp, Human
aaccctttgtcttagatgcttggggcaagttgcttaactgccctgtgcctctgtttcctcattcgtaagggggatggtagcccttcccaagacagctgttgagggcagtcttggggcagttggcaaagtgccctcagcacagagtaagcgctcagggccaggggttggtgtcatgatcggggactcgccctgggacagcccttcagcagggccagaccacgtggctgtccagagcccccatggaccagcatggcttgcagcctgctcctggactgtctactgctcacagctggaccaggcycttggccccacatgctctaggagggcaaacgccctgtggtgtttgtctaaggtctagtgtcatccgtgcggaaaaagatttccagacaccaggcagcaagctgggcccccgccagctgtgctgagcactgcacctgtttttgctgaagggttctcttgtgagggcaccaggcaggaccgagcaagcctcatgggaatcatgggagccgctgagctctccacatgggagagctggccgcctctgcaagaatgactgtccagcactgagggtcagcagaagtgtctgggcagctgcaaatgg

SEQ ID NO: 59272 - DNA, 601 bp, Human
ctgagctctccacatgggagagctggccgcctctgcaagaatgactgtccagcactgagggtcagcagaagtgtctgggcagctgcaaatgggactcatgcagaggcagcatggtgcagggtaaggagttgagtcacatccactctagacttcacttggcaggccactcaccttggtgacgctgtctgtcgtctgtgaagtgagaagagtggtgttcatcatgataggtagtgcctccctgggctcttgacaccagagtgctgttctttttttcttctccttttttttttttgagatggartctcgctctgttgcccaggctggagtgcagtggcgcgatctcggctcactgcaagctccacctcctgggttcacgccattctcctgcttcagcctcccgagtagctgggactacaggcgcccaccaccatgcctggctaattttttgtatttttagtagaggcggggtttcaccatgttagccaggatggtcttgatctcctgaccttgcgatccgccctcctccacctcctaaagtgctgggattacaggcgtgagccaccatgcctggcctttttttttttttttgaggtggagtctc

SEQ ID NO: 59273 - DNA, 601 bp, Human
tgaggcaggagaggcaagcattaccatcaactctaaaagccaggtaagaacctgagtcaacagaggtgaggtcatgggcccaggccacattctcctaaggagtggagccgagtctttttatggcagtctgacccagagacagctctcgctgtttcccacccttggctgtcttcccagggctatatgtggagtatcagtggtggcactggcagggagtggcgcccggtgaaaaggagtgttaagaggaagcacgtgccaggtgtggtggctcacgcctgtaatcccagcacttcgggaggcygaggcgggaggattgcttgagcccaggagtttgataccagcctgggcaacatggcgagacccccatctctaaaaaattaaaaaattagccaggcgtggtggtgcacacctgtagtcccagctactcaggaagctgagtgggaggattgcttgagcccagaggttcaagactgcagtgagctatgcttccaccaccgaactccagtttgggtgacagagtaagatcctgtctctgagaccaacaagaaaagaggtagcatgtgtcaagcaagagcagcagttcccactggacctggagttt

SEQ ID NO: 59274 - DNA, 601 bp, Human
gtggagtatcagtggtggcactggcagggagtggcgcccggtgaaaaggagtgttaagaggaagcacgtgccaggtgtggtggctcacgcctgtaatcccagcacttcgggaggccgaggcgggaggattgcttgagcccaggagtttgataccagcctgggcaacatggcgagacccccatctctaaaaaattaaaaaattagccaggcgtggtggtgcacacctgtagtcccagctactcaggaagctgagtgggaggattgcttgagcccagaggttcaagactgcagtgagctatgmttccaccaccgaactccagtttgggtgacagagtaagatcctgtctctgagaccaacaagaaaagaggtagcatgtgtcaagcaagagcagcagttcccactggacctggagtttcctggtgcaaatcagcctgtgagtctgtattttcttttttcttcaagacggggtcttactctgtcacccaggttgaagtgcagtggcatgatctcggctcactgcaacctctgcctcttaggatcaagtgatcctcccacctcagccccctgaatagctgggaccacaggtgcacaccaccacac

SEQ ID NO: 59275 - DNA, 601 bp, Human
ggcaaggggcgccagatgcctgtccactacggctgcaaggaacgccacttcgtcactatctcctctccactggccacgcagatccctcagggtgaggatgcatgccctgtaccttgcacatgtgcagaccaatgtcacacccctgtccaggcctcagctcttttgcctgccttctgggtggaattctgggttggtgacaccactagagccctggtctgtgctccagacttcttcttcttatttttttcttttttgagacggagtcttgcactgttgcccaggctagagtgcagtggtgctrtcgcagctcactgcagcctccttctcccagcttcaagcaattctcctgcctcagcctcccgattagctgagactacaggtgtgcaccaccacgcccagctaatttttgtatttttaatagagacagggtttcaccgtgttggccaggctggtctcaaactcccggcctcaggtgatccacccgcctcagcctctcaaagtgctgggattacaggcgtttaagccattgtgcccagcccactttttttttggtctgagacggggtttcactctcgtcagccaggttggagtgcaatggtgc

SEQ ID NO: 59276 - DNA, 601 bp, Human
tcgctaacggtcatgtggcacagagggagaggagcagggactcaagtcattgactgtgtacctccagagcctgggttcttggccctgacctttgtctgcctcagtcctcagagtcaagtaagcttccccaaagcttaccgtaggtgccctgaagtcccttcccttataagagcttttttgggaagcaaacccactgggtgccaggcctgcaccctcatagtgtggagaacaaggaatcggagccccttcctgccctccggggcctgtagcctgatctagggttggtctgggccctggcttytttgccctagggcagctgagatgcatgagtttgtgtctctccaggcctcagcactgtgcccagcacagcaggaggctccacaccccttagctcatagtgttcttttgttgaggaacaagaagcagtttgagcctcttaggtgggaggtgggcagggaagctttctcagaggagggggcatttagggggcatttgagctaaaggtaatagggtttccacaaggctggggcgtggccctaaccttccctctgggtccctgctaagtcacttcaaatacacgaagttcctgccgtgtgccggt

SEQ ID NO: 59277 - DNA, 601 bp, Human
ccctggcttttttgccctagggcagctgagatgcatgagtttgtgtctctccaggcctcagcactgtgcccagcacagcaggaggctccacaccccttagctcatagtgttcttttgttgaggaacaagaagcagtttgagcctcttaggtgggaggtgggcagggaagctttctcagaggagggggcatttagggggcatttgagctaaaggtaatagggtttccacaaggctggggcgtggccctaaccttccctctgggtccctgctaagtcacttcaaatacacgaagttcctgccrtgtgccggtgccactccaagtgcagggaacaaaagcaacgcaaacctcagccctcctggtgctgccattgtggtgggggagacggacagtaacagagatggagagggaactcctggagtatatgagggtgggggtcctgtagggagcagccaagccagccgggtgtggtgcactgtaggggtggctggggtccgtcactggagtgacactgaagtatggaccagaggatgtgagggggggagctgtgtggtgtcttgaggcaggtgtgagcctggcgtgtttgaggagctgggaggagcc

SEQ ID NO: 59278 - DNA, 601 bp, Human
tggccctaaccttccctctgggtccctgctaagtcacttcaaatacacgaagttcctgccgtgtgccggtgccactccaagtgcagggaacaaaagcaacgcaaacctcagccctcctggtgctgccattgtggtgggggagacggacagtaacagagatggagagggaactcctggagtatatgagggtgggggtcctgtagggagcagccaagccagccgggtgtggtgcactgtaggggtggctggggtccgtcactggagtgacactgaagtatggaccagaggatgtgagggggggagctgtgtggtgtcttgaggcaggtgtgagcctggcgtgtttgaggagctgggaggagcccagaggggcaggtgtggagtgagcaggtgtggagtgagcgggtgtagggtgagcaggtgtggggtggttggaggtaaagtccaggaggtggtgggtgggggtgcagatggtgcagggttgggtggggcctcaaggcctttgcctgttgcagggatgtcgacttttactcaaagtgggacaggagccgtgggtggggaggagtctgctcttccttggcctggctcacctcttcatggaatc

SEQ ID NO: 59279 - DNA, 601 bp, Human
cccctaccctccttcctggttctcgtcctgtgtcctgtggcgtctggcacttggtcagccacaggagttgaggtcctgagcactcagccttgctctctgtcctctccctgctcgtccccttggcctcgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagcccttyctcatcgaggccatgacctacaggtgcctgccgctccccccgtcagcacccccacagcactgacagccaccatagcatcttcctcatatcgatcactgtctccaaaacatggtcttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtgg

SEQ ID NO: 59280 - DNA, 601 bp, Human
cttggtcagccacaggagttgaggtcctgagcactcagccttgctctctgtcctctccctgctcgtccccttggcctcgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggtgcctgccgctccccccgtcagcayccccacagcactgacagccaccatagcatcttcctcatatcgatcactgtctccaaaacatggtcttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcg

SEQ ID NO: 59281 - DNA, 601 bp, Human
gtcctgagcactcagccttgctctctgtcctctccctgctcgtccccttggcctcgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggtgcctgccgctccccccgtcagcacccccacagcactgacagccaccrtagcatcttcctcatatcgatcactgtctccaaaacatggtcttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcggcactatctgctgagccaaggct

SEQ ID NO: 59282 - DNA, 601 bp, Human
gtccccttggcctcgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggtgcctgccgctccccccgtcagcacccccacagcactgacagccaccatagcatcttcctcatatcgatcactgtctccaaaacatggycttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcc

SEQ ID NO: 59283 - DNA, 601 bp, Human
gcgtggatggtaatgatgtgtttgccgtatacaacgccacaaaggaggcccgacggcgggctgtggcagagaaccagccctttctcatcgaggccatgacctacaggtgcctgccgctccccccgtcagcacccccacagcactgacagccaccatagcatcttcctcatatcgatcactgtctccaaaacatggtcttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgagggtgccccgcccgggagggtgtgctgggggctgctgcggcctgcagagcttgggaaggatttgtggaacaccgaactgggaggctcaggga

SEQ ID NO: 59284 - DNA, 601 bp, Human
aattagggctgggcgcagtggctcacgcctgtaatcccagcactttgggaggccaaggcggacagatcacctgaggtcgggagtttgagaccagcctggccaacatggtgaaacctcgtctctaataaaaatacaaaaattagccgggcatggtgccgggtgcctgtaatcccagctacttgggaggccgaggcaggagaattgcttgaacctgggaggtagaggttgcagtgagctgagatcgtaccattgcactccagcctgggcaacgagagcaagactccatctcaaaaaaaaaaaattagccaggcgtggtggtgcgtgcctgtagtcccagctactcaggaaggtgaggcagaagaatcgcttgaacccgggaggtggaacttgcagtgattggagatggcgccactgcactccagcctgggcaacagagcaagactatctcttaaaaaaaaaaaaaagctcgtttgaggattaggtggcaaaccgtggtggagtgtacatgccctgcccagagtcagtgtgccaccctccctgacccggtcattaggacccagggcccgtgcagcccagtggtgagggcagcacccggcatagg

SEQ ID NO: 59285 - DNA, 601 bp, Human
aatcccagctacttgggaggccgaggcaggagaattgcttgaacctgggaggtagaggttgcagtgagctgagatcgtaccattgcactccagcctgggcaacgagagcaagactccatctcaaaaaaaaaaaattagccaggcgtggtggtgcgtgcctgtagtcccagctactcaggaaggtgaggcagaagaatcgcttgaacccgggaggtggaacttgcagtgattggagatggcgccactgcactccagcctgggcaacagagcaagactatctcttaaaaaaaaaaaaaagctsgtttgaggattaggtggcaaaccgtggtggagtgtacatgccctgcccagagtcagtgtgccaccctccctgacccggtcattaggacccagggcccgtgcagcccagtggtgagggcagcacccggcatagggcagcaccgtgtgtcctgtccctgcccttctctgtgcctcagtttcctcattgcttagctgtctacctcttagggctgctgaaagccttaaatgattccacacacttggatagcacctgatccctgctgggatttgagggttttcattacacttctgctaggataat

SEQ ID NO: 59286 - DNA, 601 bp, Human
atcgtaccattgcactccagcctgggcaacgagagcaagactccatctcaaaaaaaaaaaattagccaggcgtggtggtgcgtgcctgtagtcccagctactcaggaaggtgaggcagaagaatcgcttgaacccgggaggtggaacttgcagtgattggagatggcgccactgcactccagcctgggcaacagagcaagactatctcttaaaaaaaaaaaaaagctcgtttgaggattaggtggcaaaccgtggtggagtgtacatgccctgcccagagtcagtgtgccaccctccctgrcccggtcattaggacccagggcccgtgcagcccagtggtgagggcagcacccggcatagggcagcaccgtgtgtcctgtccctgcccttctctgtgcctcagtttcctcattgcttagctgtctacctcttagggctgctgaaagccttaaatgattccacacacttggatagcacctgatccctgctgggatttgagggttttcattacacttctgctaggataatcatttccattgtcgaggtgggaacacaaaggcttggagtggttaattccttgccaaggccccgcaggaggaag

SEQ ID NO: 59287 - DNA, 601 bp, Human
aaaagaggccaggcgcagtggctcacgcctgtaatctgagcactttgggagaccgaggcaggtggatcacgaggtcaggagatcgagaccatcctggccaacatggtaaaaccccatctctaccaaaaatacaaaaattagctgggcgtggtggcgcacacctgtaatcccagctacttgggaggctgaggcaggagaatcactggaacccaggaggcggagattgcagtgagctgaggtcataccactgcactccagcttggcaacagagtgagacactgtctcaaaaaaaaaaaaaagmgttctaggattgtatggtttgtgttcttctatccttcagggaccatctaggtggaccttgtaaccagccgacccacagccacccccttggtcacagctcaccctctccagcccatgccctgaccttccttctggctcatgtcctcacctggtacagctccacgtgctgctccacttttaacttgagcctcagcagacgcagctctgcccgggagagcaacacgggttcaggtaccgcttctcggagctctgatgtgttgaagaacatatatatgctgtgtgtactctgcttgaacttgtc

SEQ ID NO: 59288 - DNA, 601 bp, Human
tccgggtgcagtggctcacacctgtaatcccagcactctgggaggctcaggtaggagaatcacttgagggcaggagtttgagacaagcctggccaacatgataaaactctgtctctactaaaaatacaaaaattagcccagcgtgttggcacatgcctgtaatcccagctactcgggtggctgaggcaggagaatcacttgaacccaggaggcggaggttgcagtgagccgagatcaccccattgtactccagcctgggcgacagagcaagactccatctcaaaaaaaaaaaaaaaaaaaagaggccaggcgcagtggctcacgcctgtaatctgagcactttgggagaccgaggcaggtggatcacgaggtcaggagatcgagaccatcctggccaacatggtaaaaccccatctctaccaaaaatacaaaaattagctgggcgtggtggcgcacacctgtaatcccagctacttgggaggctgaggcaggagaatcactggaacccaggaggcggagattgcagtgagctgaggtcataccactgcactccagcttggcaacagagtgagacactgtctcaaaaaaaaaaaaaagagtt

SEQ ID NO: 59289 - DNA, 601 bp, Human
aaaaagtcattttgtgattcaaatgtttgataatatcccaagatttccacttctagagcctgagaagctttagaagactaatgttctataaacccaagagtctgccatgccgcacctagatgctgcaggtacccaacatctgtgtagaataattttctgggccaggcacagtcgctcacgcttgtaatcccagcactttgggaggccgaggagggtggatcaccagaggtcagaagttcgagaccagcctgaccaatatggagaaacaccgtctctactaaaaatacaaaattagctaggygtggtggtgcatgcctgtaatcccagctgctcgggtggctgaggcaggagaatcgcttgaacccaggaagcaaaggttgtggtgagccaagatggtgccattgcactccagcctgggcaacaggagcaaaactccatcacacacacacacaaaaaaaagaagaattttctggggctggatagtccactccagggactgcagaataaagctgaattccccagactccaagaagccaagctaacataggacaaagttctctcactgtgaaagtctgaaatctaccatcctatgagttaacat

SEQ ID NO: 59290 - DNA, 601 bp, Human
cactatgtcccccacaccacccagcacatggccaggcacacagcaggaacctgtgggcaattattgaataaaagcataaatgagagggaggtgagggagagagataggggcaccatgggccctgccagaaaccagacagagacaatcatctcctggacagatcaaatgagttaggctctccctggcctccaggcctttgcacaggctgttccctttgcctggaatcttttttttttttttttttttttgagatgggatctcactctttcatgtaggctggattgcagtagtgtgattatgrctcactgcagcctcgacctcccaggctcaggtgattctcccacctcagtctcccaagcagctggaactacaggcacgtaacagcatgcatggctaatttttgtatttttgtgtagagaccgggtttcgccatgttgcccaggctgctctcaaactcctgagctccagtgatccatcctccttggccttcaaaagtgctgggattataggcataagccaccatgcccagccccagaatactcttacacctctccttttcctgaccattctactcatcccttcaacatcagctatggtgccc

SEQ ID NO: 59291 - DNA, 601 bp, Human
gtgcctccccatcccattcttgatcattctaggtcattcctgcctggtggggccttgacaagatctcttaggtgtccagaagtgactgtgggccccatgagggcagaactgagggctgtcttggttatcactatgtcccccacaccacccagcacatggccaggcacacagcaggaacctgtgggcaattattgaataaaagcataaatgagagggaggtgagggagagagataggggcaccatgggccctgccagaaaccagacagagacaatcatctcctggacagatcaaatgagtttggctctccctggcctccaggcctttgcacaggctgttccctttgcctggaatcttttttttttttttttttttttgagatgggatctcactctttcatgtaggctggattgcagtagtgtgattatggctcactgcagcctcgacctcccaggctcaggtgattctcccacctcagtctcccaagcagctggaactacaggcacgtaacagcatgcatggctaatttttgtatttttgtgtagagaccgggtttcgccatgttgcccaggctgctctcaaactcctgagctccagtgatc

SEQ ID NO: 59292 - DNA, 601 bp, Human
tgggattacaggcttgagccactgcatccggcctacacggctactttttaaattctctgtagagacagaggtctcactatgttgcccaggctgggctcaagcaatcctcctgccctggcctcccgaagtgctgggattacaggcatgagccactgcacccggccagcatcaatctcttgaatgaatgagtgaatgatgttttctaggctcctacaatgtgccgaagcctgtgctgtgtgcttgggactcagcattgaccaagacagatgagctccttctaggcctttgtcgaacagcccakgacactcctcccagtgcccacctgctccctaatccctattttttctttttcttttctttttttttttttgagacggagtttcactgttgttgcccaggctggagtgcaatggcacgatcttggctcactgaaacctccacctcctgggttcaagcaattctcctgcctcagcctcccgagtagctgggattacaggcatgcatcaccacgcccagctaattatgtatttttagtagagacggggtttctccatgttggtcaggctggtctcgaactcccgatctcaggtgatccacccac

SEQ ID NO: 59293 - DNA, 601 bp, Human
ccgcgtccagctggaaagtttcagatgtacacaaaagcagcttcaacaatgaccaactcatggccaatttccattgcatctctacccctatccactatctcttttttttttttttttgagacaggatctcactctgtcacccaggctggagtgcagtggtgcaatcacagctcactgtggcctccagctcctggggctcaagccaacctcccacctcagcctcctgagtagctgggacaaaaggtacacaccaccaggcccagctacttttcatattttttttttttgggagatggggttkcaccatattgcccaggctggtctccaactcttaggctcaagcaatcctcctgccttggcctcccaaagtggtgggattatagctgtgagccactgcagccagccgacaatggtttatctcaaagcacatgcaatccaccgtgttgcttcatccataaatatttcaaatgtatctctaattaagactactttaaaacacagtcacaataccatgtaagaaaattaacaattccttgatatctagaggaatatctagacagagttcacatttacccaactgtctcataaatatctttttttt

SEQ ID NO: 59294 - DNA, 601 bp, Human
tctcctggctcagcctcccaagtagctgggattacaggcacacaccaccatacccagctaatttttctgtatttttagtagagacagggtttcaccatgttggacaggctggtctcgaactcctgacctcatgtgatccacccgcctcagccttccaaagtgctgggattacaggtgtgagccaccgcgtccagctggaaagtttcagatgtacacaaaagcagcttcaacaatgaccaactcatggccaatttccattgcatctctacccctatccactatctcttttttttttttttttgagacaggatctcactctgtcacccaggctggagtgcagtggtgcaatcacagctcactgtggcctccagctcctggggctcaagccaacctcccacctcagcctcctgagtagctgggacaaaaggtacacaccaccaggcccagctacttttcatattttttttttttgggagatggggtttcaccatattgcccaggctggtctccaactcttaggctcaagcaatcctcctgccttggcctcccaaagtggtgggattatagctgtgagccactgcagccagccgacaatggttta

SEQ ID NO: 59295 - DNA, 601 bp, Human
gccaaggggccatcatgggcaggcttagggagggccatgagtgcctgagatcatatgcacatgtgtgtatgtatgcatgtatttctgggaaaaagagtcctggctttcactttctcacaggaagttctgaactcacaaaaggggaagaactagtgtccggaatctttttttttttttgagatggagtttccctcctgttgcccaggctggagtgcgatggtgtgatctcagctcactgcaacctccgtctcccgggttcaagcaattctcctgcctcagcctctcaagtacctgggattayaggcatgtgccaccatgcctggctaattttttgtatttttagtagaggctgggtttcaccatgttggtcaggctggtctcaaactcctgacctcaggtgacccacccacctcggcctcccaaagtgctgggattacaggcatgagccaccgcacccggctcagaatcatctttaatatgcagttcaaccctagctggggttctgagatcctaggatttgaacaatctgtgatactgttatccaagtcagcagctctccacgtgagctcccaggaccagcggcagcatcacctgggaacta

SEQ ID NO: 59296 - DNA, 601 bp, Human
gaaggaagtcaagaaactgagatccctgtgaactcagcccgtaccacccaatttggttggacctcagtttcctcatctgttcagaggtaggagctactagataaaataaggtgttaagctgagggccaaggggccatcatgggcaggcttagggagggccatgagtgcctgagatcatatgcacatgtgtgtatgtatgcatgtatttctgggaaaaagagtcctggctttcactttctcacaggaagttctgaactcacaaaaggggaagaactagtgtccggaatctttttttttttttgagatggagtttccctcctgttgcccaggctggagtgcgatggtgtgatctcagctcactgcaacctccgtctcccgggttcaagcaattctcctgcctcagcctctcaagtacctgggattacaggcatgtgccaccatgcctggctaattttttgtatttttagtagaggctgggtttcaccatgttggtcaggctggtctcaaactcctgacctcaggtgacccacccacctcggcctcccaaagtgctgggattacaggcatgagccaccgcacccggctcagaatcatctttaat

SEQ ID NO: 59297 - DNA, 601 bp, Human
gctggtctcgaactcctgaccttgtgatccgcccacctcagcctcccaaagtgctggtattacagacctgagccactgcatctggcctatttattctttttaatttgttattctttttagagacacggtctcactatgttgctgaggctggtgtcgaacttgggctcaaacgatccgcacgcctcggcctcccaaagcattgggattactggcatgagccaccacacctggccccttcacttcatttaaaccttagctcaaatgtccttcactcagggacccttaactcctaaagcagtgyctggaatgcagtaggtactagtaaatatcagttacatgactgaacatcacctcctcagagatacctttctgagccatcctttccaaaatatccaagtgactgttagttccatttagtgcaatacggtattgcagttatgcaagaaaatataaaaatgtctgcatttgaaatggggcaaaatcttaattaccgatgacgctggatgagagtttacgggcattcattatcttcattgcttttgtatacatttgaaattttccataataaaggaatttaaatcagaataggaaaaataacagt

SEQ ID NO: 59298 - DNA, 601 bp, Human
caccccatccctctctttctccccatcctgccaactcacctctctgactttacttctctttctctctcctcttcctccgtcctggctccccccaagcgcatctcgtagcccggtgggccagacgtaccttgctgtactgcgtgtccaggctccaaatgtaggggcagggcccgaggcagaagttggcatggtagcccttgggctcgtggatccacttccagccgaggtccttgcggaagtcaatgtacagctgccgcacgcagcagttcttctccgtggagctgcaggcaggagagacgcrtcaggggcagggaggggctaccaccatagaagccacatgcccctcctccccaggtgcgtgtgtcaccctaggttgcccccccagccctatctccatctgggtctcccttgcacccactgtgttaataacaacacaaatagtcatgataatcactaacacagattaagcacttcctccagtgctaagagcaatgtaataattaatttcacgcaatgcttaagacaagcctgtaagaagccagatgaccatccacgggggggctaaataaatcatggcatgccacaccctggaacatacaaa

SEQ ID NO: 59299 - DNA, 601 bp, Human
ccgcctcagcctccggagtagctccaaccacaggcaagcgccaccactcctagctttttttttttttttttttttttttttggtagagatgggatctcagtctgctgcctgggctactctcgaactcctgggctcaagcgatcctcctgcttcagcgtcccaaagtgttggtattaccatcgtgagccgccgcgcccgcctgattttctttctcagtctctgtccctcctcatcttcgcctcttgccttgttgtgtatctgtctttgtctctccttggcctaactctgtgtctgtatctgkctctctcattttgtctctccatttctgcgtttttccttccatctccctgtctctcttctccccttcacccccatccctctgttacttcactctgtgggtcttcatagctcatctccctctggcccctgctcagagcccctctctagcttcctgcctctctccccatctctttattcattcccctccccaccccatccctctctttctccccatcctgccaactcacctctctgactttacttctctttctctctcctcttcctccgtcctggctccccccaagcgcatctcgtagcccgg

SEQ ID NO: 59300 - DNA, 601 bp, Human
cgttttcctcttctgcaaaatgagttaataataggacatacttcgtggttgtcatgagcttccagactggacaccctctttccgttctgacagaccccctcccagtgtccagctctgaccctgaacctctctgtctctcctcttgccctgtcagaatcacctccctgcagctttccgacacgggacagtaccagtgtttggtgtttctgggacatcagaccttcgtgtcccagcctggctatgttgggctggagggtgagctctggggtcaggggtcctgaggggtcagaggacatgtggygctcataggttgtgggaagtcaggaatcctgaggggtcaaggtcaaagggtgctggaggattcaggatgaacctagcgtcatacagcctaagaatgtcagagttttgggtggtcaagaagctgggagtccatataagttatggtgccaaggctgggggattatatgttctgggtgaaaagacttcttgggggtagttggatgtcctaggcatcagacaccatcaggtcacaggaggccattctggtcttcagataaggcgtcagaggcacgcaacgtacccctgtccccacgaccccagc

SEQ ID NO: 59301 - DNA, 601 bp, Human
ctccctccattcaccccggcctctctctgaatagaattctttgtcctgggtttcctctgagctgttccatggctcgagtgcgtgtgggcctggtgcccctttgtcagcccttgacccaagcagggcaccggaatcaaccgtgccctcctctcctccgcctccctccacaaccggcccacctcctgccctaacaagcctgctggcctcagtcaaagggaggatgtccagcccggtccccactggggagatggaacccaaagaagagagagcaggaagaaagtaggagacagaggctgggcgyggtggctcacgcctgtaatcccagcactttgggaggctgaggcgggcggatcacgaggtcaggagatcaagaccatcctggctaacacggtgaaaccccatctctactaaaaatacaaaaaattagccgggcgtggtggcgggcgcctgtagtcccagctactcgggaggctgaggcaggagaatggcaggaacccgagaggcggagcttgcagtgagccgagatcgcgccactgcactccagcctgggcgacagggcgagactccatctcaaaagaaaaaaaaaaaaaaagaaagtggg

SEQ ID NO: 59302 - DNA, 601 bp, Human
agcccggtccccactggggagatggaacccaaagaagagagagcaggaagaaagtaggagacagaggctgggcgtggtggctcacgcctgtaatcccagcactttgggaggctgaggcgggcggatcacgaggtcaggagatcaagaccatcctggctaacacggtgaaaccccatctctactaaaaatacaaaaaattagccgggcgtggtggcgggcgcctgtagtcccagctactcgggaggctgaggcaggagaatggcaggaacccgagaggcggagcttgcagtgagccgagatygcgccactgcactccagcctgggcgacagggcgagactccatctcaaaagaaaaaaaaaaaaaaagaaagtgggagacagagagagatagaatgacatacactggaagggacaggccacagtgacccaagatgaacatagacaggacagagaggccgggcatggtggctcacgcctgtaatcccagcactttgggaggctgaggcaggtggatcacttgaggctgggagttcgagaccagcctggccaacatgacaaaactccatctttaccaaaaatacaaaaattagccaggcgtggt

SEQ ID NO: 59303 - DNA, 601 bp, Human
ggctgggcgtggtggctcacgcctgtaatcccagcactttgggaggctgaggcgggcggatcacgaggtcaggagatcaagaccatcctggctaacacggtgaaaccccatctctactaaaaatacaaaaaattagccgggcgtggtggcgggcgcctgtagtcccagctactcgggaggctgaggcaggagaatggcaggaacccgagaggcggagcttgcagtgagccgagatcgcgccactgcactccagcctgggcgacagggcgagactccatctcaaaagaaaaaaaaaaaaaaagaaagtgggagacagagagagatagaatgacatacactggaagggacaggccacagtgacccaagatgaacatagacaggacagagaggccgggcatggtggctcacgcctgtaatcccagcactttgggaggctgaggcaggtggatcacttgaggctgggagttcgagaccagcctggccaacatgacaaaactccatctttaccaaaaatacaaaaattagccaggcgtggtgacgggcatctgtagtcccagctacttgggaggctgaggcaggagaatcgcttgaacccgggaga

SEQ ID NO: 59304 - DNA, 601 bp, Human
actttgggaggctgaggcgggcggatcacgaggtcaggagatcaagaccatcctggctaacacggtgaaaccccatctctactaaaaatacaaaaaattagccgggcgtggtggcgggcgcctgtagtcccagctactcgggaggctgaggcaggagaatggcaggaacccgagaggcggagcttgcagtgagccgagatcgcgccactgcactccagcctgggcgacagggcgagactccatctcaaaagaaaaaaaaaaaaaaagaaagtgggagacagagagagatagaatgacatamactggaagggacaggccacagtgacccaagatgaacatagacaggacagagaggccgggcatggtggctcacgcctgtaatcccagcactttgggaggctgaggcaggtggatcacttgaggctgggagttcgagaccagcctggccaacatgacaaaactccatctttaccaaaaatacaaaaattagccaggcgtggtgacgggcatctgtagtcccagctacttgggaggctgaggcaggagaatcgcttgaacccgggagatggaggttgcagtgagccgagatcacaccactgca

SEQ ID NO: 59305 - DNA, 601 bp, Human
gaaaaacaaaacaaaatgaaagacaggacagggaagttggagtgacagaaaccctctccttcttggggaccattcccttctgcaccatgcagacgaggaaggaccgagctcagggttatgcagtggtcaggggcatcactgggggaccctggattcagggggttctccctactgaaggaggaaagacagaggagcagatggcagaggctctgtaaaggaaggaggctgcagcctggagggcatcagcttcccgcactcccaacctgctgcctctctctgctggaatgaggaggggccttcygactgggggtctccagggtggagggaggagctcacattctcagcattcctgggaccctgagttgcaaggaagacctggtgagcatgctgaccccagaggagtgactcaggcccatggctcgagtggctgagtagggaccagggttggggatcgggcatgagtcagcctggcaggtcccatgagaaggggaggggagggagagaaatgggggctgcacaggtgtgaggatctgtgcatgtctgtgtggtggtggtggggtgtctggatatctgtgtgttctggatctgagtgttagtgtat

SEQ ID NO: 59306 - DNA, 601 bp, Human
tctgtaaaggaaggaggctgcagcctggagggcatcagcttcccgcactcccaacctgctgcctctctctgctggaatgaggaggggccttctgactgggggtctccagggtggagggaggagctcacattctcagcattcctgggaccctgagttgcaaggaagacctggtgagcatgctgaccccagaggagtgactcaggcccatggctcgagtggctgagtagggaccagggttggggatcgggcatgagtcagcctggcaggtcccatgagaaggggaggggagggagagaaatgsgggctgcacaggtgtgaggatctgtgcatgtctgtgtggtggtggtggggtgtctggatatctgtgtgttctggatctgagtgttagtgtatccgtcagcacaacctctgtgtgagggtgtgccttggcgagggtggacttctgtggatgtcccatgtgtggtgtgtgtgtgtgtgtgtgtgactaaatatatttccttcagcttggattctgtcccaatatgtgtttggatctttatagcatgtctctctctctacgtttcttaggggttgcccgtgtgtgggtgtctgtgtgtgtgcg

SEQ ID NO: 59307 - DNA, 601 bp, Human
cggtcggaacgggacccggctccagaacccacctccagccccagggcttctccggccggcggcgccagctcccgcgcgctgaccctggcggggccccacgtgccaggtggctggacccgacccaggctccccgcccccactcgggccgcccgcccgggactgtactgtttctcctccgggcggcgcgggggctgcgggcgcggggccttcagggcgcggaggctgcgggagcgggcacctgaccttgtctgggaacggccacctaggaagccgcgactgaggagctcccctaccctccccyttccggcctctgcagactttgcaccattccactccctccgctgacggagaaaaggaaactttgtgtctgcggatggagagcctcccttgccaacgcggtgggaacagaggcgtacacgcacggagcaaacacgagagacacgtacacagatactcaacacatgcacgtacacaccatccacagatacacgcagggtcacaaacataccagctcagaaacacaaacacagatgcacaagcacacgcgtaaacaacacgcagaactgcagtcgcacttacaagacttggtcccagggccggg

SEQ ID NO: 59308 - DNA, 601 bp, Human
ggggctgcgggcgcggggccttcagggcgcggaggctgcgggagcgggcacctgaccttgtctgggaacggccacctaggaagccgcgactgaggagctcccctaccctcccctttccggcctctgcagactttgcaccattccactccctccgctgacggagaaaaggaaactttgtgtctgcggatggagagcctcccttgccaacgcggtgggaacagaggcgtacacgcacggagcaaacacgagagacacgtacacagatactcaacacatgcacgtacacaccatccacagatasacgcagggtcacaaacataccagctcagaaacacaaacacagatgcacaagcacacgcgtaaacaacacgcagaactgcagtcgcacttacaagacttggtcccagggccgggcaccgagtggctctgcctgcgatccagcactttgggaggccgaggcgggaggatcgcttggggccagaagtttgagagcagcctgggcaacgtggtgagactctcctcttctctacaaaaaaaaattgaaaagttagccaagtgtggtggccgcctgtagtcccagctgcttgggaggatgagacag

SEQ ID NO: 59309 - DNA, 601 bp, Human
cggcctctgcagactttgcaccattccactccctccgctgacggagaaaaggaaactttgtgtctgcggatggagagcctcccttgccaacgcggtgggaacagaggcgtacacgcacggagcaaacacgagagacacgtacacagatactcaacacatgcacgtacacaccatccacagatacacgcagggtcacaaacataccagctcagaaacacaaacacagatgcacaagcacacgcgtaaacaacacgcagaactgcagtcgcacttacaagacttggtcccagggccgggcacsgagtggctctgcctgcgatccagcactttgggaggccgaggcgggaggatcgcttggggccagaagtttgagagcagcctgggcaacgtggtgagactctcctcttctctacaaaaaaaaattgaaaagttagccaagtgtggtggccgcctgtagtcccagctgcttgggaggatgagacaggaggatcgcttgagccctggaggtcaaggcagcagtgagccgtgattgtgccactgtactgcagcctgggagatagagcaagaacctgtctcaaaaaacaaaacgaaaaacttggtc

SEQ ID NO: 59310 - DNA, 601 bp, Human
aaaattgaaaagttagccaagtgtggtggccgcctgtagtcccagctgcttgggaggatgagacaggaggatcgcttgagccctggaggtcaaggcagcagtgagccgtgattgtgccactgtactgcagcctgggagatagagcaagaacctgtctcaaaaaacaaaacgaaaaacttggtccttcttacatcctagcgcagacattgtgtgtgtgtgctgggggaggggggtgtctatgtttctacgtgtatctgtgttgggggattccccttattcaccaggatacgttctctaagascccccacaaaagcctgaaacaatgaataatactaaaccctgtatatactacacataactttctttttccttcacaatttcgcagatagattgttttcttactatagatcttagcaacctcagtacatatatatatgattatctttttctaagtggagaattttcaccttttcacttaaaaggaagcactttaaggcttctctttggcctatccgaattgcagccatcactattttgcaccctggggcctttttttttttttttagacagagtctctctctgtcgcccaggctggagtgca

SEQ ID NO: 59311 - DNA, 601 bp, Human
gttgatctgatagctaagtgacttacagacaggtatcagatacagcactgagatgctggacaaaggggggattcacgttctaggccaaccagagtgggatggcatgaggtttcatcacagtactcagaacggcatgcaatttaaaacttaggagttatatctggaattttccattgaaatatttttagaccaagtgtaactgaaacctcaaaaagtgaaacctcggataaagggggactgatgtacgttgtatagcggtttgtgttgggtatctctgtgtgcttgcaggtctgtgtctctygtgtttgtctctgtaattgtacgtgcttctgtgtgtgcacgctggtcataccaacaccaacaccaccacgttagggagggaaggcaatccaccttcactcgaaaacagttactcaaggccgggcacggtggctcacacctgtgatcccagcactttgggaggctgagatgggcagatcacttgaggtcaggagttcgagaccagcctggccaacatggtgaaaccctatctctactaaaaattacaaaaattagccgggcatggtggcgcgctcctgtaatcccagctactcagaaggct

SEQ ID NO: 59312 - DNA, 601 bp, Human
gctcacacctgtgatcccagcactttgggaggctgagatgggcagatcacttgaggtcaggagttcgagaccagcctggccaacatggtgaaaccctatctctactaaaaattacaaaaattagccgggcatggtggcgcgctcctgtaatcccagctactcagaaggctgaggcaggagaatggcttgaacccaggaggcagaggttgcagtgagccaagatcatgccactgcactttagcctgggcaacagagcaagactctcaaaaaacaaaagaaaaaaacagtcaagacacaatasgtgaactcccctatggaattacacatgctcatatttctacacctatgcccaggaatgctcataagtacacagctgaacacaatttcactcactcattcaacaagcatttatggcacacctattgtgtgccaggccatcctgacacagcaggggacgaaacagacacaacccctgctctcctagagctgacattctagtgggagaaactgacaatgggcaaggtacttgggtaacaggtaaagtatgttgggtgatgagaagaaccaaagaggaaaagtaaagcgggaaggggatagattt

SEQ ID NO: 59313 - DNA, 601 bp, Human
ctcacacctgtgatcccagcactttgggaggctgagatgggcagatcacttgaggtcaggagttcgagaccagcctggccaacatggtgaaaccctatctctactaaaaattacaaaaattagccgggcatggtggcgcgctcctgtaatcccagctactcagaaggctgaggcaggagaatggcttgaacccaggaggcagaggttgcagtgagccaagatcatgccactgcactttagcctgggcaacagagcaagactctcaaaaaacaaaagaaaaaaacagtcaagacacaatagrtgaactcccctatggaattacacatgctcatatttctacacctatgcccaggaatgctcataagtacacagctgaacacaatttcactcactcattcaacaagcatttatggcacacctattgtgtgccaggccatcctgacacagcaggggacgaaacagacacaacccctgctctcctagagctgacattctagtgggagaaactgacaatgggcaaggtacttgggtaacaggtaaagtatgttgggtgatgagaagaaccaaagaggaaaagtaaagcgggaaggggatagatttg

SEQ ID NO: 59314 - DNA, 601 bp, Human
ccagcctggccaacatggtgaaaccctatctctactaaaaattacaaaaattagccgggcatggtggcgcgctcctgtaatcccagctactcagaaggctgaggcaggagaatggcttgaacccaggaggcagaggttgcagtgagccaagatcatgccactgcactttagcctgggcaacagagcaagactctcaaaaaacaaaagaaaaaaacagtcaagacacaataggtgaactcccctatggaattacacatgctcatatttctacacctatgcccaggaatgctcataagtacayagctgaacacaatttcactcactcattcaacaagcatttatggcacacctattgtgtgccaggccatcctgacacagcaggggacgaaacagacacaacccctgctctcctagagctgacattctagtgggagaaactgacaatgggcaaggtacttgggtaacaggtaaagtatgttgggtgatgagaagaaccaaagaggaaaagtaaagcgggaaggggatagatttggagaggaagctccaattagctccaattttattgtattttttctttctttctttttcttttcttttcttt

SEQ ID NO: 59315 - DNA, 601 bp, Human
ggagaatggcttgaacccaggaggcagaggttgcagtgagccaagatcatgccactgcactttagcctgggcaacagagcaagactctcaaaaaacaaaagaaaaaaacagtcaagacacaataggtgaactcccctatggaattacacatgctcatatttctacacctatgcccaggaatgctcataagtacacagctgaacacaatttcactcactcattcaacaagcatttatggcacacctattgtgtgccaggccatcctgacacagcaggggacgaaacagacacaacccctgcyctcctagagctgacattctagtgggagaaactgacaatgggcaaggtacttgggtaacaggtaaagtatgttgggtgatgagaagaaccaaagaggaaaagtaaagcgggaaggggatagatttggagaggaagctccaattagctccaattttattgtattttttctttctttctttttcttttcttttctttctttttttttttgagacagagtttcactcttgttgcccaggctggagtgcaatggcgtgatctcagctcactgcagcctctgcctcccgggttcaagcgattctcc

SEQ ID NO: 59316 - DNA, 601 bp, Human
aacagacacaacccctgctctcctagagctgacattctagtgggagaaactgacaatgggcaaggtacttgggtaacaggtaaagtatgttgggtgatgagaagaaccaaagaggaaaagtaaagcgggaaggggatagatttggagaggaagctccaattagctccaattttattgtattttttctttctttctttttcttttcttttctttctttttttttttgagacagagtttcactcttgttgcccaggctggagtgcaatggcgtgatctcagctcactgcagcctctgcctccygggttcaagcgattctcctgcctcagcctcctgagtagctgggattaaaggggcctgccactatgcccagctaattttttgtatttttagtagagacgaggtttcactatgttggccaggctggtctcgaacttcggacctcaggtgatccacccacctcggcctcccaaggctgggattacgggcatgaaccaccgtgcccagcctttatttttcattttattatttttagtttttttgagacagggtctcactctgtcacccaggttggagtgcagtggtgtgatcacagctcactgc

SEQ ID NO: 59317 - DNA, 601 bp, Human
attttattgtattttttctttctttctttttcttttcttttctttctttttttttttgagacagagtttcactcttgttgcccaggctggagtgcaatggcgtgatctcagctcactgcagcctctgcctcccgggttcaagcgattctcctgcctcagcctcctgagtagctgggattaaaggggcctgccactatgcccagctaattttttgtatttttagtagagacgaggtttcactatgttggccaggctggtctcgaacttcggacctcaggtgatccacccacctcggcctccyaaggctgggattacgggcatgaaccaccgtgcccagcctttatttttcattttattatttttagtttttttgagacagggtctcactctgtcacccaggttggagtgcagtggtgtgatcacagctcactgcagcctccacctccccgggcacaggtagtcctcccacctcagcctcccaagtagctgggactacaggtgtgcaccaccacacccagctaatttttctcttttttgtagagatggggtctcaccacgttgcccaggctggtctctaactcctggcctcaagcgatcctcc

SEQ ID NO: 59318 - DNA, 601 bp, Human
aattggccaggcgcggtggctcacacctgtaatcccagcactttgggaggccgaggtgggcggatcacttgaggtcaggagttcgagaccagcctggccaacatagtgaaaccacatttctactaaaaatacaaaaattaactgggcctggtgggacgcacttgtagtcccagctactggggaggctgaggcaggagaattgcttgaacctgggaggcggaggttgcagtgagccaagatcgtgccactgctctccagcctgggtgacagagcgagactctgtctcaaaaaaaaaaagaamcaaaaaaaaaaaaaatttaacaaaatgaaaatgatcagctgttttaattattttcagtattagtgatgttaactctagccagagtgggagccctgagacagcagagtctggagccatttctgtcaccactggatacccagaaccctccacttctcccatcccagccctggccactctgtgtggtcactgtctggggatgggtctgtcccctactggaatgtgagctctgacagggcagggctggagctgtcccagtcaccactggctcctcattcttgcccagcacaggaccagacatag

SEQ ID NO: 59319 - DNA, 601 bp, Human
ggccaggcgcggtggctcacacctgtaatcccagcactttgggaggccgaggtgggcggatcacttgaggtcaggagttcgagaccagcctggccaacatagtgaaaccacatttctactaaaaatacaaaaattaactgggcctggtgggacgcacttgtagtcccagctactggggaggctgaggcaggagaattgcttgaacctgggaggcggaggttgcagtgagccaagatcgtgccactgctctccagcctgggtgacagagcgagactctgtctcaaaaaaaaaaagaaacaamaaaaaaaaaaatttaacaaaatgaaaatgatcagctgttttaattattttcagtattagtgatgttaactctagccagagtgggagccctgagacagcagagtctggagccatttctgtcaccactggatacccagaaccctccacttctcccatcccagccctggccactctgtgtggtcactgtctggggatgggtctgtcccctactggaatgtgagctctgacagggcagggctggagctgtcccagtcaccactggctcctcattcttgcccagcacaggaccagacatagagta

SEQ ID NO: 59320 - DNA, 601 bp, Human
caggcgcggtggctcacacctgtaatcccagcactttgggaggccgaggtgggcggatcacttgaggtcaggagttcgagaccagcctggccaacatagtgaaaccacatttctactaaaaatacaaaaattaactgggcctggtgggacgcacttgtagtcccagctactggggaggctgaggcaggagaattgcttgaacctgggaggcggaggttgcagtgagccaagatcgtgccactgctctccagcctgggtgacagagcgagactctgtctcaaaaaaaaaaagaaacaaaaamaaaaaaaatttaacaaaatgaaaatgatcagctgttttaattattttcagtattagtgatgttaactctagccagagtgggagccctgagacagcagagtctggagccatttctgtcaccactggatacccagaaccctccacttctcccatcccagccctggccactctgtgtggtcactgtctggggatgggtctgtcccctactggaatgtgagctctgacagggcagggctggagctgtcccagtcaccactggctcctcattcttgcccagcacaggaccagacatagagtaggg

SEQ ID NO: 59321 - DNA, 601 bp, Human
ggtgggacgcacttgtagtcccagctactggggaggctgaggcaggagaattgcttgaacctgggaggcggaggttgcagtgagccaagatcgtgccactgctctccagcctgggtgacagagcgagactctgtctcaaaaaaaaaaagaaacaaaaaaaaaaaaaatttaacaaaatgaaaatgatcagctgttttaattattttcagtattagtgatgttaactctagccagagtgggagccctgagacagcagagtctggagccatttctgtcaccactggatacccagaaccctccrcttctcccatcccagccctggccactctgtgtggtcactgtctggggatgggtctgtcccctactggaatgtgagctctgacagggcagggctggagctgtcccagtcaccactggctcctcattcttgcccagcacaggaccagacatagagtagggaatattcgctagaaggatatattacaacccagatgagctagacccagcctctgccctcaagttgctcctagaataagaaaaccaaaaccaggccaggtgtggtggcttacacctgtaaccccagcactttgggaggccaagg

SEQ ID NO: 59322 - DNA, 601 bp, Human
gcgtgatcacggcttattgcaacctccgcctcctaggttcaagcaattctcttgcctcagcctcctgagtagctggtattacaggcgcccaccaccacgcccagctaatttttgtatttttagtagagacagggtttcaccatgttggtcaggctggtctcgaactcttgacctcaagtgacccgcccacctcggcctcccaaagtgctgggattacaggcgtgagccaccgcgctgggccctgagaaaatgtttagagtcagtgcttgattaaacaggaattgtcttatacttacatgcyctgagcacaaccccatctgcttgtcgttttaaacctagaaaatagtggctattggctgggcatgatagctcacgcctgtaatcccagcacttcggggggctgaggcaggtctgtacaaaaaattcaaaaaaattagctcagtgtggtggcacacacctgtagtcccagatactcgggaggctgaagtgggacaatcacctgagcctggcagtcaaggctacagtgaggcaggattgaacctctgctctccagcttgggtgacagagtaagactctgtctgagaaaaaaaaaaacaaaaaa

SEQ ID NO: 59323 - DNA, 601 bp, Human
actcagagaagttaagacactcactctaggtcacacagcaaacaacatccaacacaggacttagatccaaggaatctggctttagagcccacaccctgtggcagtaaactccttcctgacatactgtgtggctgtatggctggagtctccagggtgaaggggaagcccttggctgcaccattcctgaggcgtggctgtgaattgtgtggttatgggggttttgtggttccatgtggcagggctatacagatgtgtacaccagtggtggccccctccactctgagtgtgccattcctcgggyggaataggtatgggaacctgtgccgctatgcagagcttgacacttgttgccaggaaacacacataaaataataagtgacaggccgggcacggtggctcgtgcctgtgatcccagcactttgggaggctgagcgggcagatcacctgaggtagggagtttgagaccagcctgaccaacatggagtaaccctgtctctactaaaaatacagaattagccgggtgtggtggtgcatgcctgtaatcctagctactcaggaggttgaggcaagagaatcacttgaacctgggaggcggaggttg

SEQ ID NO: 59324 - DNA, 601 bp, Human
actgcctctgtgcacagacaagaggtattgttaccattactgatattcttaccgccagtagagcaaagactctggggacaggatggggtttaggtcccagcttcatcagtgacaaactgatgaccttgaacaagtgattccgtctctctgggcctcagtgttgtcatctgtacagtgggaataagcataatgcttaccacaggacaacaggattgatgtgagggccaaatgaattcagatttgtcaagggctaagaaaggcactcagtacatgttggacgtgttttatctttttttattawgataatatataacatagtcaggtgaggtggctcacgcctgtaatcccagcactttgggaggccgaggcaggtggattacctgaggtcaggagtttgagaccagcctgggcaacatggtgaaaccctttctctacacagaataaaaaaaaagccgggtgtggtagctcacacctgtaatcccagcactttgggaggccgaggggggcggatcacttgagatcaggagttcaagaccagcctgaccaacatgatgaaacctcgtctctactaaaaatacaaaaaagttagccaggcatggtg

SEQ ID NO: 59325 - DNA, 601 bp, Human
ggcggatcacttgagatcaggagttcaagaccagcctgaccaacatgatgaaacctcgtctctactaaaaatacaaaaaagttagccaggcatggtggcacatgactgtagccccagctactcgagaggctgaagcagaagaattacttgagcccaggaggcggaggttgcagtgagccgagattgtaccactgcactccaacctgagtgacagagcaagactctgtctaaaaaaaaaaaaaaaaaaaaattagtcaagcatggttgctcacgcctgtaatcccatctacttgggaggccraggcatgagaattgcctgaacctgggaggcggagattgcagtgagccgaaatcacgccactgcactccagctcaggtgatgaaatgagactcataggccgggcacggtggctcacacctgtaatcccagcactttgagaggctgaggcgggcggattgcctgaggtcaagagtttgagaccagcctgactaacatggtgaaacgctgtctctactgaaaatacggcaattagtcgggcgtggtggtacgcgtagtcccagctacttgggaggctgaggcagaagaattgcttgaacctag

SEQ ID NO: 59326 - DNA, 601 bp, Human
atcctgtaaggcacttgatcctctaaggccccgtgtgcccaaggaaaaaactgaggctcagagagggaagagtcttgccagaggtggcttttggaagtggtgacagaaccacattgtatacagccaaatgatctccttgctttgcaaatccaggtgcccgtgttatcctagcatggcactgcaacacacacgcacccttgaaaagttgtgtagtcacaccagaccaccaccactgggagctgtgtgaccatctcgtgtgattgcttggctgtcccgtcctcacacccttgcctctcctcargctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggaggtaagaagggttggggagggacacgtcaccactgccccaccggaccttgcttatatcagtgccacccccattgtcccctttcactcctt

SEQ ID NO: 59327 - DNA, 601 bp, Human
ggattggagtggagtggcttggggaggagggaggagaacatatcagggcagacatagatggttgtgaaggttgggtagtacacaattgctctatgcctagggggcacattcagggaaggttcacattcacattctggggagaataagggggtctaagggagggcatggggaatggctgtttttgaaccactgcaaaagcatttcagcagactcatatttactatataacgattttacagcagatagttatatagcaccttggggaaggggtaccttttcctgattttcacaaaggcactcytatcagggctagcaataccctgacatagggagggaggatggaaagggaagctagaaggggatggagggatacaggttaaaggatgaggatgagagatgaaggggaggacgaggaaggatgaggagttggaggatggggagagcgttttgagaaagagatggggcattgagcccgagagtgaaggcttaacagctggggggtaaggttctaccctgatgccacttctggacctcctaggtgctaatggacatagggctaaggcaagaggtgaccctggagctgcagggggacgggtctgtg

SEQ ID NO: 59328 - DNA, 601 bp, Human
cagggggacgggtctgtgtccaatctgacagtgtgtgtggcagcctacactgctgctggggatggaccctggagcctcccagtacccctggaggcctggcgcccaggtaagtccaaagccatgcccaacctgcttcaaccctgtctctccctgacagccctgacttactccttgtacctttcagtgttaccgcaacttaggccctgttcctaccctgagccttactgagagctgccctcactcccttacccatgccaacccctcactcccttacctgtgccacggcctcactcctttaccygtgccacaccctcactcccttacccgtgccacaccctcactcccttacccgtgccaaaccttcactcccttactcgtgccacaccctcactcccttacccgtgccacacccttactcccttacccgtgccacgccagtcttgtcctctctgagcacatctcctctctgtcctttcttctcacagggcaagcacagccagtccaccagctgggtaagggcttccacaccccatctcctccttccctaccctcaacacctagtgggggcactgtcaccatgcatactcattgcacatccctt

SEQ ID NO: 59329 - DNA, 601 bp, Human
acaaaagatgactgggtggtgagtggatatatggatgggtagatgggtggatggatggatggatggatggatgaatggatggttggataaatggatggatggacagatggatggatttgtgagtggatgaatggatgggtagaaaggtggatggatggatgaatgaggtatcctcctcacatccatccctctcaaatatttctctaacaattctcaaacattcctcctacacccattgtcccctctgggcactattatggttcactcttgtaactcaacccactagccttcaatactcctyacatcccttcctacatttcttcacatacgctttccacgcttattccaccctcctttcacatatatcccattataatccgttcctcccacatgaccccaaaggcccattgcacaacacacttctcattcacaaactctgcacaccttgtatgcacttaccataccttccacattgcaaacactgaaaaacattgtccacaactttcccacacccgattctccttgcatgcttactgcacactccatagacatcattccctcacccttcactaatcccaacccatctcactctgcacactca

SEQ ID NO: 59330 - DNA, 601 bp, Human
ggccgggtgcaatggctcacgcctgtaatcccagtactttgggaggcctgagacaggtggatcacctgaggtcaggagttcaagaccagcctggccaacattggcgaaaacccatctctactaaaaatacaaaaattagctgggcctggtggtgcgagcctgtaatcccagctgctcgggaggctgaggcacaagaattgcttgaacctgggaggcggaggttacagtgagccaagatcatgccactatactccagcctgggcaacacagcaagactctgtctcaaaaaaaaaaaaaaaaagaaagaaagaaagaaaaaaagaaagaaaagaaaaagaaaagaaaaaaaaattagccaggtggcacagacctgcagtcccagctactcaggagacatggtgaaaccctgtctctaccaaaaaaagaatacaaaaattagctgggcatggtggtgcacacctgtaatcccagctacttagaagctgaggcaggagatttgcttgaaactgggaggcagaggttgcaatgagctgagaccgggccactgcactccagcctgggtgaaagagtgagaccctgtctcaaaaaacaaacaaacaaa

SEQ ID NO: 59331 - DNA, 601 bp, Human
gcacagagggcaggcagggcttgaggctgagatggtgcttgctcaactgctggttgagtagggggttccacatggtttttccctgccctcacctactccccctcccccccagagaagtgtttgaaccaacagtggaaagaggtgaactggtagtcaggtaccgcgtgcgcaagtcctacagtcgtcggaccactgaagctacctgtaagtgaaccctatgccccactgccctggcctggatctaaaggctgtagagaatctggcctgctgggcttctgtacatgtgtgagccaaaagtttytaaaggccttgggatactagaatgtcagaaccacagaccctagaaataacagatttgtggaaccacaaagaactttcaaggaatagaatcttagacacagtaaatcttagaaacaccaaggctgggtgtggtggctcatgcctgtaatcctagcgcttcggggggccgaggtgggaggatcacttgagcccaggagttcgagaacagcctgggcagcatggtgaaaccctgtctctacaaaaaaaaaaaattagccaggtatggtggtgtgcccctgtactccctgctactcgggaggct

SEQ ID NO: 59332 - DNA, 601 bp, Human
acagcatccattctcagggtgtgagcctggtcccctgtggtccctgagacctttgcagggggcccataaggtcaaatctattttcatactattaccaagacattatttgcccttttgctttctcattctctcattagcattcagcgcagttttccagaggctccctgacgtgggatgatgtcatccaacactctgacagctgatggaccttgtgcttgtatattcttgttttaaaaatttatcaggctgggcatagtggcacatgcctgtaatcccaccactttgggaggccaaggtgggmaaattgcttgaggtcaggagtttgagaccagcctgaccaacatggtgaaaccccatttctactaaaatacaaaaattagctgggtgtggtggtgcatgcctgtaatcctagctacttgggaggctgaggaaagagaatcgcttgaacccgggaggcggatgttgcagcaagctgaggttgtaccactggacttcagcctgggcaacagagtgagactgtctcaaaaaaaaaaaaaattaaataaacctgataggttttcttttgaggccaggagtttgaaaccagtgtgggcaacatggc

SEQ ID NO: 59333 - DNA, 601 bp, Human
gagtgagactgtctcaaaaaaaaaaaaaattaaataaacctgataggttttcttttgaggccaggagtttgaaaccagtgtgggcaacatggcaaaaccccatctctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttmtttttttagagatggggtctggctatgttgcccaggctgatctccaactccaggcctcaactggtcctccttccttggcctcccaagttgctgggattacaagcgtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaacaactaaattaaaa

SEQ ID NO: 59334 - DNA, 601 bp, Human
accccatctctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttctttttttagagatggggtctggctatgttgcccaggctgatctccaactccaggcctcaactggtcctccttccttggcctcccaagttgctgggattacaagcgtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaacaactaaattaaaactatttcatagacatcatgttgagtgaaagaagccagacacaaaagagaatatactatgtgattccatttttataatatttcaaaactaatcgatt

SEQ ID NO: 59335 - DNA, 601 bp, Human
cccatctctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttctttttttagagatggggtctggctatgttgcccaggctgatctccaactccaggcctcaactggtcctccttccttggcctcccaagttgctgggatkacaagcgtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaacaactaaattaaaactatttcatagacatcatgttgagtgaaagaagccagacacaaaagagaatatactatgtgattccatttttataatatttcaaaactaatcgattgt

SEQ ID NO: 59336 - DNA, 601 bp, Human
ccatctctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttctttttttagagatggggtctggctatgttgcccaggctgatctccaactccaggcctcaactggtcctccttccttggcctcccaagttgctgggattacaagcgtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaacaactaaattaaaactatttcatagacatcatgttgagtgaaagaagccagacacaaaagagaatatactatgtgattccatttttataatatttcaaaactaatcgattgta

SEQ ID NO: 59337 - DNA, 601 bp, Human
atctctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttctttttttagagatggggtctggctatgttgcccaggctgatctccaactccaggcctcaactggtcctccttccttggcctcccaagttgctgggattacmagcgtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaacaactaaattaaaactatttcatagacatcatgttgagtgaaagaagccagacacaaaagagaatatactatgtgattccatttttataatatttcaaaactaatcgattgtaac

SEQ ID NO: 59338 - DNA, 601 bp, Human
ctctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttctttttttagagatggggtctggctatgttgcccaggctgatctccaactccaggcctcaactggtcctccttccttggcctcccaagttgctgggattacaascgtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaacaactaaattaaaactatttcatagacatcatgttgagtgaaagaagccagacacaaaagagaatatactatgtgattccatttttataatatttcaaaactaatcgattgtaacag

SEQ ID NO: 59339 - DNA, 601 bp, Human
tctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttctttttttagagatggggtctggctatgttgcccaggctgatctccaactccaggcctcaactggtcctccttccttggcctcccaagttgctgggattacaagygtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaacaactaaattaaaactatttcatagacatcatgttgagtgaaagaagccagacacaaaagagaatatactatgtgattccatttttataatatttcaaaactaatcgattgtaacaga

SEQ ID NO: 59340 - DNA, 601 bp, Human
agaggcggaggttgcggtgagccgagattgcgccatcgcactccagcctgggcaacaggaacgaaactccatctcaaaaaaaaaaagaaaagaaaatccactgagttgcttacttatgatttgtgcagattatacttcaataaaaagaaatatttttgtgtgtgtgttttgtttgagatggggtcttgctctgtcacccaggctggggtgcagtggcatgagctcagcttactgcagcctccacccctgggctcaagtgatcctccaacctcagcctcctgagtagctgggactataggcrcgtaccaccacacatggctagcttttgtatttttttgtagagacggggattcgccatgttgcccaggctggttttgaattcctggactcaagtgatccaccggcctctgcctcccaaagtgctgcgattacaggcatgagccactgcgtccagcaaaaagaaatatttttattttattttattttattttattttattttatttttgagacggagtcttgccctgtcacccaggctggagtgaagtggtgcgatctcagctcattgcaacctctgtctcttgggttcaagtgattttcct

SEQ ID NO: 59341 - DNA, 601 bp, Human
aatatttttgtgtgtgtgttttgtttgagatggggtcttgctctgtcacccaggctggggtgcagtggcatgagctcagcttactgcagcctccacccctgggctcaagtgatcctccaacctcagcctcctgagtagctgggactataggcacgtaccaccacacatggctagcttttgtatttttttgtagagacggggattcgccatgttgcccaggctggttttgaattcctggactcaagtgatccaccggcctctgcctcccaaagtgctgcgattacaggcatgagccactgcrtccagcaaaaagaaatatttttattttattttattttattttattttattttatttttgagacggagtcttgccctgtcacccaggctggagtgaagtggtgcgatctcagctcattgcaacctctgtctcttgggttcaagtgattttcctgcctcagcctccccagtagctgggactacaggcatgtgccaccacacacggctaatttttgtatttttttgtagagacagagattcgccatgttgcccaggctggtcttgaactcctggactcaagtgatccacctgcctctgcctcc

SEQ ID NO: 59342 - DNA, 601 bp, Human
tcttgggttcaagtgattttcctgcctcagcctccccagtagctgggactacaggcatgtgccaccacacacggctaatttttgtatttttttgtagagacagagattcgccatgttgcccaggctggtcttgaactcctggactcaagtgatccacctgcctctgcctcccagagtgctgggattacaggcgtaagccactgtgcccagcaaaagaaatatttttaacaactggtacagcagggcactgacccatcagggtgcccactggagcaagagcgtggccaggctttaccccttkagttccctttgagggaaggttcagggggtccagaggaggagctggggtggaagtagaggggtgctcagggcagttgctaattttaaatcagtgcagaagtatgtcagtgtttcaacaatggatctatccctactggtgggtgaatgtcacctgaatgtcagccctgctccatgactctgtccaccccaaccttgcatgcagtgaacagcctgggcatcagtgaagagctgaaggagaagctgcgggatgtgatggtggaccggcacaaggtggccctggggaagactctgggagagggtg

SEQ ID NO: 59343 - DNA, 601 bp, Human
aaaccagagatgagcagcagcaggaagtcacttcccccgctaggcctgaagggtagagggagcaagtggtgttaccagaatccacagctagggacaccaggcaggagctggtatcacagagttagaggctgctctgtgggagctaaaaacccagaatagcactttgggaggccgaggcagcagatcgcttgagtccaggagtttgagaccagcctaggcaatatggtgaaaccacatgtctatgaaaaaaaaaataataatagtaacaaaaaattagctgggcatggtggcacacgcctgkagtcccagctacttgggacactgaggtgggagaatcacttgagtctgtgcggcagaggttgcagtcagctatgatcatgccactgcactccaatctgggtgacagagtgagactttgtcttaaaaaaataaaacacacatggctgggcgtggtggctcacgtctgtaatcccagcactttgggaggccaaggcgggtggatcacatgaggtcaggagttcgagactggcctgatctgcatagcgaaaccccacctctactaaaaatacaaaaattagccaggcgtggtggcaggcacctg

SEQ ID NO: 59344 - DNA, 601 bp, Human
agttagaggctgctctgtgggagctaaaaacccagaatagcactttgggaggccgaggcagcagatcgcttgagtccaggagtttgagaccagcctaggcaatatggtgaaaccacatgtctatgaaaaaaaaaataataatagtaacaaaaaattagctgggcatggtggcacacgcctggagtcccagctacttgggacactgaggtgggagaatcacttgagtctgtgcggcagaggttgcagtcagctatgatcatgccactgcactccaatctgggtgacagagtgagactttgtyttaaaaaaataaaacacacatggctgggcgtggtggctcacgtctgtaatcccagcactttgggaggccaaggcgggtggatcacatgaggtcaggagttcgagactggcctgatctgcatagcgaaaccccacctctactaaaaatacaaaaattagccaggcgtggtggcaggcacctgtaatcccagctactcgggaggctgaggcaggagaatcgcttgaacctcacaggcggagattgcagtgagccgagatcgtgccactgccctccagcctgggcgacagagcaagactccgt

SEQ ID NO: 59345 - DNA, 601 bp, Human
agagggtgaaataccctggcttctccctttctccccgctacctgccagtctcccataagggcctacctcccattggcaaatcccaagaggaaaccactaggaaagggagcctgggaaatgtagttttcaggggccggcccactgtgatacatagtggagcaggagaagctctagaatgaggcatacctggctgaatcatttaccagctatgcgatctcaggcaaatgactttccctctctgagcctcccacctgtcatctggaaaaaaggaccctaatgtccccaccttccaaagctgttktgaggcaaagcacttcatgctgagggtggcaagtaggacatgcttgttaatgtggagtaggactatattatttccattatcagagagggcaggagccatttcagggttacacagcacaggaagtccagggctaagttcttcacacacagggaaggagaagcatagggcattcagattggggctggtggtgaatagagaatgatcctttctgaattacagggcttaaaagcttgggctatgaagtcattacccactcattcgttcattatggagcacctcctgtgtaccaggttattttgt

SEQ ID NO: 59346 - DNA, 601 bp, Human
gggcattcagattggggctggtggtgaatagagaatgatcctttctgaattacagggcttaaaagcttgggctatgaagtcattacccactcattcgttcattatggagcacctcctgtgtaccaggttattttgtttgttttgctctgttttgttttgttttgaggaggagtctcactctgctgtccaggctggagtgcagtggcatgacctcagctaactactacctctgcctcccaggttcaagcgattcttctgcctcagcctcctgagtaactgggactacaggtgtgcgccaccrcgcccagctaatttttgtgtttttagtagagacggggtttcaccatgttggccaggatggtctctatctcttgacctcatgatccacctgcctcggcatcccaaagtgctgggattacaggtgtgagccaccacacccagcctacgttttttgttttttgagacagagtcttgctcgttgcccatgctggagagcagtggcaggatcacagctcactgtagtctcaacctctgaggctcaagcgatcctccccactcagcctcccactggttatagtcttggcctgggtctgaatctcag

SEQ ID NO: 59347 - DNA, 601 bp, Human
aggaccaggaaagtcagtaagggggtctgggaaggcttcctggaggaggtgagtcctgaactgagatctggaaggagcatttggatgcggagagggaagagaccagaaggtgggctcagtgcacagcatgaggtgagcaaaggggctgaggtgaccgatgggggtggggacacgtgagctgcatctctgtcccactccatgctgggtgtcttgcctggggctgccctttggaagcggccacactggataagaaaatcaaactccccaccaatggacaagcagaaaatatgccagatggggygcagtggctcacgcctgtaatcccagcactttgggagtccgaggcgggtggatcacttgaggccaggagttcgagaccagccttggtgaaaccccctgtctactaaaagtacaaaattcagcctggtgcggtggtgtgcgcctgtaatcccaacacgagaattgcttgaacccaggaggcggaggttgcaatgagccgagatcgcatcactgcactccagcctgggcgacagagcaagactctgtctcaaaaaaaaaaaaaaaaagaaagaaagaaagaaagaaagaaaaaagaaaatag

SEQ ID NO: 59348 - DNA, 601 bp, Human
cgccaagtggtacccactatcctgacttctcagtgctagtttagcctgttctgaaaagtcatacaaatgggatcatgcagtttgtactgctttgtgtctggcttctatggctcagcatgatgtttttgagatggatctgtgtaggggtagtttgctctttttctttgctgtgtggtatggtattccatcatatgaatgtcctgtggattttcttttctttttttctctttctttctttttctttcttttctttctttttctctctgtcctttcttctttcttttctttctctttctctctttttatctccttccttccttccttccctccctccctctctctttccctttctttccctttttttctttcttttcttttttgttttgacagagtcttactctgtcctttagggtggggtgcagtggcatgatcatagctcactgtagcctccaactcctggctcaagctatccttctgcctcagcctcctaagtagctggaactacagacatgtgccaccatgtccagctaatttttaaatttttttgtagagacagggtcttgctttgttttccaggctggtcttgaactcctagcctcaa

SEQ ID NO: 59349 - DNA, 601 bp, Human
atgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtggtaggtgcactcccgccaagagtggggaaccatgggagggcatggcctgaccatcacacactatgcctgggtggctgtggatgcaagggtcacagggacatgtgggcttccctttgcaggggcttgtccacatgggctgggcatgtcttggggyatggtgggcatctctgaatagtggtgtgtacatgcccaggataaatacaggcccacgtgtgcatggtagcaatgtagacagtttaggttagaagaagctgcagtgattatgcgtgcatgtgcgcacactcatagaatgtggacagccagggtgtgcagagtggcacatgagctcatgtgtccatgaagtgtgtatatgtgtgtgatggtgagcatgtgtatgcatccacaaaagttacttattcatgtgtatacccgtgtcaagtattttttatatatatatatttttctttttttgaga

SEQ ID NO: 59350 - DNA, 601 bp, Human
ataggtatcattatgattcccattctgcagataagaaaacccagtcctacagggagggtaatttatttttatttattgacttgagtctcgctctgtcgcccaggctggagcacaatggctccatctcggctcactgcaacctcccaggttctagcgattctcttgcctcagcctcccaagtagctgggactacaggcgtgtgccaccatgcccagctaattttttttgtatttttagtagagatggggtttcaccaccttagccaggatggtcttgatatcgtgacctcatgatccacccktcccagcctcccaaagtgctgggattataggcatgagcctccacgcccagtctgggagggtgatttatttgccaaagattgcacagctggtgtgtttgttatctatatccccaaatcaagtagtttaaaacaacaaacgtttattatctcacacaatttctgaaagttggatactgggaacagcttagcagggtgattttggttcaggatctctaatgaagttacaaagatatcactgggggctgcagtcatctgaaggttgggactggaggattgctttcaaggtggcttactcacatg

SEQ ID NO: 59351 - DNA, 601 bp, Human
tacaggcgtgtgccaccatgcccagctaattttttttgtatttttagtagagatggggtttcaccaccttagccaggatggtcttgatatcgtgacctcatgatccacccgtcccagcctcccaaagtgctgggattataggcatgagcctccacgcccagtctgggagggtgatttatttgccaaagattgcacagctggtgtgtttgttatctatatccccaaatcaagtagtttaaaacaacaaacgtttattatctcacacaatttctgaaagttggatactgggaacagcttagcrgggtgattttggttcaggatctctaatgaagttacaaagatatcactgggggctgcagtcatctgaaggttgggactggaggattgctttcaaggtggcttactcacatggctgtagcaggaggcttcagttcgttgccatgtggacccctttgtggcactgcttgagcttactcacaacatggcaacccaggagaaagtgcgaggaagccacatgccttttatgacctagtctcagaagtcacacacaccatcacttctgccaaatcagaagcaagtcactaagtcctgcccatgctca

SEQ ID NO: 59352 - DNA, 601 bp, Human
gagcccgtcacatttttcaggacagtgggaagcaagtcaggttgtgtgcccatcccgtcctcagagctccatcccttcggcaggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctgggtgagtgttcctgggaggggctggtgctgggggcgaggaggcggctgggaagggcgggggtcctgtccmgggacccgtgggagagaaaatgggggacacccgcagccttgctgccctgtcctgtcttctcacagcaggcgtccaccctaactttccatctgggagggggcccggggcaggcagactctggccagatgcccagccctgggtgttccacaggtcctctcccctctgggcccgggcctcctcctgcctagccggaaagggtctatctaccactgagtcccactctcttcagctctcccttcccccagattcaccatcagaattcatctcctttaggagtttaccttgtcaatagggccccgt

SEQ ID NO: 59353 - DNA, 601 bp, Human
cctttgctgaccctgtcatcctcagctgccctgagccccaacatctctctcctcagacccttgctgggggcactggaggctagctccttcatgctggggtccctcactggcaccctgttttgcaacttggaggtaactggccctcggcaacacacaccactctgggctcccaactcagtacagagaagtgtgatgagcaagcaagggcctgggccacgcccagcagtcctttctgtttgtcagaaatgcagatgacttctcagtttaagatcaagcaattcataaaattaaaataataacmgctcaacttaagcaagcgcttttatgttctagtcacttaccctagcacttgaggtttgtcaatttaattctcataacaaccccagaggaagataagaagataatatcgtcccttatttaccaactgggacaatttactgttgtccaagtgctctgggcaggacagaagggtgtgggtgtgctgcttccaggcttggaacaggaggtagaacaatgaacaatgacagaaagtattaataggccaggcacggtggctcacacctgcaatcccggcactttgggaggccaagaagggcggatc

SEQ ID NO: 59354 - DNA, 601 bp, Human
aggttggagggaggtctcagggtagggcaggttctgaatggcacgaaataatggccaggctactccgccgtatgaatgcccatcagctgagcctaacaggcaggcctccagacacaccgcagccagttcctgagggcttttgtgtgtcagggtgcaggtctgctgggctgccagccaacttgacatcacctctcttgcctgccaataaaactgaaccttctaacgaggttatccattcctgattccctgggctcataacccttctaggtggcctttctggtcactcaggggtgggccttcmtacctgcgtctctttacttcctcccaccatcactctaaggcctctccctgggagctggctgagctcactcctgcacatttggctgtctttagaactcctggtcccaaattgcagttctggcccctctggctgctggggaacataacctctgcctgctccccaggggctcaccgtgtgggggagcaaatcatgtatatccagtgctgtgagtggctccagtcatggaggagcaaggatgagttctgcctggaagaatctgggaaggcttcctggaggagggaacaatggcatggaccttga

SEQ ID NO: 59355 - DNA, 601 bp, Human
gggaggtctcagggtagggcaggttctgaatggcacgaaataatggccaggctactccgccgtatgaatgcccatcagctgagcctaacaggcaggcctccagacacaccgcagccagttcctgagggcttttgtgtgtcagggtgcaggtctgctgggctgccagccaacttgacatcacctctcttgcctgccaataaaactgaaccttctaacgaggttatccattcctgattccctgggctcataacccttctaggtggcctttctggtcactcaggggtgggccttcatacctgcrtctctttacttcctcccaccatcactctaaggcctctccctgggagctggctgagctcactcctgcacatttggctgtctttagaactcctggtcccaaattgcagttctggcccctctggctgctggggaacataacctctgcctgctccccaggggctcaccgtgtgggggagcaaatcatgtatatccagtgctgtgagtggctccagtcatggaggagcaaggatgagttctgcctggaagaatctgggaaggcttcctggaggagggaacaatggcatggaccttgaagagtcag

SEQ ID NO: 59356 - DNA, 601 bp, Human
tctcagggtagggcaggttctgaatggcacgaaataatggccaggctactccgccgtatgaatgcccatcagctgagcctaacaggcaggcctccagacacaccgcagccagttcctgagggcttttgtgtgtcagggtgcaggtctgctgggctgccagccaacttgacatcacctctcttgcctgccaataaaactgaaccttctaacgaggttatccattcctgattccctgggctcataacccttctaggtggcctttctggtcactcaggggtgggccttcatacctgcgtctctytacttcctcccaccatcactctaaggcctctccctgggagctggctgagctcactcctgcacatttggctgtctttagaactcctggtcccaaattgcagttctggcccctctggctgctggggaacataacctctgcctgctccccaggggctcaccgtgtgggggagcaaatcatgtatatccagtgctgtgagtggctccagtcatggaggagcaaggatgagttctgcctggaagaatctgggaaggcttcctggaggagggaacaatggcatggaccttgaagagtcagaagctt

SEQ ID NO: 59357 - DNA, 601 bp, Human
ctccccagcaaagataagaaacttgccaaccactcccctggtccagcatttggccaaggcagacactgaggctctgaggacaagtggctttcccaaggaaggtcctgctgcccagaagagcttggcccagagccctgtgcccagtgaccccactagcttttccctctactttccccgcctggctgtgctccccttgattcgtgcctattggccgtgcccatagtctctcccaagctcaaagttcacctctttctccagatcccctggggtccccaagcctgactcagtgtatctgggggggtcccttctgagcccacgcaccgacccagctcctcttccctgcagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggtaagtatcctggcggggcttgctggggagggcgatgaggagggcaagagcctccaaggacccagtcccaatctcaaccctatgaacctcaatc

SEQ ID NO: 59358 - DNA, 601 bp, Human
aggagggcaagagcctccaaggacccagtcccaatctcaaccctatgaacctcaatctccctgttcctctgtctctctctacacattctctcagggtttctctgagggagatggaggagggagggaaggagcccaagccaggaacagtgcactcaggaagactcagcccgaagcagatttgctgggttacctggggcgtctcctcccctctggggtgcagcctccttccctgaagagcgaggctgcttctagctctggagttcaccatgggggttcatgcctgcagcagcctctccccaawcaaagaccccgagggtactgggaaacagagaggggaactgggtggggtctgtaagcctcagcccctgctgagggtcactggagtctctgaccccacagtcctgcccacagagcttccccgacaggcatgtcccactctgtccaccctctgcttcttcccaggagcaactggactctccggattgaccaagttcatcctgggctccattgggtctgccattgcggctgtcattgcgaggttctactagctccctgcccctcgccctgcagagaagagaaccatgccaggggagaaggcacc

SEQ ID NO: 59359 - DNA, 601 bp, Human
ccctgacccgcggccagcatccttcatcggtggtgccgactggagcagatgcattgtagcttgcaggctgcgactctgtggctgttgtggctgttgtggctatctggctgggcttaggagcatcaatcatggcagtggacgagaatggttcttagctacagccctctgtgtcagccccctgcatggcaggaacccaggggacatcggaacccctgtggatgactcacagactccggggtctggaaaatcctaaccagattgcctcataacactgctggctgccctaatgttcaatgtgccstttaaaaaaacaaagcatctcaacaaaccaaacaagcgagctgcagccatggctttgctctggaggctgggcagggggagggacagagggttctcaggtgttactcacagtctgcggtgggctcaggctgtttctgctggcttggtcctgctgtcctggaccctagcatgtgtacagtaagcctgcggtggatgctgcctgttaaattttgtttgccagcttcctgggtggttaatggttagaggggccagtggccttcaccgcttggtagtcctctcccccgagtcattaaccaatggg

SEQ ID NO: 59360 - DNA, 601 bp, Human
aaaatgcagagtatcaatattattcatgcatttcatgtcaagtatgccctctttgttcctcatctctgaagagactcacttagtaaatattcactgtgttctctgttttcacaaatgccctatgagccaggcacagttcttgaccttctgtagtgaaacctcatgacatgtggtacagtgcagacagttctgttctctgtgcattatctctgccccaggtcactgagtgaggagccatggtggagacaggtctgcgtgactcagaagaatacccctgcactgggccagctgagccctcccmggccctgacccgcggccagcatccttcatcggtggtgccgactggagcagatgcattgtagcttgcaggctgcgactctgtggctgttgtggctgttgtggctatctggctgggcttaggagcatcaatcatggcagtggacgagaatggttcttagctacagccctctgtgtcagccccctgcatggcaggaacccaggggacatcggaacccctgtggatgactcacagactccggggtctggaaaatcctaaccagattgcctcataacactgctggctgccctaatgttcaatgtg

SEQ ID NO: 59361 - DNA, 601 bp, Human
gtgtggtggctcatgcctgtaatcccagcacttttggaagctgaggtgggcagatcatctgaggtcaggagttcgagactagccttgctaacatggcgaaacccatttctactaaaaatacaaaaacattagctgggtgtgatggtgtgtgcctgtaattccagctactcgggaggctgaggctggagaatagcttgaacccaggaggcagaggttgcagtgagccgagatcgcaccattgcactccagcttgggcaacaagagtgaaattccatcttaaaaaacaaacaaacaaacaaacaaaaaagtacccagccatataaaaatgcagagtatcaatattattcatgcatttcatgtcaagtatgccctctttgttcctcatctctgaagagactcacttagtaaatattcactgtgttctctgttttcacaaatgccctatgagccaggcacagttcttgaccttctgtagtgaaacctcatgacatgtggtacagtgcagacagttctgttctctgtgcattatctctgccccaggtcactgagtgaggagccatggtggagacaggtctgcgtgactcagaagaatacccctgca

SEQ ID NO: 59362 - DNA, 601 bp, Human
aaactgagatccagggagacagagtaactccccctgagctggaattctaagcctagatgtctgacatcggagcttgtgccatgccattctgcctatctctacagagagcaaaatgatgagtaaagcagctcttaagagtacccagccatggtcaggtgtggtggctcatgcctgtaatcccagcacttttggaagctgaggtgggcagatcatctgaggtcaggagttcgagactagccttgctaacatggcgaaacccatttctactaaaaatacaaaaacattagctgggtgtgatggygtgtgcctgtaattccagctactcgggaggctgaggctggagaatagcttgaacccaggaggcagaggttgcagtgagccgagatcgcaccattgcactccagcttgggcaacaagagtgaaattccatcttaaaaaacaaacaaacaaacaaacaaaaaagtacccagccatataaaaatgcagagtatcaatattattcatgcatttcatgtcaagtatgccctctttgttcctcatctctgaagagactcacttagtaaatattcactgtgttctctgttttcacaaatgccctatg

SEQ ID NO: 59363 - DNA, 601 bp, Human
tgagggtgaaaactccatccaccccacaatattgttgtgaataccagacgtggctgttatcagtgcttggcttatgtgacctcacttaatgggtcatcctggggcccattttacagatgagaaaactgagatccagggagacagagtaactccccctgagctggaattctaagcctagatgtctgacatcggagcttgtgccatgccattctgcctatctctacagagagcaaaatgatgagtaaagcagctcttaagagtacccagccatggtcaggtgtggtggctcatgcctgtaatmccagcacttttggaagctgaggtgggcagatcatctgaggtcaggagttcgagactagccttgctaacatggcgaaacccatttctactaaaaatacaaaaacattagctgggtgtgatggtgtgtgcctgtaattccagctactcgggaggctgaggctggagaatagcttgaacccaggaggcagaggttgcagtgagccgagatcgcaccattgcactccagcttgggcaacaagagtgaaattccatcttaaaaaacaaacaaacaaacaaacaaaaaagtacccagccatataaa

SEQ ID NO: 59364 - DNA, 601 bp, Human
taggtccctcatctccctgcctcatctggctcactccatcttgtcctttgagactcaggtcccaggtcaccgcctccaggaagccttgtatctgtgcttctctatggccttgccccatgacaggcagtgaaatctttgcttagctttggtcactgccatacctatctgggatctcctctcaggcacaggccctgtgcggtatgatgccaatggtaggatgggctcccctgccagctctggggagattgcatgtctcaccttctcctgcgttaattctctaagatgagggtgaaaactccayccaccccacaatattgttgtgaataccagacgtggctgttatcagtgcttggcttatgtgacctcacttaatgggtcatcctggggcccattttacagatgagaaaactgagatccagggagacagagtaactccccctgagctggaattctaagcctagatgtctgacatcggagcttgtgccatgccattctgcctatctctacagagagcaaaatgatgagtaaagcagctcttaagagtacccagccatggtcaggtgtggtggctcatgcctgtaatcccagcacttttggaagc

SEQ ID NO: 59365 - DNA, 601 bp, Human
tgaattaggtgatgtgggacaggctacttaaactctgcctcagtttccacagtataaaatagagctgataataacacctctagccttacccatttttctggtgtttgtctattctccagtgcctctgcacagcctcctcatctctctcaggactcagcagtagcccctacctcgtctccctgcctcctgttcaactccctccagcccttttacccatctgcagctgcatctttttaaattctcaaaaattcaagctgatcggttctgctttgaagttttcagggactccccattgcccacsacagggctgattctcactaatgtagcccagggggtctttgtgacccagtccctggtgacagttctgcctccagcctcaaatctggccctttggggtctcagccacagcaacactgggtgccaggggttcttccagcacacatcagccttttctcccactgtggggcagggcagggcatgtcacatcactatagggcaggttacagcaagacaggtcactgcagttccccagggcaggtcattttgatttttccatgtttgctgagcccagctctggactgggagcagggaacaaagatgg

SEQ ID NO: 59366 - DNA, 601 bp, Human
aaacacagagctgtaacctatcagcctatgtgtgtatgtcacttccttcttctgcctgtaaatactgcctacgttgctgggtggcactctctgaacctttactggtttagggtgctgtgtgattcatgaattgtttctttgctcaaataaactctgctacgtttaatttgtctaaagttttcttttaacaggtgcgctccgagcgtgggaaccactgttctgctctggaattccctagaggccccttccctggtgtgttccaaaagcagaatctcaagaatgacaggtgggaactcccccscaaaacccttagttctcctgagtctcccaaaaccctccttgcgtgtctcccttatctcaccagggtggaaaacaacccctgttggctgctctagcccctagttctctgctttagataatagaggcaggtgtgacctgctccccactccccgcacccaaatgatgggctttattgaattctccatcgggtttctgacttggatttctgggtcctcgcgacaattcttttgtcgcgaaacccagaaaagatcctgggtttcgtggcagatcaagctggattggggccctagcactgccatgt

SEQ ID NO: 59367 - DNA, 601 bp, Human
ataccactttgtatccacagggatggctactaacagacaaacaaaacagaaaacaataagttggcacaccaggcatgatggcccgtgcctgtaatcccagctactctgaaagctgaggcaggaggaatgcttgaggccaggagtttgagaccagcctaggtaacatagcaagatttcctttaaaaaaaatttttttttaatttaaatgttagcattgcatgtggggaaattggaacccttatgcattgctggtaggaatataaagtgctacaatgtgtggaaaacaatatgacagttcttyaaaaattaaacaaattgtcatttgacccaacaattttgcttcgagtatatacaccaaagaactgcaagcagctagtcaaggaacttgaaaagataattgtagaccaaagtcacagcagcattattcaccatagccaaaagatgaaaacaacccaaatgtctatcaatggatgaatgaataaacaaagtctggtataaacatacaatggaatactattcaactttaaaaaggaatgaaattctgacatttcctacaacatggatgaacctggaagacattatgttatgtgaaataagccag

SEQ ID NO: 59368 - DNA, 601 bp, Human
gggcaaaggacttgagtggacatcttttcagagacaacatacaaatggccagtaagcacatgaaaagatgctcagcatcactaatcattaggaatatcaaaaccgcaatgagataccactttgtatccacagggatggctactaacagacaaacaaaacagaaaacaataagttggcacaccaggcatgatggcccgtgcctgtaatcccagctactctgaaagctgaggcaggaggaatgcttgaggccaggagtttgagaccagcctaggtaacatagcaagatttcctttaaaaaaawtttttttttaatttaaatgttagcattgcatgtggggaaattggaacccttatgcattgctggtaggaatataaagtgctacaatgtgtggaaaacaatatgacagttctttaaaaattaaacaaattgtcatttgacccaacaattttgcttcgagtatatacaccaaagaactgcaagcagctagtcaaggaacttgaaaagataattgtagaccaaagtcacagcagcattattcaccatagccaaaagatgaaaacaacccaaatgtctatcaatggatgaatgaataaacaaagt

SEQ ID NO: 59369 - DNA, 601 bp, Human
cttcatcaaaattgaaaactttgttcatcaaaggatactatcaataaagtaaaaatgcaactcacagaatgggaaaacatttgcaaatttcatatctgataaggaattgatatccaggatatataaagaactcctaaaacccaagaacaacaacaaaacaaataaacccagttagaaatgggcaaaggacttgagtggacatcttttcagagacaacatacaaatggccagtaagcacatgaaaagatgctcagcatcactaatcattaggaatatcaaaaccgcaatgagataccacttygtatccacagggatggctactaacagacaaacaaaacagaaaacaataagttggcacaccaggcatgatggcccgtgcctgtaatcccagctactctgaaagctgaggcaggaggaatgcttgaggccaggagtttgagaccagcctaggtaacatagcaagatttcctttaaaaaaaatttttttttaatttaaatgttagcattgcatgtggggaaattggaacccttatgcattgctggtaggaatataaagtgctacaatgtgtggaaaacaatatgacagttctttaaaaattaa

SEQ ID NO: 59370 - DNA, 601 bp, Human
cctactaataggattatatgccatacccaatttggatttatttctgtaatgcaaggatgtttcaacatacaaaaattgatcagtgtaatacatcatattaacaaaataaaagaaaaaatcacatgatcatcttaattggtgcagaaaaaagtatttgacataattcaacacaccctcgcatgataaaaacacacagcagattgagacagtcaagtgtaaagaggtgcctggagaacattcagttggcctgcacactgggagaatggggtggagctgtgggaagtttgtgccctttgcagcrgggaggagcttggcctctctctcctgatccgatgtggtaatctggggattcagtcagtcagatgagggcctgttaacaggactctctcttgctttgctgagttgttttccttttcacccaataaattccattttattcacacctcaaagtgtctgtgagcctaatctttcatggccatgtgacaaggaccccgtgtttagctggactaagtagaaagtcctacaacaaaattagtaatagaagaaaactacctcaacataatcaagactacgtatttataaaaccttttatactcaatag

SEQ ID NO: 59371 - DNA, 601 bp, Human
actcaaaaataatgttttaccagctgctaaggtttgaatgtttgtgtccccacaaattcatatgtggaaacctattcatgggggctctaccctcataaaaggaattagtgcctacataaaagaggcctgtggcagtatttctggaagaaattggcatatgaatcagtggattgagttaaagacagccacctttaccaatatgggtgggcatttttaatctattaaaggctgaatggaacaaagaggtaggagaagggcaaattctctcttctgtccctgagctggacatctgtgtttaccrgccctgaacactgggcctcctgcttcttggacctttaaactctgggacttaaaccagcagccttattaggcccttttcctattgtggagctgcaccattggctcctccggttgtcaggccttcagactcagactgaattacatggctggctttcctgggtctccagcttgcagatggcagattgtgggacttctcagcttctgtaattacataaggcaattcccataatgcctcctcttatatatatttctatatatcctatagattctgtttctctggagaaccctgactaatataatg

SEQ ID NO: 59372 - DNA, 601 bp, Human
actgactgaaagtgaaaggatggaaaagttaccccatgcaaatagtaatcaaaagagagcaggggtgactacactaatattagacaaaatagattttgaattaaaaaagttccaaaagacagggcaatgacatattaataaagttttcagtacagcaagaagatataacatttttggttcttcatttcctatattactgtccttttttgtatttagtttttgtactgaaatgcttttttgtattgaaacactttaataattctattctcatccctttgtggttattatggggattacattagcatcctaaagttaacacctgaatttgaatatatgccattgtttatttgagatcttcttgtttttaatgtgtttacagctttacatttctatcatcacactgctttcactcattccataagttttggtatgttgtgtttccattttcgtttgtctttaagtattttctaattcccctggtggtatcttttttgatcctctggttgataaagagtgtgttgttttttccacaatttgtaaaatttccagttttccttctgttattgatttctaactgcatctcattgtgattgaagaagat

SEQ ID NO: 59373 - DNA, 601 bp, Human
cagtttcctcatctggagatatgaataacagccgttatgatttatccagtgcctgacaggtacccaacactgatctaggtagtctggctatattcagtcatctaaccattaccaaaacactcctaaagcaagtattattaacatgattttaggcaggcagaaataggtgctcagaaaggttaaaacccacccaaaggatatgttcaaaatgctggaagaaaagcaaaacacaattaaagcattcccagaaaaacaaaagctgagtaagcttttttccacaatacctaccctgcaagaaatragaggcattttatttcggattgaaatgaaaggacactggacagtaactttaagctgaatgaagaaataaaagacctctggtaaaggtagatgcgtgggcaattataagttatgtttttgggcacatgatgtgtagatataatttgttacatcagtaactggaaacaggtaggaacagagctataaggaagcagagcttttgtatgctattgaagtaaagctggttatatcaaatatactatggactaaatgtattatgagcatacatattacattttggtttaatttattttctctattg

SEQ ID NO: 59374 - DNA, 601 bp, Human
gattttagcggctgttattcctggccatagtggatgggccttcagatggggatgggtgggaatacctttgaagaagatatagttgaccaggacgaggatggctgggctatccagccctgaaaacaagtcgacaattttcccctgtgtcttattcttgacatagctgttgatctgtctgctggctgttgcccagtcctggaaattcatagccaagacctctgactcatagtagtgcttgatgtctgctgagaatgactccagcaactccaggctgccatcaagaaacaaggcattgcccatrgtcatttctaagctggtgtctgactttgcaaagagttggtgcaggtgctggaaaccctggtggatctcagtctcagacctctcagtgaggttgaaacccaggccctggagaagctgggcccgtgtgtggccacaggtgcccagggacagcatagctaaggccatggagatgctcacaggggagatgaaaatgttctttttgggactcaaggccactaggtgcttatacaggctgaaggcaaagtcaacgttggctgaagccaggccccggtgatggttactcatgttcacataagcagcg

SEQ ID NO: 59375 - DNA, 601 bp, Human
tttcagagtattttgccaaaagttttaaccaaacactcacggattcgttttgttgtattatagaaaatctgtgtacaatgaggcatttcatctccatcaatgtctggtcctgcattcaggtgttccaagtttctctgattttgtaacctaaagctgtgatctcctatccacttagccccactgtggtcctgaggacactgtgaaacctcgtacagaatgacaccaggccagcacccgttccaccagcacccattccaccacatgtgctcaggcatctctcaggctcaggagggccctcccygcacctgggtttactgtgccttttccccaggttgtgttgcctgaacctctgtgcaaccactgctgagcttgttccatgcaccaagcattaaacaagggcactggaatctcccaaagagacaaagataccctgcacaagagtgcacagtctcgtgggggagatggtctatggaatttgtgggagcacacagaagagtttctgggcaaatgttcccagcctccctggccctcccatagtcaggtgttaggaaggctgcctttgcctggtcagcctctcagcctcaccatcctgcgaagaggg

SEQ ID NO: 59376 - DNA, 601 bp, Human
gataatacctacactaatcttgatttctgtttattatcctggcttgctagaaatatttcagagtattttgccaaaagttttaaccaaacactcacggattcgttttgttgtattatagaaaatctgtgtacaatgaggcatttcatctccatcaatgtctggtcctgcattcaggtgttccaagtttctctgattttgtaacctaaagctgtgatctcctatccacttagccccactgtggtcctgaggacactgtgaaacctcgtacagaatgacaccaggccagcacccgttccaccarcacccattccaccacatgtgctcaggcatctctcaggctcaggagggccctccctgcacctgggtttactgtgccttttccccaggttgtgttgcctgaacctctgtgcaaccactgctgagcttgttccatgcaccaagcattaaacaagggcactggaatctcccaaagagacaaagataccctgcacaagagtgcacagtctcgtgggggagatggtctatggaatttgtgggagcacacagaagagtttctgggcaaatgttcccagcctccctggccctcccatagtcaggtgtt

SEQ ID NO: 59377 - DNA, 601 bp, Human
tggctcacacctgtaatcccagcactttgggaggccgaggcgggtggatcatgaggtcaggagatcgagaccgtcctggctaacgtggtgaaaccctgtctgtactaaaaatacaaaaaaataaaaaaattagccgggtgtcatggcaggtgcctgtagtcccagctactcaggaggctgaggcaggagaatggcatgaacccgggaggcggagcttgcagtgagccaagattctgccactgcactccagcctgggcaactgagcaagactccgtctcaaaaaaaataaaaataaataaakaaataaataacacatcagggccattttacatattctacatttagtgataatacctacactaatcttgatttctgtttattatcctggcttgctagaaatatttcagagtattttgccaaaagttttaaccaaacactcacggattcgttttgttgtattatagaaaatctgtgtacaatgaggcatttcatctccatcaatgtctggtcctgcattcaggtgttccaagtttctctgattttgtaacctaaagctgtgatctcctatccacttagccccactgtggtcctgaggacactg

SEQ ID NO: 59378 - DNA, 601 bp, Human
agtccagcagatcccaggtgtcctggctgccattgaccacaagccctgaagcccttgccaggccaccatttcccagcccaggctccctaaaggtggccagaacatcactccaggtagccctttctccatcctactgtctgtgggatctatggattgctcagccaaaattcttggttctaagccagccacaaaccttttgtaatagctacttatggagacaacagggagaggctgatggatgtagagaaatcagccatggctgcggagtctagagacaccagagctatgctggtcccttctkaatgacctcactaaccttgatgtctgcagacactggccaatggtagtaaactcaccgtccgtctgtctcacggcaaatgagattatttgagggttctcaaatcatcctccaaaggaggtctaaaatcctcagaaccagagggcagttgtattttgtggctaacttacagcaaaaaaacaaagtgggtaaaatatttttcattgttaggtttttttcgtccttaacattttgctgcttgctttttatggagtatttcttttctaggagtaagcataatgtatatagtttgacacaaaacaa

SEQ ID NO: 59379 - DNA, 601 bp, Human
ccacctgcaggaaacttacctgggctgagtgtcacagggtctctctgctctaggtgacgtctccccagtcttaaagtgatgactgaggcccttgagtccagcagatcccaggtgtcctggctgccattgaccacaagccctgaagcccttgccaggccaccatttcccagcccaggctccctaaaggtggccagaacatcactccaggtagccctttctccatcctactgtctgtgggatctatggattgctcagccaaaattcttggttctaagccagccacaaaccttttgtaatagcyacttatggagacaacagggagaggctgatggatgtagagaaatcagccatggctgcggagtctagagacaccagagctatgctggtcccttctgaatgacctcactaaccttgatgtctgcagacactggccaatggtagtaaactcaccgtccgtctgtctcacggcaaatgagattatttgagggttctcaaatcatcctccaaaggaggtctaaaatcctcagaaccagagggcagttgtattttgtggctaacttacagcaaaaaaacaaagtgggtaaaatatttttcattgtta

SEQ ID NO: 59380 - DNA, 601 bp, Human
cattcaagcctcaagggtttttaggtaagatataaaaattcccagaaatttaaatcctgtttcatcctctacttcttggaatgggttgaggatgagctctgtttctgagactggcttctaaacaaggaagtagggagagaccaagagggtactggtccttggatttgggggtaggtcagactgtgccttggctccccatgcctagagtgggtcccagttctgagggctctggaagtggtgctagacctcaagtctcaaactcagagtccctggtgggaagcgagggggccatctccacccctgccagcctggccggcccagctgaggctcctgaccctgctgaatggtccttccttctaggccacgttgtcctaatgaagagtcagggtgagaagactccttcagggtcacagactcccacccccagcaggccctcaagtcccatctaccatgttccagggtgccaccatccagcttgtttttttgccttgagatggagagctcactaccttcacagatgggacttggcggtactcgtcagctctgatgggaagaaaattgctcctcagactgagccaaagcctgcctgattgtccgccac

SEQ ID NO: 59381 - DNA, 601 bp, Human
cttccccttgtccggaaggatgaagaagacagtcccattgcccacgtagttcatctgcaccagctggcaggggagctccgagtcatgaaggtaactgatggtgctcgactgcaacatcatgggcaccttcaccacagttgtctcgtccacatagaagttctcctccctggtgcttgccaggtcaaagggctgtgtccatgtgcctaggaagaggaggagacaggtctgtagggcagagaggaaaacacagttccaggtgacctcacgggcctactatccaagtgacacagtggccttctgmatgcttggaatgtccccattcaagcctcaagggtttttaggtaagatataaaaattcccagaaatttaaatcctgtttcatcctctacttcttggaatgggttgaggatgagctctgtttctgagactggcttctaaacaaggaagtagggagagaccaagagggtactggtccttggatttgggggtaggtcagactgtgccttggctccccatgcctagagtgggtcccagttctgagggctctggaagtggtgctagacctcaagtctcaaactcagagtccctggtgggaagcgag

SEQ ID NO: 59382 - DNA, 601 bp, Human
taatcgtgtcccggctcagtgcagcgatgactgtgttcatcttccccttgtccggaaggatgaagaagacagtcccattgcccacgtagttcatctgcaccagctggcaggggagctccgagtcatgaaggtaactgatggtgctcgactgcaacatcatgggcaccttcaccacagttgtctcgtccacatagaagttctcctccctggtgcttgccaggtcaaagggctgtgtccatgtgcctaggaagaggaggagacaggtctgtagggcagagaggaaaacacagttccaggtgayctcacgggcctactatccaagtgacacagtggccttctgcatgcttggaatgtccccattcaagcctcaagggtttttaggtaagatataaaaattcccagaaatttaaatcctgtttcatcctctacttcttggaatgggttgaggatgagctctgtttctgagactggcttctaaacaaggaagtagggagagaccaagagggtactggtccttggatttgggggtaggtcagactgtgccttggctccccatgcctagagtgggtcccagttctgagggctctggaagtggtgctag

SEQ ID NO: 59383 - DNA, 601 bp, Human
tgcggaccacctgttaatcgtgtcccggctcagtgcagcgatgactgtgttcatcttccccttgtccggaaggatgaagaagacagtcccattgcccacgtagttcatctgcaccagctggcaggggagctccgagtcatgaaggtaactgatggtgctcgactgcaacatcatgggcaccttcaccacagttgtctcgtccacatagaagttctcctccctggtgcttgccaggtcaaagggctgtgtccatgtgcctaggaagaggaggagacaggtctgtagggcagagaggaaaacrcagttccaggtgacctcacgggcctactatccaagtgacacagtggccttctgcatgcttggaatgtccccattcaagcctcaagggtttttaggtaagatataaaaattcccagaaatttaaatcctgtttcatcctctacttcttggaatgggttgaggatgagctctgtttctgagactggcttctaaacaaggaagtagggagagaccaagagggtactggtccttggatttgggggtaggtcagactgtgccttggctccccatgcctagagtgggtcccagttctgagggctct

SEQ ID NO: 59384 - DNA, 601 bp, Human
cttacagcctttgggggcccagcagacaggaaaactgagccctggagggtgagtccagggaaggaaggatgccccagcatactccctttccacgtgccccactttctggggacacgtgcattgcagaaatcaacatgatggctggaggacttacctgctggtcaggcctgcggaccacctgttaatcgtgtcccggctcagtgcagcgatgactgtgttcatcttccccttgtccggaaggatgaagaagacagtcccattgcccacgtagttcatctgcaccagctggcaggggagctcygagtcatgaaggtaactgatggtgctcgactgcaacatcatgggcaccttcaccacagttgtctcgtccacatagaagttctcctccctggtgcttgccaggtcaaagggctgtgtccatgtgcctaggaagaggaggagacaggtctgtagggcagagaggaaaacacagttccaggtgacctcacgggcctactatccaagtgacacagtggccttctgcatgcttggaatgtccccattcaagcctcaagggtttttaggtaagatataaaaattcccagaaatttaaatcctgttt

SEQ ID NO: 59385 - DNA, 601 bp, Human
cactccatcccctgtgcttagctagggcatggtacatagcaagtgcttccgtttatgtgcattgaatgaatgagcgaatgaaatgcacattgaatgaatgaatgagtgagtgagtgaatgaaatgctgcctgatccaccagccttcctgagctactccagatctacattcccactctctcctcagcatcccccctgcttctgagtctgcatcagcccccctgccaccaggtttcatgctggttggcattttctgacccttctgcacagatggaacttgaatctccctgagagtgaggaccrtgttctaagaacacctccttcctcctttaaggtgaggagcagggctgcgcacttgcatgacaataatttcaattactgtctagctcaggggtgcttagggggaaaatctcatttgtttgtgcatctgtccatccatccaaccatccacccatccatccgctcactcatgcatccatttacttattcattcatccattcatttactcattctccattcactcactcacccatccattcactcactcaccattctatgcactcactcaccattctatgcactcactcacttattcatccatt

SEQ ID NO: 59386 - DNA, 601 bp, Human
ccacggaggccacaaagtcctgtgtcttgaggtcaggggccacacatctgagtaacgggggcatacacagggcctacacagtttgggatatatagtaggtgttcagtaaacattttctgaatgcatgaataacagaacataaagctgaaggatttatgtaattgaatggatgtaattgggtagaaggctcaatatgatcccaattagacatttaccacttttcctgtttctttttgccaggggccactcacagctctgccatgacaacttggttttcacagttcccctctgtgtggtctgrtgggatgggtaggtgcctggcctgtggccctcctgtgtcgacagcttcctgtgtgatcttggggatgtcatgttttcttgctgagcctccatttacctcatggtgagacaaggggctttgactcaacctggggttctcagccagggacctagaggctcattcatgaacgaactcagtgccacttcctagtattatatttatattgtgaattttggagggggaagaaaaggtgggttcccatgacatttacctttgatgacttcagctgggcgtcctgggtgatgcgtgagaaatttgcct

SEQ ID NO: 59387 - DNA, 601 bp, Human
tagcttgtggtctccaaataccaatccccacaaaaaggaactagaattccttagagaaacagttgttctgaggtcagaggatagacatatacaagataagcctagaacactttgttgtgccagaaaacaaggatgctatcaaaacctaacaggattatgttgaaaaaatacaggagccaatatgaaggaaccaaagggacaaattgggcataaagaatggaaacaactgcctaaaacacaatgattctaaaagttgaagccaacaattaaaaagagttcagtaaaatacttttaaaaaaamcccaaaaactcttggacaacactgaaaatgacaagggcaacaattccttactctgacaattatcaattagaagaaataaattctgcatttatcctaccaatgtgaatgataaattttaggataatcagatgatattaattccttaagaataatttcagctaataaatatggaaggagtaacggaattagaaagtcatcatttcacaaccttaatgacataataaatgcacacagtagtcatcagtggattcctaagtgaaaggttaatgggaaactttacaatgaaggctttgggctatt

SEQ ID NO: 59388 - DNA, 601 bp, Human
atgacacctagcttgtggtctccaaataccaatccccacaaaaaggaactagaattccttagagaaacagttgttctgaggtcagaggatagacatatacaagataagcctagaacactttgttgtgccagaaaacaaggatgctatcaaaacctaacaggattatgttgaaaaaatacaggagccaatatgaaggaaccaaagggacaaattgggcataaagaatggaaacaactgcctaaaacacaatgattctaaaagttgaagccaacaattaaaaagagttcagtaaaatactttwaaaaaaaccccaaaaactcttggacaacactgaaaatgacaagggcaacaattccttactctgacaattatcaattagaagaaataaattctgcatttatcctaccaatgtgaatgataaattttaggataatcagatgatattaattccttaagaataatttcagctaataaatatggaaggagtaacggaattagaaagtcatcatttcacaaccttaatgacataataaatgcacacagtagtcatcagtggattcctaagtgaaaggttaatgggaaactttacaatgaaggcttt

SEQ ID NO: 59389 - DNA, 601 bp, Human
gcaaaggtcaagttataattaaaagctaggaactttgtatataatacaaaaagaaattcgatttatattattaaatgtcaatgtaccaattagccttctgtactgaaccatctgtttattgacctgtttctaacccagtgaacaacagtcacgttaaattcacgctgaaagggccatatttctccctacagaaaaagtctggcataagtaagggttcatgggatcgttattgataaaaaggatggttcatttcgatgactgagcaacatgcatcctattccttttttttttttttttttttgagacggagtctcactctgtcgcccaggctggagtgcagtggcgtgatctcggctcactgcaacctccacttcccaggttcaagcgattctcctgcctcagcctcctgagtagctgggaccacaggtgcacactaccacgcctggctaatttttgtattttcagtagagacagggtttcaccatgttggccaggatggtctcattctcctgacctcgtgatccacccacctcagcttcccaaagtgctgggattacaggcgtgagccaccacgcccagccgaagcatcctattctttctc

SEQ ID NO: 59390 - DNA, 601 bp, Human
gatttgtttctagatatcaccttctgaagaaaagcaaaacaaagttcacaacttaaaaagtaggggggatgggcacggtggctcatgcctgtaatcccagcactttgggaggctaaggtggcacgtcatttgaggtcaggagtttgagaccagcctgaccaacatggcaaaaccctgtctctgctaaaaataaaaaattagccgggcatggtggcaggcgcgtgtaatcccagctgctcaggaggctgaggcaggagaatcacttgaacctgggaggcagaggttgcagtgacccgagatygtgccactgcactccagcctaggcgacaaagctagactccatctcaagaaaaaaagagaaggaaaaaaaagtgttaattttatatgcagagtaggtgatgtcaagaatatgtgaatactcacactgagcctgtgagaagtgcgaaaacaggtaactgggaagataaactcatttaaaattggattttcttggaccgtgctaggcagtggctggaaacagatttttgagcaggtcctgccactgaagcctgctctcattcctttaccaaacattcaaaataaaacttcaaaaggatctata

SEQ ID NO: 59391 - DNA, 601 bp, Human
tagctaaaattagggaataggaaactgggccaaactcaatgactaaccagagccagcaaagtctaataggctaaaaaaataaaatgatagcttaatttcctttcattaaaatgttctaattacagatcaccttaaaaggtcatctggtttctcaagaagtgagaggttttttttttcttcttaaattgtcctagagaaccaccttggtgaatcaataactgctacttttacctactataatagcaagaccttaaaaggattcttttctttccttttaacaataaatacttataatagtgawaataaagttctttaattaaacaaaggtaataccaagctataaaatttgcccatatgacatcaaggaataggaagtaataaagatttgtttctagatatcaccttctgaagaaaagcaaaacaaagttcacaacttaaaaagtaggggggatgggcacggtggctcatgcctgtaatcccagcactttgggaggctaaggtggcacgtcatttgaggtcaggagtttgagaccagcctgaccaacatggcaaaaccctgtctctgctaaaaataaaaaattagccgggcatggtggcaggc

SEQ ID NO: 59392 - DNA, 601 bp, Human
tgggcaatatagtgggatgccgtctctacaaaaaataaaattagctgggtgtggttgacatgcgcctgtggtcccagctactcaggaggctgagatgggaggactgcttgatcccatgaggtcgaggctgcagtgagctgtgattgtgccactgcactccagcctgggcaacagagtgagaacatgtctcaataaatagccaggtgcagtggcccacacctgtaatcccagcacttttgggaggccgaggcgggtggatcacctgaggtcaggtgtttcagaccagcctggccaacgtggygaaaccccgtctctactaaaaatacaaaaattagttgggcgtagtggcaggtgcctgtaatcccagctactcaggaggccgaggcaggagaattgcttgaacctgggaggcggaggctgcagtgagctgagatcgcaccactgcactccaccctgagtgacaagagcaaaactccatctcaaaaaaaaaaagaagtaaaaataaataaatagtgttacgtggatttgagaaatgtccaaaacccactctctttctgcatcccatgctgccttcccccaaaaggaatgtctgaaaaaagag

SEQ ID NO: 59393 - DNA, 601 bp, Human
gcagttaataaataaatcgtgttggtcaggtgcagtggctcacacttgtaataccagcactctgggaattcaaggtgggaggatcacttgagcccaggagtttgagaccagcctgggcaatatagtgggatgccgtctctacaaaaaataaaattagctgggtgtggttgacatgcgcctgtggtcccagctactcaggaggctgagatgggaggactgcttgatcccatgaggtcgaggctgcagtgagctgtgattgtgccactgcactccagcctgggcaacagagtgagaacatgtytcaataaatagccaggtgcagtggcccacacctgtaatcccagcacttttgggaggccgaggcgggtggatcacctgaggtcaggtgtttcagaccagcctggccaacgtggcgaaaccccgtctctactaaaaatacaaaaattagttgggcgtagtggcaggtgcctgtaatcccagctactcaggaggccgaggcaggagaattgcttgaacctgggaggcggaggctgcagtgagctgagatcgcaccactgcactccaccctgagtgacaagagcaaaactccatctcaaaaaaa

SEQ ID NO: 59394 - DNA, 601 bp, Human
atagctagtatttactgaatacttactaagtgtcaaataatgtgttgctgctttataagcattttaaatttaatcctcactataaccctactggcaagaattatttcccccgtgttccatgggaggaaactgaggcccagagaggttaagtgcctggagaggtactggcccaatcatgtagaactagaatagcatgctaaggagtttaagcttcatttagtacaaagtggaagggcaataaggaatttgaaacagaatgatgtgagtcaatgacaattcagaaagatgacgctaccagtaytatgaagacagactatagagagagaaccctagagataaggaggtgggttgggacactattccagtactccaggtaagaaaggagaagggccttcagtatagagagaaggtgacagattttatttaattaaaataattttaaattttatttaattttattaaggtttattaaattgtatttaattaaataattttatgtaattacaaaaaagtttagtaacccatgaactgaagagtttgagggattttaaggaggtagagtctacaggacaaaaccaaaaagtaaatgcccacagagatc

SEQ ID NO: 59395 - DNA, 601 bp, Human
cttcaaacaaaacaaaacaaaatgtggcacccagagtgttctgttctcccaaatccaatgtgtaatcctgattacgacattgtccatggaagatgtacttcctcattgaaaaagttgtgaaacttaagcagttcacagccccacctggtccaaatgatcaggatatcttctttcttacaaggtcttccaactacctccctgattgtcacagcacagtacagtcatgcactacatgaagacagttcagtcgaggacagactgcatatatgaaggtggtcccataagattattataatactgkatttttactatatcttttctatgtttagatacacaaatagcattgtgttctaactgcctacagtattcagtacagtcacatgctttacagctttgtagcctaggagcagtagtaggctataccatatagccgaggtgggtagtaggctataacatctaggtttgtgtaagtacacttaatatttgcacaacgaaatcacctaaccaccatttctcagaatggtcgagtccagactatacagtctcttgcatagaactgtcagcctatcctcttagctgacatcatagccctaaagagtct

SEQ ID NO: 59396 - DNA, 601 bp, Human
tagaagttgtgggaaacagtgccactgaagcactggggttcctgaaaccataagccacactgaatggtactgtaccctctgatgcctgagagacactggaagttttctgaaatgaactgaagtcaattcaataactactcattgaaaactcactaagtactaaaactgtgctggagattttaaagagatatgctacggcttcgatgtgcccctctcaaagttcatgtgttggaaacttaatccccaatgcaacagtgttgagaggtagaacctttaattttatttatttaattaaaaaaawttttttgagacaggttcttactcttgtcttccaagctggagtgcagtggcacgcaccatcatggctcactgtagcctcgaactcctgggctcaagcaatcctcccacttcagtctttcaagtagctgggactacaggcgtgagccaccacacccaggtaatttttgtattttttgtagagacagggtctcgctatactgtccaggctgatctggaactcctgggctcaagcgatcctcctgcctcagcctcccaaagtgctgggattataggcatgagccactgtgcctggcggagaagt

SEQ ID NO: 59397 - DNA, 601 bp, Human
atcaagagatagtaggcaacaacttcggctgaaaatgtgtatttccacatctgaaaaggttgccctgtcaaattttgagggaaggccatgatgaattaggattattggatatgtgctaagcttggatttacttaatataaatctgagtactgaaaagaacataagttttatctaatattccactttaattcaaacattttgatcaatgtatggcctagttcagtaggagtacaatgtcatagagctattcccactaagcccttaaaagagttacaacagctcaaggaaaaaaaaaaaacawctttaagtgttcaaatctcagggatgcttcttataatagagttcatgttagaagagtcaatctgattcagctggatcaaagaagcattctaatcttaaatcatcaagcaggagaaaggaaaagacccaaggagccccagaaaactgttcagccccaatcccctggaattcacctagttataaaatttacaactgcctgcatgaaattagaagttgtgggaaacagtgccactgaagcactggggttcctgaaaccataagccacactgaatggtactgtaccctctgatgcctgagagac

SEQ ID NO: 59398 - DNA, 601 bp, Human
gtaagatcatggctggctgtcacaagactgctaagaaaccacagccctttgggcaaagcacagcctgttggcctgccgaggtcacagaaacctcacagcatagcacactgctgcctcctctggctgttagagcaggacatacctcttcgtaatttttcgcctccactccatgcttcatgtctaggatcacgagttggtcaggtatccgccctgttcctgagaaagaaatcaaaggaatcattgtgtgaaatacttaaaattctgggaaattacccacccacccgcccgcccgccctccctytacagaacccctaccctctcaatagagggaaacagccacaactcctccccctgctcagttgcagaaaattcctggctctggctaaaatcacaaacattccagacaaagcctctatctgtgtggggtgccggaaagcaacaagaacatgctgctggcaaacatctctgagcaggcaaggacacaagatactgcaactggtactacagaggaacagaacagaagggaaaccacacaggcttattgaattgggaaataaaactcaaaaatcaaaacagtgtgaaattgagtggcatataaatc

SEQ ID NO: 59399 - DNA, 601 bp, Human
taaagaggtcttcttgttttatttatttaaattaaactagcctggaaacagaaacaaacaattgaaaattctctaccggaaactgtctcccattcacaactgtatcacttgctcctatttactgcctctaaataacgctacctagtttcattcaattgaggatttgaacaaggaaagagctgcaactgttgtactacttcctgttgcagaattaaccagtcatttccaatcttcttccattttaggatatttcccttccaaagtgctgtccaaagagagagcaacttctgttccactattsctagacaattttcctaaatcacttaaaccaattttccttcatttacttagtttgcattcttcaaaagcccattctatttcctgtaccccactcctccttcatgcccttacgtactgttttgttgggtaaaaatactcttatctttctgtaaagatcaattatctagtcttaaatagttcttgtggtttttcaaaggtgcccttcatttgaagaacccttttgtgctgcccccaagtctcgcagagatgaaaaaggctgttgtccttctcctcattctgtgtacacctccatctccctgtc

SEQ ID NO: 59400 - DNA, 601 bp, Human
gtgcttcattttgcagtgagtccctcatttttcaaatgaggaaactaaagattccataaagttactcagccctttgggtgtccaaccaaaattaacagtaccatggtctcttaactccctacccagggtgatcacagcatttaaactgccaaactctgctgtaaaattcgagaacagaatccctgacttccaaaagcatttatgctctctgtacccaaatctgacctatctttcaagcctccttgaaagcctccttcaaccactcttgtccacactgtcttccctgaagccctacaacacwtactgtgtcacacagttaacactcaatcatatattgtcatattcacaaattgttttatttttatcctgtccctccacactagtttggctcctgaactcaaggaaattaaaatgatttatagtttatatagtcgtaaagacctgagacttggtaaacacttgtaattgacctgttctgcccactctatgccttcttcaaagaagccaactttctcaaagtagctaagtgctgctggtcccctgaagcaagtgtttcttgtatactaaaagcactctgcattgattttttttctttcttttt

SEQ ID NO: 59401 - DNA, 601 bp, Human
tatactaagtttttcctgaatcaaaggtgaaatgaacaagctatattaggccacaaggatctatataagttgtcctgtttgcttgactaataaagtttgactaataaacttcctgggtttcccattgctattatttttgcagggcaacagagtaaaattttaaaacaaatcatggtaagtattctcaagaagacgctctttacttgctctggactaagcattcaatacatagcattgaggctttatatcacagtacaaaaagctaaaaaatcctcaatatcaaaattcccactttctgttrttctgctcttgtaagcagttgattgaactgttcagagtatctgtaaaaatgccaaattatacatgtttcatgaaggcaggctggtattctattctactctccttcatcactggaagcatgaggtatgttttgccaagtctgtaagacaatgtgcaccacaggttctccaatagggggtgatatccccctggcaagctgcatgtagttgttaaataatcaaaggatgttatagttacaaggtgcttcattttgcagtgagtccctcatttttcaaatgaggaaactaaagattccataaag

SEQ ID NO: 59402 - DNA, 601 bp, Human
tttattctgtaagtactagaaatttaataaagaaaaccagatgagtatactaagtttttcctgaatcaaaggtgaaatgaacaagctatattaggccacaaggatctatataagttgtcctgtttgcttgactaataaagtttgactaataaacttcctgggtttcccattgctattatttttgcagggcaacagagtaaaattttaaaacaaatcatggtaagtattctcaagaagacgctctttacttgctctggactaagcattcaatacatagcattgaggctttatatcacagtasaaaaagctaaaaaatcctcaatatcaaaattcccactttctgttattctgctcttgtaagcagttgattgaactgttcagagtatctgtaaaaatgccaaattatacatgtttcatgaaggcaggctggtattctattctactctccttcatcactggaagcatgaggtatgttttgccaagtctgtaagacaatgtgcaccacaggttctccaatagggggtgatatccccctggcaagctgcatgtagttgttaaataatcaaaggatgttatagttacaaggtgcttcattttgcag

SEQ ID NO: 59403 - DNA, 601 bp, Human
cacgcctgtaatctcagcactttgggaggctgaagcggatggatcacttgagaccaggagtttgagaccagcctggccaacatggtgaaacccagtctttattaaaattacaaaaattagctgggcatggtggcgcatgcctgtagtcccagctactcaggaggctgaggcacgagaatcctttgaacctgggaggcagaggttgcagtgagctgagatggcaccgctgcactccagcctgggctgggtggactctgtctcaaaaaaataaataaatgaagaagtagtagtagtagtcagyggtttaaaacaaaaaacaaaaaaccttcactgcaggcagggcacagtggctcatgccagtaataccagcactttgggaagccaaggcaggtggattgctggagaccaggctgggcaacacagcaagaccccatctctattacaaagtagtaataataataaagaaaaaaaaactttattgcaagaatatataacaatagacttttattaccagcttaaaacaaatataaaaaagtttcttgattttttttaaacattttaaggccttaacgtttttttctgagttcttattatgtgcaag

SEQ ID NO: 59404 - DNA, 601 bp, Human
ctgtacattccctatggcccacttttttttctctcctttgttcaattcattgtccttgtccttttctttgtgaaatgttaacagcagttaacaagggatgaataggaggcatttattttatgttttcttattatattcttcactaaatgtgtgatgaacaaaagttatttaaaataaaacaaactgctgttaaaattgggatgtaaaaattgagtttatatttaaggtccataaaaatatggtgatagacttgcgatgatacacctacagttttctctcaccagaagcacattttcttgcrtttgtaaaatgttggctagagttaacggtgtgactggtaactgcagaacagcttctgggtgtaagatttaaccaatagttaatgcacagagctaactttcctaagtgaatggccaaatgccaggttttgtcattaacccagaatatatatctgttcattgatctcatatagagctgcagaacaaaaaaaaattcctcaagaaaaatacaggagctatacaagctgaaccttagtctaacatcttccctcctgctctatacttccccactcagagcttcctaaatgagacagtataaagga

SEQ ID NO: 59405 - DNA, 601 bp, Human
taagagtcgccttccccctcaccgttggtatcacgcatctcctcttctctcttcttcatgtaggcaaaatcattaacaatagattctgaaaggtcttctaggcgtcgcagctctacctctaatggtttgagcttctcaacttttgcaatctggaaaagaatggaatattttcagctctctgaaaacatcgcttcagtcaagaacataaagaaggcaacagagaagtcttttttaaagtttcaccagatttaaattctctcctatcaatcatcctaacatattttaaaatttgggcttctttctttccctatagactatatctttccatttcagaccttttttgatactttaattttgactaaaatcttagaagtaatataataaccgtaggctataaagtaagatatactattgtctcaagattttttactttttttttgagacagggttttactctgttgcccaggctggagtgcagtggcacagtcttggctcactgcaggctcgacctcctgggctcaggcaatcctcttgcctcagcatcccaagtagctgggaccacagtcatgcactgccacacccagctaatttttatactttt

SEQ ID NO: 59406 - DNA, 601 bp, Human
acagaactgtattttatttagagttgtttgccttatcacactcctttctttgagactgggtaaggttctgatgaaccagaaaaagtcactaggaaggatgaaagaatgggcaggtggagttgatcagaagatgtaaggggagggaggcgacaggggaagacagactcccacgtctcagagtggtgtgctagcaatactttagagaaggcctgagatgttcccaacagagtgactcttgagaataggtaatgtgaccagagattgctaacatacaggctgaaataaatttttaaaatttatrtgaaagcaaggaaaacgattatggagaaactagtctatttttatttttatttatttttaatttttttttttttgagacggagtctcactttgtcacccaggctggagtgcaatggtgtgatctcggctcactgcaagctctgcctcctgggttcatgccattctcctgcctccatgccattctcctgcctcagcctcccgagtagctgggagtacaggtgcccgccaccacgcccagctaattttttgtatttttagtagagacggggtttcaccgtgttagccaggatggtctcgaact

SEQ ID NO: 59407 - DNA, 601 bp, Human
ttcttgtgccttagcctcctgagtagctgggactacaggtgcacaccaccatgcccagctaatttttgtatttttagtagagacggggttttgccatgttgctcaggctggtcctgaactcctggcctcaagccatccacctgcctcacctcccaaagtgttgggattacaggtgtgagccaccgcacccagccttcataatattcttagttttagattggctttccctaatccatccaaatcattgaaactatattatataccaaaaataatcattaaaaaaaggttacaagaagaccasctggttagtcattcaggctaaactccattcttacctgcctcgccattctcttcagtcttagtgctcatcaaacaggcaataaacttgttatctacttgctggagaacctgtcagacattcaaataagtggtacaacactaaataaaaattaacaaaggcttatttgcatagaaagatacagaactgtattttatttagagttgtttgccttatcacactcctttctttgagactgggtaaggttctgatgaaccagaaaaagtcactaggaaggatgaaagaatgggcaggtggagttga

SEQ ID NO: 59408 - DNA, 601 bp, Human
tccctggcatacaatgggcactcaattaatacttgttgaatgagttaatatatttacaaactattattgtttcattagagcaggtcaccaagagattctgtgtaaatattgacaaacctagcagagttcattatatacactttctattattataaagggaaaacatgaaaatattattaaaaagtcaaacaatagaaaatatttaaaagaataaaagatgggctgggcgtggtggcttacacctgtaatcccagctgttagggaggcagaggtggaaggatagcttaagcccaggagttcragacctacctgggcaatatagcgagaccccgttctccacaaaaaggaaaaaaaaaagacaaaaagagtaaaagttgaaatatctcctttgcacaccctcattttcactcccaaagtaaatactcttgatagtttaatgtgcatcctgagtatatgtatgtgtatgaacataaaactaaatgtctgtcgcccaggctggagtgtaatagcgcaatctcggctcactacatcctctgcctcccaagttcaagcgattcttgtgccttagcctcctgagtagctgggactacaggtgcacacc

SEQ ID NO: 59409 - DNA, 601 bp, Human
caaaataaaaagtaatagttctctctaatacctccaatgccacagcccagcagtagctttccaaacctttaccaaaacatatatgtaaagtaatcatatttggaatgcaatctaaaatggaccttactctcctgcttaaaagttttcactggctgcctataggataaaatgcaaactacttagtagaatatgctaaattattttatgatttgaccttgacaacccatctagccaactcccatccagtcaaagatccaagtataacttctgatttccccccaatttttttttttttttttttgagacggagtcttactgtgtcactcaggctggagtgcagtgcagtgatcttggatcactgcaacctccaccttccgggttcaagcaattctcatgcctcagcctcccaagtagctgggattacaggcacataccatcatgcctggctaattttttaatttttagtagagacggggtctcatcatgttggccaggctggtcttgaactccagacctcaaatgatccgcccgccttggcctcccaaaatgctgggattacaggcgtgagccactgcacctggcctgatttccccaaatctta

SEQ ID NO: 59410 - DNA, 601 bp, Human
aaggatataaatggaatatataacttctaaacgagtagagcaaaaaaaaaaagagaaatacagaaaactataatagaaaacaggaaaggagaggaaaaagacaataaagacaaaataaatgatatttgctataaaaaaagaaacatataagtaatcaaaataaaaagtaatagttctctctaatacctccaatgccacagcccagcagtagctttccaaacctttaccaaaacatatatgtaaagtaatcatatttggaatgcaatctaaaatggaccttactctcctgcttaaaagtttycactggctgcctataggataaaatgcaaactacttagtagaatatgctaaattattttatgatttgaccttgacaacccatctagccaactcccatccagtcaaagatccaagtataacttctgatttccccccaatttttttttttttttttttgagacggagtcttactgtgtcactcaggctggagtgcagtgcagtgatcttggatcactgcaacctccaccttccgggttcaagcaattctcatgcctcagcctcccaagtagctgggattacaggcacataccatcatgcctgg

SEQ ID NO: 59411 - DNA, 601 bp, Human
gctgagatcatcccattgcactccagcctgggtaacagagtgagactctgtctcaaaaaatgaaataaaataaaataaaatagaaagtcaaaagtagtgaaatattttcaaaatgcgggggggataactggcaatgtgaaattctgtttttagctagataatcatgcaagtatgaagacaaaataaagatactttaaaagacagcttatcattcacggacttttttttttttgagacagagtttcactcttgtcacccaggctggggtgcaatggcgtgatctcagctcattgcaacttcygcctcccgggttcaagtgattctcctgcctcagcctcccgagtagctggaattacaagtacctgccaccatgcccagctaatttttgtatttttggtagagacagggtttcaccacgttggccaggctggtctcaaaactcctgacctcaggtgatctgcccgccttggcctcccaaagtgctgggattacaggcatgagccaccatgcctggcccacggactcttactaaaataacttctatttatttttatatttttgtattttttgtctcaagatctgtttgtggataaaagatctt

SEQ ID NO: 59412 - DNA, 601 bp, Human
atgggtttgtgaagttggggttatctttctccatggatcgtccaatagcaatctctgattgtttccttacaatgttcattttatttgcttctttttttctaatttccataataatcttcctaatctaaactctcatattgttataacctgcctttatgcacaatttacccagtcaacaaatatttattaagtatatactttgtattgggagctttgtcaggcagttagtgagacagataatttccatcctcatggcgcttatggtctaataggggagacaaacatgaagcagataattatmcaataatttaaatgataaatataggtgctataaaatacaggatatgaatatataataggaagaccaaacccagtttaggagcttaaggaaggctttcctggcaaagtagtattcaagctgagactttaggttaagaaagacgtggctaattgaagaaggagagaaaagtgtttcaggtagaggagaaggccagtgcagaggccccgacgctgacaaatgtttagcacacaggaagcagaagaccaaaaaagcaggctgggatgtaaagaacaaggtggagagtgatatgacgtgacactg

SEQ ID NO: 59413 - DNA, 601 bp, Human
tttgggcagggcgcagtggctcatgcctataatcccagcactttgggaggccaaggtggacagttcacctgaggtcgggagttcgagaccagcctgaccaacatggagaaacgctgactactaaaaatacagaattagccgggcgtggtggcgcatgcctgtaatcccagctactcgggaggctgaggcaggagaattgcttgaacctgggaggcagaggttgcggtgagccaagatcgcaccattgcactccagcctgcgcaacaacagcaaaactccgtctcaaaaaacaaaaaaaaaaggaaagattttggaaagcagcaacagggacattcctgttatgttctccatgttctccttcactgaagattataacaaggacagaagttcttcatttaagccattctgtgccttttctgcattatccacattgtagtttgcaggttgctgggtaattagggccaaagcataatgtagagatccccaagcttgggtccctgtctgatgatcctcaaaccataactcaagatccttggggatggccagctacagtcacagatcaccgtttccagcaggtactatcaagaaactggaagttgag

SEQ ID NO: 59414 - DNA, 601 bp, Human
gctagttgagtcagacaacattagtacctgaaaactccatgcaagaaaagattttatatcccttagcagggaaaggttagcaaaagaaaagattttgggcagggcgcagtggctcatgcctataatcccagcactttgggaggccaaggtggacagttcacctgaggtcgggagttcgagaccagcctgaccaacatggagaaacgctgactactaaaaatacagaattagccgggcgtggtggcgcatgcctgtaatcccagctactcgggaggctgaggcaggagaattgcttgaaccygggaggcagaggttgcggtgagccaagatcgcaccattgcactccagcctgcgcaacaacagcaaaactccgtctcaaaaaacaaaaaaaaaaggaaagattttggaaagcagcaacagggacattcctgttatgttctccatgttctccttcactgaagattataacaaggacagaagttcttcatttaagccattctgtgccttttctgcattatccacattgtagtttgcaggttgctgggtaattagggccaaagcataatgtagagatccccaagcttgggtccctgtctgatga

SEQ ID NO: 59415 - DNA, 601 bp, Human
aagtctagattcccagctctcagcaatggagaaaaactttcttcatatttttctttgtgaaacaaagaggttttaatgaagtaaaatcagctagttgagtcagacaacattagtacctgaaaactccatgcaagaaaagattttatatcccttagcagggaaaggttagcaaaagaaaagattttgggcagggcgcagtggctcatgcctataatcccagcactttgggaggccaaggtggacagttcacctgaggtcgggagttcgagaccagcctgaccaacatggagaaacgctgaccactaaaaatacagaattagccgggcgtggtggcgcatgcctgtaatcccagctactcgggaggctgaggcaggagaattgcttgaacctgggaggcagaggttgcggtgagccaagatcgcaccattgcactccagcctgcgcaacaacagcaaaactccgtctcaaaaaacaaaaaaaaaaggaaagattttggaaagcagcaacagggacattcctgttatgttctccatgttctccttcactgaagattataacaaggacagaagttcttcatttaagccattctgtgccttttctg

SEQ ID NO: 59416 - DNA, 601 bp, Human
ttaagtctagattcccagctctcagcaatggagaaaaactttcttcatatttttctttgtgaaacaaagaggttttaatgaagtaaaatcagctagttgagtcagacaacattagtacctgaaaactccatgcaagaaaagattttatatcccttagcagggaaaggttagcaaaagaaaagattttgggcagggcgcagtggctcatgcctataatcccagcactttgggaggccaaggtggacagttcacctgaggtcgggagttcgagaccagcctgaccaacatggagaaacgctgwctactaaaaatacagaattagccgggcgtggtggcgcatgcctgtaatcccagctactcgggaggctgaggcaggagaattgcttgaacctgggaggcagaggttgcggtgagccaagatcgcaccattgcactccagcctgcgcaacaacagcaaaactccgtctcaaaaaacaaaaaaaaaaggaaagattttggaaagcagcaacagggacattcctgttatgttctccatgttctccttcactgaagattataacaaggacagaagttcttcatttaagccattctgtgccttttc

SEQ ID NO: 59417 - DNA, 601 bp, Human
aaataagtagcaaaaggtagatactatatagcaaccttctgtgcccatggatgcaaatgaatgaattgtctttaggcttgaatttcatctggctactcaactaggggaatcatctgctcaagaaagactgatacagagagccctgctgtctaagctgctcagggacactgggctgattcagtcagggccgtgctggtacctgctgctgctgctctctgctcagaggcatacagtgaacatccctttgttccttttagaccagtgattctgttctcatggtggctcacagggaggcatggaytgctgcaggctctgccttgtatcacactctgcttttccaaagagacgccaggcctgggccattttgcgaagtttagtgaggttgggtttaatctatgggaagaaagaataacttcaattagcaatatgaaaaggtaggtagcatacaggctgggcgaggtgactcacacctgtaatcccagcactctgggaggccaaggcaggcggatcacaaggtcaggagtttgagaccagcctggccaatacggtgaaaccctgtctctactaaaaatacaaaaaaaaattagccgggtgtggtggc

SEQ ID NO: 59418 - DNA, 601 bp, Human; identical to SEQ ID NO: 59406

SEQ ID NO: 59419 - DNA, 601 bp, Human; identical to SEQ ID NO: 59407

SEQ ID NO: 59420 - DNA, 601 bp, Human; identical to SEQ ID NO: 59408

SEQ ID NO: 59421 - DNA, 601 bp, Human; identical to SEQ ID NO: 59409

SEQ ID NO: 59422 - DNA, 601 bp, Human; identical to SEQ ID NO: 59410

SEQ ID NO: 59423 - DNA, 601 bp, Human; identical to SEQ ID NO: 59411

SEQ ID NO: 59424 - DNA, 601 bp, Human; identical to SEQ ID NO: 59412

SEQ ID NO: 59425 - DNA, 601 bp, Human; identical to SEQ ID NO: 59413

SEQ ID NO: 59426 - DNA, 601 bp, Human; identical to SEQ ID NO: 59414

SEQ ID NO: 59427 - DNA, 601 bp, Human; identical to SEQ ID NO: 59415

SEQ ID NO: 59428 - DNA, 601 bp, Human; identical to SEQ ID NO: 59416

SEQ ID NO: 59429 - DNA, 601 bp, Human; identical to SEQ ID NO: 59417

SEQ ID NO: 59430 - DNA, 601 bp, Human; identical to SEQ ID NO: 25531

SEQ ID NO: 59431 - DNA, 601 bp, Human; identical to SEQ ID NO: 25532

SEQ ID NO: 59432 - DNA, 601 bp, Human; identical to SEQ ID NO: 25533

SEQ ID NO: 59433 - DNA, 601 bp, Human; identical to SEQ ID NO: 25534

SEQ ID NO: 59434 - DNA, 601 bp, Human; identical to SEQ ID NO: 25535

SEQ ID NO: 59435 - DNA, 601 bp, Human; identical to SEQ ID NO: 25536

SEQ ID NO: 59436 - DNA, 601 bp, Human; identical to SEQ ID NO: 59406

SEQ ID NO: 59437 - DNA, 601 bp, Human; identical to SEQ ID NO: 59407

SEQ ID NO: 59438 - DNA, 601 bp, Human; identical to SEQ ID NO: 59408

SEQ ID NO: 59439 - DNA, 601 bp, Human; identical to SEQ ID NO: 59409

SEQ ID NO: 59440 - DNA, 601 bp, Human; identical to SEQ ID NO: 59410

SEQ ID NO: 59441 - DNA, 601 bp, Human; identical to SEQ ID NO: 59411

SEQ ID NO: 59442 - DNA, 601 bp, Human; identical to SEQ ID NO: 59412

SEQ ID NO: 59443 - DNA, 601 bp, Human; identical to SEQ ID NO: 59413

SEQ ID NO: 59444 - DNA, 601 bp, Human; identical to SEQ ID NO: 59414

SEQ ID NO: 59445 - DNA, 601 bp, Human; identical to SEQ ID NO: 59415

SEQ ID NO: 59446 - DNA, 601 bp, Human; identical to SEQ ID NO: 59416

SEQ ID NO: 59447 - DNA, 601 bp, Human; identical to SEQ ID NO: 59417

SEQ ID NO: 59448 - DNA, 601 bp, Human; identical to SEQ ID NO: 59406

SEQ ID NO: 59449 - DNA, 601 bp, Human; identical to SEQ ID NO: 59407

SEQ ID NO: 59450 - DNA, 601 bp, Human; identical to SEQ ID NO: 59408

SEQ ID NO: 59451 - DNA, 601 bp, Human; identical to SEQ ID NO: 59409

SEQ ID NO: 59452 - DNA, 601 bp, Human; identical to SEQ ID NO: 59410

SEQ ID NO: 59453 - DNA, 601 bp, Human; identical to SEQ ID NO: 59411

SEQ ID NO: 59454 - DNA, 601 bp, Human; identical to SEQ ID NO: 59412

SEQ ID NO: 59455 - DNA, 601 bp, Human; identical to SEQ ID NO: 59413

SEQ ID NO: 59456 - DNA, 601 bp, Human; identical to SEQ ID NO: 59414

SEQ ID NO: 59457 - DNA, 601 bp, Human; identical to SEQ ID NO: 59415

SEQ ID NO: 59458 - DNA, 601 bp, Human; identical to SEQ ID NO: 59416

SEQ ID NO: 59459 - DNA, 601 bp, Human; identical to SEQ ID NO: 59417

SEQ ID NO: 59460 - DNA, 601 bp, Human
cgtgttgattgggtctgccagcacggtgtgttgcatttaccttcggagttacgagattcacctgtcaccaccactgggacagctttgagcgtgtacttaaaagaaaaagctgggtttttttttcatcttgggtgacgtcgataatgtcttctttctcaacaggggaactgccctctagggagacgttccctgcctggtaagttctgcccttaccgtcacctaaaatgctctcctcctgggcagagcagtatgtgaggaactcgggggtgcctgtgtttctcataatatttaaagacagttyggttcagagagtagtgagacgcaatgctacataatcacgagctatcgcttattcatttagctcgtagttgagtttctactgtgttaggcactgtgctagacgctagggatacaggagtggatacagaagtgtacagttcttgccctcgtggagctcctaggctagttggatagtgtcagttgctaaacaagccaacaaaggcaaatttttgtaactgctgagaaggaaacgagggtggacagaagagccctttttgaggaggtgacttaaaagttatggccatggccgggcgcggtggct

SEQ ID NO: 59461 - DNA, 601 bp, Human
ttggttactacgagagaggaattaaagggtgtgatgagagggtgggatgatgtagaccagcttgggaaggttgggaatgtcagtaaaggcttccctgaagaagtgacatttaactgagacctgaatataaaagagccaagaaaatgtattccaggcaaagggaattgcttgtgcaaaggttttcagacaggaaaggacttgaccagtgatagacatgggaagaagcctgtctggcaggaaagatagagtgggctggacggtacaggatcgcgtaaagtgtggactttatcctgagagttaygagaacataaagcccctagcacaatgtcggcttgtagtggactctcaataacaaacatgtttttcaagtgggaaccctgaacaatgtcagtaaacattttctccacttcataggtgggcaggacaatggaaagagccttgcacttggggatttgcatttgggctcagggattcaccttgggctagtcgcttaacctccaaaagtcctacttatatgaaatgggaataatggcagatggtcgttccacttcagagagttgtgagactgtaaaatcaaaatgaggtcattatgggaaagctt

SEQ ID NO: 59462 - DNA, 601 bp, Human
agttgttggttaagagttattttgtttcttgcaggggtctccttatgccagggaccaggttaccctaacagcaggaaggttgtgtaagtatcactggggagtacagatatgtggccacgggttatttatttaaagacataaagttctaaatttgaccatctgatttcttcactggcctccagacctagaaattgaggtgattatgttgagtccctagactaacctcaatgttcacttttcccatgtgatgttccttgagcatcagctccgtgtcaggttttggactgggagtgtgcccacyctccacaggtgtttggattataatgaaagttaagttggaatcctctttttatgggatatagaagggtgctcctagatattctgtttggatgtaagtgcagctgaaaggctcgaggttacatttattgtggagattgagagcatcctctcagtagcatagttactcatttttaaaaacagtaaaagcataaaactggttgagtcctgggactgactgactagtttggagggaatgctgttattgcataatgcagagtttggagaaaggctacccatgtgtgtttcagattaacttctgcgt

SEQ ID NO: 59463 - DNA, 601 bp, Human
aatgtttctgagaaaggacagaaagtgaatcttcacagtagcgatgacttgttatcacccttgctctgaaattatggccttagatgtttgtgtgcaaggccttatatattgtgttgcaactcttgttactcactggagatacgctgttgttgttgttgttttgagacgtttcgctctatcacccaggctggagtgcagtggcacgatatcggctccacctgccaggttcaagcgattctcgtgcctcagcctcccaagtagctgggattacatttttgtagtttttagtagagatggggtwtcaccatgttggccaggctggtcttgaactcctgacctcaagtgatccgcctgccttggcatcccaatatgctgggactacaggcatgagccactgtgcctggcttcattggagattctatacagctaattttctaatgctggataaacatttggacttcctccatctgtcttcctcttccagacatctgtgcaggttccatcaccagcaaatggcgtgattgaagctcttttggtacctgatgggggaaaagtcgaaggaggcactccacttttcacactcaggaaaactggtggtaaa

SEQ ID NO: 59464 - DNA, 601 bp, Human
gatagcctcgaaagtttgttgctcatgaggttctgttccacaaatagctattcttatgcaaatctttatcaacagaaagtgccctttttcttatgattcttatgttggctagactacactacactacattcttttataaatgggttttggtttttaaatcactgtttctgagccttcattcttggtcaagctttaggcacatctgagtgagtagttttggcctgtgtttgcatgtttttgcttggaggagaaagggccaccacaggaaagggaagcctggagctcgtgtacttagatactrtagtccttggccatctactcgtggcaagccgtgttctttctgactacacggggaatgcttgacccagagagatcagattgtcaatgcttgttccactcttactttcaggagaaaatgaacaggatgcggcagcgcattgctcagcgtctgaaggaggcccagaatacatgtgcaatgctgacaacttttaatgagattgacatgaggtagtgtctctagtccctcttatcccctaggcccctttttcttagagaacacgaacttgccccactccttatctagtgctgattctaaaactaa

SEQ ID NO: 59465 - DNA, 601 bp, Human
gaagcctggagctcgtgtacttagatactgtagtccttggccatctactcgtggcaagccgtgttctttctgactacacggggaatgcttgacccagagagatcagattgtcaatgcttgttccactcttactttcaggagaaaatgaacaggatgcggcagcgcattgctcagcgtctgaaggaggcccagaatacatgtgcaatgctgacaacttttaatgagattgacatgaggtagtgtctctagtccctcttatcccctaggcccctttttcttagagaacacgaacttgccccastccttatctagtgctgattctaaaactaacttgtcagggaagaggtatttgtttattgttttttgtttgtttgtttttgtttttgttttttgagatggagtctcgctgtctcccaggctggagtgcagtggcatgatctcggctcactgcaagctccgcctcccgggttcacgccattctcctgcctcagcctccagagtagctgggaatacaggcgccccccaccacgcctggctaattttttgtatttttttagtggagacggggtttcaccgtgttagccaggatggtctcgatctc

SEQ ID NO: 59466 - DNA, 601 bp, Human
gatagacgctgggcaccatggctcgtgcctataatcccagagctttgggagggtgaggaaggaggatcgcttgagcttaggagttggaaaccagcctgggcaacatagcaagactgtctctacataaaatttaaaaattagccaagtgagggctgggtgcggtggcttgcgcttgtaatcgcaacactttgggaggctgaggtgggtggatcacatgaggccaggagttcgagaccagcctggccaacgtggtgaaactctgcctctactaaaaatacaaaaattacccaggcatggtggygtatgcctgtaatcccagctactcggaaggctgaggcacaagaattgcttgaacccaggaggaggttgcagtggctgatatcgcgccactgcactccagcctgggcaacagagcgagattgtgtctcaaaaaaaaaattatgtatggtggcatggacctatagtctcagctacttgggaggctcaagtgatcttcctgcctcagcctcccaaatggctgggaccactacaggcatgtgccaccaggcttggccaatttttttagtttttgtagagacaaggtctcgctgtgttgcctagg

SEQ ID NO: 59467 - DNA, 601 bp, Human
atgttggtgtgctgtgtgatctcttgttcatatgatgtgtcactgaaatctgtgacttctagaccatgaaggagccctgtaaagagatcaacccaccttaaagacagattgggcctgattcctgtagatttctttgtaaaagaacagagttactgtgttaacctcaggtagactatttcaaaacttgaactaaggtaatggtccagagtgagggaaaagctctcacctaattgtgtatatggattgagaaacctgtgtgaaagtcaaaatgcaggctttgtggtcagtttgttttgtaatrttttcacagtaacatccaggagatgagggctcggcacaaagaggcttttttgaagaaacataacctcaaactaggcttcatgtcggcatttgtgaaggcctcagcctttgccttgcaggaacagcctgttgtaaatgcaggtgagttgcttgtggctggaattggagaggtcctgggaggtaggtgtatgagcacagacctgctcccacatgcagaggatcaacagaccaaggctttttatttgctacctatagaaatatcagtatcttccccagggatttcttggttcaccttcctgaa

SEQ ID NO: 59468 - DNA, 601 bp, Human
cttgttcatatgatgtgtcactgaaatctgtgacttctagaccatgaaggagccctgtaaagagatcaacccaccttaaagacagattgggcctgattcctgtagatttctttgtaaaagaacagagttactgtgttaacctcaggtagactatttcaaaacttgaactaaggtaatggtccagagtgagggaaaagctctcacctaattgtgtatatggattgagaaacctgtgtgaaagtcaaaatgcaggctttgtggtcagtttgttttgtaatattttcacagtaacatccaggaratgagggctcggcacaaagaggcttttttgaagaaacataacctcaaactaggcttcatgtcggcatttgtgaaggcctcagcctttgccttgcaggaacagcctgttgtaaatgcaggtgagttgcttgtggctggaattggagaggtcctgggaggtaggtgtatgagcacagacctgctcccacatgcagaggatcaacagaccaaggctttttatttgctacctatagaaatatcagtatcttccccagggatttcttggttcaccttcctgaagcagcatcatgattactttcta

SEQ ID NO: 59469 - DNA, 601 bp, Human
cggaccatcactgaactgggagagaaggtaaagtagaaagatgtatacaagctgctaagcaggcgagggaagagagccttcagaaggctgggctcactagcaagcagtgctcatggaaagtcaagtgcatagcccctgagaaaagcagttgcccatgagagctaagtattttatatatctggtggagtttaccatgctctggtaactgaaatctcatcagatgagacctgctagaaaagatcatctttgaagtcttcaactgtatgaaattgtgccttttctctggtggagcactggtcayagacaccttagccgaacaactgtcacacggaagctagcgcttgtgccatcgatctcgatacaagctttctggacttcctttgcttttttgtttttagaggcagggtctcgctgtgttgcccaggctggagtagagtggtagagtcatagcttactgcagccttgcactcctgggctcaagcgattctcctgcctcagcctcccaagtagctgggactacaggtgtgcaccaccatgcctggctaattcttaagttttttatacagatgggggtctcactatgttgcccaggttggccttg

SEQ ID NO: 59470 - DNA, 601 bp, Human
tttttagaggcagggtctcgctgtgttgcccaggctggagtagagtggtagagtcatagcttactgcagccttgcactcctgggctcaagcgattctcctgcctcagcctcccaagtagctgggactacaggtgtgcaccaccatgcctggctaattcttaagttttttatacagatgggggtctcactatgttgcccaggttggccttgaactcctggcctcaagcagtcctcctgcctcggcctcccaaagcgctgggattatggactgactttaggtgaaggaaactgggttggcttratatttcaattatgaaatctgtttttaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtaggaaccgtcacttctaaggtcctagtggctaggtctcgatgaaagggaaatccaactaaatgctaattgtaaaacattaactataatttcaggcctaagtt

SEQ ID NO: 59471 - DNA, 601 bp, Human
agccttgcactcctgggctcaagcgattctcctgcctcagcctcccaagtagctgggactacaggtgtgcaccaccatgcctggctaattcttaagttttttatacagatgggggtctcactatgttgcccaggttggccttgaactcctggcctcaagcagtcctcctgcctcggcctcccaaagcgctgggattatggactgactttaggtgaaggaaactgggttggcttaatatttcaattatgaaatctgtttttaggcccgaaagaatgaacttgccattgaagatatggatggyggtaccttcaccattagcaatggaggcgtttttggctcgctctttggaacacccattatcaacccccctcagtctgccatcctggggatgcatggcatctttgacaggccagtggctataggaggcaaggtaggaaccgtcacttctaaggtcctagtggctaggtctcgatgaaagggaaatccaactaaatgctaattgtaaaacattaactataatttcaggcctaagttccatttcttagtttctaatagctaaggcactgattatcaaattgtggtctggatcagcatcatctgg

SEQ ID NO: 59472 - DNA, 601 bp, Human
cctaccaaagtgttgggattacaggcgtgagccactgcgcccggcctggcttgtaactttttttgtgtgtgtgtgcctttttgatacagagtcttgccctgtcgcccaggctggagtacagtggtgctatctcagctcactgcaacctccgcctccagggttcaggcaattctcctgtctcagtctcctgagtagctgggactacaggcgccctccaccacgcctagctaatttttgtatttttagtagagatggggtttcaccatattggtcaggctggtcttgaactcctgacctcagstgatccacccgcctcagcctcccaaagtgctgctcacctcaggtgagccaccatgcccggccttgtagcttttttaaaataggagaaggtattttctaattactacttttttttctgcaagcaaaaatttagcctttgctttttaaatgcagtgtatctgggtgccacatattaagcgaactgttttgagaacaaattagatttggcatctgcatttgctcatgtctcaaacatcagaggaggttactgaaagacgtacaaaattgttaaaaattctttggtgaaaagttgaaacttcta

SEQ ID NO: 59473 - DNA, 601 bp, Human
gctgtgattctgtatactgagcattgtgacccatggtcagtattataagacatataagagaaaattctgaatcatgcttctgtgaaaaggtagtttgttctttactggaagccttgtggaggccacatcaggtgtagattgggagagaggatgataataattttccgcagggaaaggaaagcttgactatggaaagtgccctcagttcgtagaggatcaggatcaggcttttgtaatatatcttttctcacttgtcagcctttcaaccagtgtagagcccaagctattatactatatactrcttcctgcctccagagttttcatccatcttagtggatgagacaaggagccatctttgagtataggcagatgaggagggaatggcagttcagggctctgcctgatcacccaggctttcattcatactgtcctccttgaatcctgaatgaaaatgatctctaactatggggatggtgttatggcacctgctacatctgtgagagaatatgatgtatgtttatgtgtgtgtactcaatgtatacccaatgtatgttagtttcttttaccctacattgtgtctgaaatcttatttctgataata

SEQ ID NO: 59474 - DNA, 601 bp, Human
ttttgtcttcctctcaattttatcatttggattcattttataatttattggttaattggattgtaactcttaaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggtaactttttaaagtcttactaagattcaacaaaggagaatgggttttatttacaactttgcctcatgtttatttycttgttaagaaggattagatacttgtttgagaacatttttgtgagatttaatattaaaaataaattctgttagattcttggaatcttattgcttgaaagggatcctaggaatcatatcaaatgtatcgttttatagatgatgaaattttggcctggccgggtgctatggctcatgcctgtaatcccagcactttgagaggcctaggtgggcggatcacttgaggtcaggagttcaagtccagcctggccaacatggtgaaaccctgtttctactaaaaatataaaagtcgggcatggtag

SEQ ID NO: 59475 - DNA, 601 bp, Human
aatggtacttgatatgacaatggtatctgataaatttggttgggatacttcttcaggtaacagaaggttgatgtagagaacctctagtgtttttgaaaatggaaagtcaatcgcaaattatgactagaggaatatatcttgtagagcatatgtggtgagaaaagaaagtatgttcacatccaaaagtaaggctgttaaactcaaaaattacatttgtaattaatttaataaagttgaagtaacatatgtgattattctttgatggctgcagatataacccctgtcatgtgtggtaaagatkaaatatggtatttgtgtttggctaattttgtttattccttttttctctgttttctctagtggaagaactagagactattttcaaagtataaatacaaatatgttagtatttgaaaaaatataggtattctagaatgcgtatttctgttaccattacagtttcagtttttacatgtctaatttttatgctgtaataatgacagtttttgtaaaatgttttctcaaagattataatattctttgctttcatataaaatcattttctaaatatttctaggcaatgtgcagaatatacacaagg

SEQ ID NO: 59476 - DNA, 601 bp, Human
gtcaaaatctaagtttgttgtagaaattgacagactgactttaaaatttatatggaaatgtaaagtactgagaccagtctaagaatagttttgaaaaagaacaagttgggggacttagagtatctgatttcaaggctaactgtaacatgaccgtaatcaagataatgtggtattggaataaagagagtcatacagatcagtggaatgaatagaagagagtctaggaatagatccacacatatatgacccactgatttctgataaagctgccaagaaggcaactcagtgggggaaatgatartcttttcaactaatggtgcttgaacaactggatagccacatacagtaatatgagccttgacacttacctcacatcctacaaagacattaattcaaaatggattatagacctaaatgtaagagtttaactgtgaaacttctataagaaaacaaaattgtagtgaccttgggttcagcaaaaaatttttagatagcgtacaaaaggcaccaactataaaaaaatcagtaagttggactttatcaaaatgaaaaactattgcttcccagagaatgtttaagaaaataaaaacccaagccacaa

SEQ ID NO: 59477 - DNA, 601 bp, Human
tcctctgtggttctccactgctcttagataaactcctgagtcttttttttttttttttttttgagacagaatctctctctgttgcccaggctggagtacagtggcacgatctcggctcacttcaacctccgcctcccaggttcaagcgattctcctgcctcagcctctcagtagctgggattacaggcacacaccaccacgcctggctaatttttatatttttggtagagacagggttttgccatgttggccaggctggtctcaaactcctgacttcaggtgatccgcccgccttagcctyccaaagtgctgggatgcaggcatgagtcactgcacccagccaaagtccagagtctttaaaatggtataggatgttctccatgatctgtaccctgtgttcctcttgagccttttctcttacatttccccaaattacaatgagcatctttcagttcctcaaaaggaggaacacttcgctttgctaattcttccttgtgcttcaggtctcattatgggcattaattacccagacaactgtccctgatgtgccagtctgggtttggtcctcctcctagtgttccctcagtatcctgagatctct

SEQ ID NO: 59478 - DNA, 601 bp, Human
caaacgcacgatgaagaaaatgacaaatgctgggtaggtaccaagtagagaatcaaagcagggtgacttgattcagtgtgacaaggtggctgctttatctggagtggtcactgtctgcgaaggacaggtaaagcactgtgcagcagacttgctgcacagagcgggtgacaattcagctgaggcctgactgacaagaagcacacagccctgtgaagattagagaaagagcattccaagcagaggcaacaaaggccctaccgtgagaacaagcttggcaggtggaaaaacagtggagggtggyagaaagagagtcggcttggtgtcagaaagctcggggcattgtcccagatctgttgcttcctaggagtgtgaacgatgagcaagtccctccatctctgatgattagttttttcttttggaaaatggtgctaatgtttgctaccttataggcttggtgtgaagattagatgaactacattaaacatgcccagcacaagataggcactggagaaatgctagctttgggtgctttttaaattaattaattaatttatttaatttttttagatatgggctcgccatgttacccaggctggtcttg

SEQ ID NO: 59479 - DNA, 601 bp, Human
tgttttctaaagagaggatggggaaaggaaacaaagactctgaagtttattccgtatttttcagtttctgaaaagtgtatttgttttctatggactcataaatattaatggaaagtttcaataatttagatggacaggataattgcattgtagtggtataactgatagggccccaacttgtttttatttgttacaaaactatacatttatggctgagaattaataaacatactaacagtaatcataaaggaaataaaacctcagccattgtaaaaaataaaaataaaaaaaaccacaaccyccccatctgccaaaactagatataattgattcttgcttaattctgaaagctcatttactttttggattataattttgtgaactaactctggataattttgcctattttgaatagttttagataatgcctattttggcatctccctgaatatttctgaccatcccttcaacatttatttggtctgtttaaagaagacacattaacatttgcctaagtcacatgaattaggatgcagaatctataattatggactaatgatacacaaatacaggctttgaggagtatttattggacaactac

SEQ ID NO: 59480 - DNA, 601 bp, Human
aggaatgtattaatgacagcctgcgcttgataagaacaggacaccaacagggggcataaacaagatctaggtacaactgtgaccttgaagtgaccttgagtttaagttgccatttaaactcattttccttaaactgtccttttctggcaaaataagtgactcctgaagttgcctcattagaactccaatatgcatttttctctctgaactgtttctgatgggtgttgactccttctgttgtcatttggtcctataggaccaaacttgtatatgtagaattttattttaaaataggaaaaaycatgattctgaaaaattgtgcctgtcaagatattaaatgactgttcccattaatattattgccattaatattttgaagtcaaattacatagtgacagctctctgcctgaatgatacttacgttaaaaggaagaaactgtctgagagaattggaagagatgataatgaggcctccccaccactttcccttttaagcccctcacctatcacctactcctccatcccctagacttaagtaggttcccttacttttcttctgcttgggccattgtttagaaaggtctgagtcttgggatgagct

SEQ ID NO: 59481 - DNA, 601 bp, Human
acaaaagatttatttatttttagcccggtggccaccctgaaccccccagttgattgattgaggctagtcttgagcgtgccctgcttcacatgctagttttccagtttctactttgggagaatgaccttatcattaggctggccaagagggcttctttctgttcctgtcacagtactaggctgtatactcattcaccctcagttcccttttctggtatatttcttaacaaattatttccctctttccactatttttaggggtaacaagtctaagatatttacatataaatggctctcccttytcaaacccttttctagcaagcactttctgggaggacagtgtcttaccaggatcttctgtcactgtggtccctttgagggtagaaagaatagattgttgtgaagtcttttgtcagcctcttcatggttataaacgtacttagttttccagactatgtaggttttagacttcaagtgaaaagagtatacgttgttatgcagcaatagaaaacaaaacaactaccacaaaattgtattttttctccatccagaggctttaactttcaacatttgtatatggaggcaaggctgacagccacagc

SEQ ID NO: 59482 - DNA, 601 bp, Human
cagaataccttcaagatattcagattctcttattatcctcctctttgggaggcaactgaggctcagagaggttaagatacttgccccaaataagtggtgaaggctgggcacggtggcccagcactttgggaggccaaggcaggaggattgcttgagcccaggagtttgagaccagcctggacaacatagcaagaccctgtctctttttttttttttaaagttgtggagctagagtttgagcacctgcatggaaccactaagctgcattacacctgcctcaggtggttgatatgaagaaaartaaaaatttttcagatggactctgggtatttgccttttaaggctatatgccttttaattctgatgtaaagtggtagagaaatgattaaaggtttaagagttgatagggccctgggtagcagggacactttacatgtgttgtgtgtgcatctgcagcagatgacagctccccaaatggacatgcctcccttgttcaagaaagcttgtcagggtggcaccaatttttttttagcaatttaatgaatgaggtatcaaatgatcacataatacaaatttgattgatctccttttggatatatct

SEQ ID NO: 59483 - DNA, 601 bp, Human
acatgtgttgtgtgtgcatctgcagcagatgacagctccccaaatggacatgcctcccttgttcaagaaagcttgtcagggtggcaccaatttttttttagcaatttaatgaatgaggtatcaaatgatcacataatacaaatttgattgatctccttttggatatatctccccttaaacattgtgctggctacactatccatttctataatacctttgattttatcctctttactcctaacagtgaattcctaggtaaagtcacaactgaatttatcagcacaagcatgctgcatcatgytgtacgttctgcaaacagtaacttgagatagtgtgtcatttcccagttcttaaggctgtggcctacaccaatggtcttattttcccttttgattttttcaaaattaactgttattttgccaataagtttaacatttcattgcagcaattattacgtgtctggggttatgcaacacatgggatgtgcagaaataaaaagatagtttccctgccctcaaggagcttgtcttataggggaaacagatacataaacacttctagggcacacagattttcatgtatgtgtgtactatggtgttaa

SEQ ID NO: 59484 - DNA, 601 bp, Human
gcacatatttataatcagtgagtcaccctcctagactgtaagcaccatgagggcaagatctgcagcccaccagcagcctctgcttccagcacagcacttggcacacaggaagcactctcttagtatttgttgtacttgtcagtgtttgttgcctgaatgacacagaagtgttccctgctggagaagggattcgagttaaatggaatcatccagagaatttgataaaatgatgatggctatccgtttatgctcttaaaagtatgcacttgagacctctaagtagatgtttatttgtttatcyctttccagggttcatgtgtttatcttgtttccttttgtatgcattttctgctttgcccctcacatagtaattcttggaagcaagtagatcattgtttccatttcagttgagatcactttaggggcatgtcttggacttgatgacagatcttccactatcttatgctccctacctcacatttattgagtacctactatgtaccaatccttaacatttgttattccagtttatcttccatcagtcctgttgaggtagatattgtgccccattttacagatgaggaaatcaaggttctgagag

SEQ ID NO: 59485 - DNA, 601 bp, Human
ctgccctccagcctgggcaacagaacgagactccatctcagaaaataaaaaaaaaagaaatgctggtatgtccaagtctgtgttcactcttatgttcatggttgttttacaaaagctgtatttagcaagcactcaatggcaagttatgccagcactgtgcttggcataacttggatatataggtgaatgaggcagccatacagagaaatatgacaagagtatgttttaaatgccccaaagaaggtttatggaaggtgctacaggaatgtggagctgggaaaataaccatcatttatatagygctttatatgctgtctcttgcttttatatttgcccccattgtattgtctttctctctcacctttcctccacgtctcctcccctctccggaatttcaggatttggatgcatgtgtacatttaagatttgttctaaatacttgaaagcacgcttgcttgttagttacctgtccaaagcctgttgactgctgggccccagaggaacactagcatgtgcccttgccccgcctgtttctttgtatacaaacagtatacaaaacatagagaagagaactgacagatatttagatctatgggctttt

SEQ ID NO: 59486 - DNA, 601 bp, Human
aaataaccatcatttatatagcgctttatatgctgtctcttgcttttatatttgcccccattgtattgtctttctctctcacctttcctccacgtctcctcccctctccggaatttcaggatttggatgcatgtgtacatttaagatttgttctaaatacttgaaagcacgcttgcttgttagttacctgtccaaagcctgttgactgctgggccccagaggaacactagcatgtgcccttgccccgcctgtttctttgtatacaaacagtatacaaaacatagagaagagaactgacagrtatttagatctatgggcttttatagaaaataagaattacttttcttctgtaaggtcagtgtttacaccttgtctgcttgctccatactcctctagagactaaaacacctcattgcttctcagaatcatttctgaaactgaggctagaaattacaacagagactctcttctcacctcttcaccagcatcccttgcctcttaaagtcactgaaagaatatcccccctcccccatggaggggtcataacacttttttgtctgtctattccaggaagctcgagtgctttacaacgctttaccca

SEQ ID NO: 59487 - DNA, 601 bp, Human
accgctacactccagcaggagcaacagagtgagaccctacctctgaaaaaataataataagaagaatcacatggatgaagcaaatgatgataaccaaaatataatgtatgggagatcactttataaagatgtaaggctatacaataatttaacgtgtttttgaagtaacattgcaattcctaaggggaccaaaatgaatggttggtcttaatgggctttgtctgaaaattgactggaacaattgcttccaaacagaagatacttggaatttcatatatggaatatagatgagatggttggyatttgaccatttaattttatcagtcaatataaaatgatctatattattcttaattttcacacttttccatatttctaatcctaatatactcatttgttgccttttcccacttaattgtataattgcagttcccatgttgcttataatagctgcataatatttcagtcactggtttacataatttaccatcttcttattgctgtttctatttgtgtgtgtgtgtgtgtgtgtgtgtgtgtgttacaaataacacttccgtacctatagctgtttctttttcttttcctttttttcccccta

SEQ ID NO: 59488 - DNA, 601 bp, Human
taataataagaagaatcacatggatgaagcaaatgatgataaccaaaatataatgtatgggagatcactttataaagatgtaaggctatacaataatttaacgtgtttttgaagtaacattgcaattcctaaggggaccaaaatgaatggttggtcttaatgggctttgtctgaaaattgactggaacaattgcttccaaacagaagatacttggaatttcatatatggaatatagatgagatggttggcatttgaccatttaattttatcagtcaatataaaatgatctatattattctkaattttcacacttttccatatttctaatcctaatatactcatttgttgccttttcccacttaattgtataattgcagttcccatgttgcttataatagctgcataatatttcagtcactggtttacataatttaccatcttcttattgctgtttctatttgtgtgtgtgtgtgtgtgtgtgtgtgtgtgttacaaataacacttccgtacctatagctgtttctttttcttttcctttttttccccctatatttaggggttgttttcttagggaatatttttttctgaatgcgtgaggaa

SEQ ID NO: 59489 - DNA, 601 bp, Human
ggggttgttttcttagggaatatttttttctgaatgcgtgaggaacttaaagtttattctataagcatttattcagcatctactgtgtacagggccctggagatacagagatgaattttagaacctgtgcacaagctgtctccatttcctggactctcttcctccctctcccttcacctgacgaattctccatttaaatcccactttgccaatgaggcctttatgtattccccagagtattttaggcttttctgtactttttcttctcatttagtcacagttatattgtgtacatctcagrataactaagattacttcatttttgccttcctcattagactattaaacagtaaactctgagaacaggttttatgtctgatttattttccttggtaccctcagtacctgggacattatgtctggcatataccaggcacagaaattcaaatgagtacttgcataaatgaattagatgaacaaatatttgaatatgattcttgccttgagaaatttagattagaactgaaaaatggattcaatggataatttcgatgatgtgtaagtgctttatagaaaatagaaaataaaccttttcctagct

SEQ ID NO: 59490 - DNA, 601 bp, Human
caaatggaggatttttttttaaaggatgatcatcaaataaatattttaagtaatttgaccaaaatttatcttcttacctttttactaaaaatatacactaaataattttaagggaagattttatagtctcatattcaacatggaaatttcttgattagtattgccctgactttattggttgcttcacgggtggcttctgaattcatttcttggaatgttactattcagggccaactttgttagtattgctacgttgtgatttaattttttgccacttacacattctagccagtctggaagwtctccaccaaaacacctgtatagttcagtctgaatttagaagtgtcacttgcaagagaggcagcaacgtcaggcccgtgagactcaagagaagtctctttccatgatagatcttcttatacttggtagaaactggcaagtgactcaccaggggtggaagcctggaaaacagcctgccgaggagggtagtctttctggtaacacatcgccacccctttgaagcatccagagaaccggaagagcaggaactgcctgtcagactgactgagcgcttggcattctttcatggaaagatgacaac

SEQ ID NO: 59491 - DNA, 601 bp, Human
aaatgattgctgtgaaaaataaaatatttcacattgcaggcctcatttttaagttatttttcccagagaacattttcatattttagaacttatggtaatgttaacactttctatttgcataagcacttccctgttgggagatactgcaggtgtaagtttttctgaggagtgtcataccaccatggaactattttccatcgatctggagatagggaacttcttgtatactctgagagagaacttctttgagatgtaaactagactgacctactttagaggctgcctgtatcctaattttctrttttaaaagagtgatggctgaacactgaaaagctcgggacattttagaactgtgctgcccaatatggtggccactagccatatgtggctatttaagtttaaattgaattaaaataaaatgaagtggaaaaaattaagttcatcaattatattagccacatgtaactgatgactagtggctacctaccatatatagaacatttctattattgcacattattctactggacaatgctgttttaggatgtagaagtcctgatggataatatcaaagccaccttaccacagacagagttttaca

SEQ ID NO: 59492 - DNA, 601 bp, Human
agctgtgaagtaattcttactgggaacaccagatacttacttaccattttatatagcgtatgtggcattctctcatcttatcattagagcatgcctgtatctttagcgacaatagcattcaaacaccaaatgttatattgtctgtctggaaatgttttcttatacaactcaaaggggaagagaggaatatgtcgtgagtaaatggaattatttttctctgcaccacatcattataaaaactcgaagaggttgggtgcagtggctcacgcccatgatcccagcactttgggaggccaaggcaggtggatcacttgaggtcaggagatcaagaccagcctggccaacatggtgaaatgctgtctctactaaaaatataaaaattagacgggcatggtggtgggcgcctgtaatcccagctactcgggaggctgagccatgagaatcatttgaacatgggaggcggaggttgcagggagccgaagtcgcgccactgcactccagcctgggtgtcagagtgagactccatctcaaaaaaaaagaaaaaagaaaaaagaaaaactcgaagaggctaaaacgtatcctggaactaaatatttacatt

SEQ ID NO: 59493 - DNA, 601 bp, Human
aggactttttcttactttggcagactggagacccagagctcagagaaggcagaaagtgtgttaaagaacaataggaaaagtggtgagagacaggcagatgaaggaagcatgaactaccatcacagagaaagggtagagtcagcaggtaattctcaaagggatgtgcatctgcccctaacccaatctaaatgcctgactcaatgtcctcagaggacacgaaccctggaaaacaagtatgagatgatactactcaggtattgcgtgtgtgtgtgtgtatgtgtgtgtgtgtgtgtgtgtgtggcagaggtcagccctgatgtaattgccaccgaggtcaccgtggatgaggtcattgtgggtgaggttacagtgcaagagctgtcttttggtgctgttctggtcttgtgatttccctattttcagcacccagtaggtaggtgctcaataaatgtttgttggaggaatgggtgctggggccagccccctaactctggcctctgttggacgttttgtgacctggaatcattctagaaggaaagagactgcccagagtggatttgtgtcctgcttgtgactttcttggtaacaactacaatgaata

SEQ ID NO: 59494 - DNA, 601 bp, Human
caaagggatgtgcatctgcccctaacccaatctaaatgcctgactcaatgtcctcagaggacacgaaccctggaaaacaagtatgagatgatactactcaggtattgcgtgtgtgtgtgtgtatgtgtgtgtgtgtgtgtgtgtgtgtcagaggtcagccctgatgtaattgccaccgaggtcaccgtggatgaggtcattgtgggtgaggttacagtgcaagagctgtcttttggtgctgttctggtcttgtgatttccctattttcagcacccagtaggtaggtgctcaataaatgttkgttggaggaatgggtgctggggccagccccctaactctggcctctgttggacgttttgtgacctggaatcattctagaaggaaagagactgcccagagtggatttgtgtcctgcttgtgactttcttggtaacaactacaatgaatatgctccccaggctcttaatctggagaactcctttttttttttttttttttaaacagtctcgctctttcacccaggctggagtgcagtggcgcaatctcggctcactgcaagctccgcctcccaggttcacgccattctcctgcctcagccttc

SEQ ID NO: 59495 - DNA, 601 bp, Human
tgacagggaaaaggccctgtactgccatgtcctcccctctggctgcttcatgccgggtcttctgcctaatacctgacacaaggagactcctccagactgaactgcgaggaaaggctttacaggcagaacaggctctgcagagttgctgctcagtaggccaggggtcagcagacttcatgctgtgtgccttaggccacatgagtgatcctcctgtagatatttcccatcagtgaaaacagagctggcactgatcacctcctctcttacagactgcggagctaaagtgggctgctggttggartgtgctgtgaaagttggaatgtttttgcaaattttattttattttttgaatttgaagtagaaagctgtttgattataaatggtgacttttcccttctaaaatcatttaaaatttttgtaccctttgaaaatgacatttaattataggcactcaaagtgcagttgacaattattgttatttttggggaattgtttaaaggatgttcattcatgcatgcatttttttcattatttacttattcagaaagatgtggaagtctaatatgtgccaggcactgggaaacagtgatcctgctgctca

SEQ ID NO: 59496 - DNA, 601 bp, Human
ttggcctcccaaagtgctgggattacaggcatgagccaccatgcttggcctgtccaccaaagtatgaactcattgcagcattaatgagtccgcaatccaaagtctcatctgagacaaaggcaagtcccttccacctatgagcctgtaaaatcaaaaacaagttagttacttctaagatgcaatgggggtacaggcattgggtaaatgctcccactgcaaaagggagaaattggccaaaacaatggggctacaggccccatgcaagtccaaaacccagcagggtagtcattaaatcttaaasctccaaagtaatctcctttgactccatgtctcacatccagggcacaccgatgcaaggggtgggctccgaatgtcttgggcagttctactctgtgcctatgcagggtacagcccctgcgactgctttcgtggcgttgagtgcctgtggcttttccaggtgcaagatgcaagctgtcagtggatctaccattctggggtctggaggacaatgtctgtcttcccacagctccactaggtagtgccccaatggggactctgtgtgggggtttcagccccacatttcccctttgcagtgccctca

SEQ ID NO: 59497 - DNA, 601 bp, Human
aagtgacaatggaaggaagggaattttgaaaacaaagtttggatagattagtgggaaggcagcaaaaggggagcccaagtggtcctgaaagccaggtggagcagggtgttttattctgaagactctcggagaccagcggaggctttagagggggaagttgatgagatcagcactttagaaaaggctgctttgtttttggtggggtgttccatgactgcaggagaaaggatgagggaggaggcctgcagtgacagggatcctagaatgatggagggaacgaagggaaaaacagatggtcacrgtgcctcaagtcggagtggctccaggattttaagcctgggaacgcagaagaacagtggttctagtgattcagtgatgaccactggaagctttaggaggaaacatgggattggagccctttaaagctggaattggccccttagagagaatctggctcaggcttcccagatggtggtccgtggtctggctatatcagagttacctacagaacttttaaaaacagcagatgcctagaccccgttcccttgccccagaaaatttaaaatcagtagatcacctgtggggtctgggaatcttatat

SEQ ID NO: 59498 - DNA, 601 bp, Human
agcacggatgttagaaggcatagagggatgtgataattgttgtcgaatatttgacctattctctttggctgacaatttgaatatgttttttgagtgcaagtgatagaaacccctactcaaactggctaagacaaaaggaatttataggctcaaataacaaaaaaaaatcccaaagaatcaagcaaggcttgatctaagggtttaaatgatgttacgaagagctgttctctttctgtccctcagctctcccctctttgttggcttcattctgtagctcagtggggggacaacacaggtgccrgacactcccaagtttgtgtccttccagattgaagtttagcagaagcgagatcttgtcccttccttgtagatccaggattcctagttggacctacttggatttttgtgctcaaacctgaaccagtagatgctgataccgggtagggagttgtaattacactgatagccagagagaaggaatgtgcctgccccaggccagctgtgcagagttcagtcagtgctctgatctgctaggcctgctcacatgtccactctggagttaggggcagaatcccagatgagccatttggactacatgtga

SEQ ID NO: 59499 - DNA, 601 bp, Human
ggtgatttatagtgtggtaaccacattggtaacaggttttatgcagagaaagggtgggttgtaagaataggttgttatacaggttaagctttctgaatctgaacaaagcaggcatcttttattttgaaaaagtatataatcagggtgtggtggtgacctagggtaagtccagtgcatttttgggggctttgtcatgggtagatacaataaattttaaaaaagtaaacagtactgttaagaatctttgagattggctgggcatggtggctctcgcctgtaatcccagcactctgggaggccraggcgggcggattgcctggtctcaggagttcaagaccagtctgggcaacatgcctctctaagccaggcatgatggcatgtgcctgtggtcccagctacttggggggctgaggcaggaaaatcacttgaacccaggtggtcgaggctacagtgagtcatgattgcagcattgaagtccagcctgggtgacagagggagactctgtcttaaaaaaaaaaaaaatctttgagatcatatgtggaggctgtgttagaaacgctaggccaatgccaggcacagtgactcacacttgtaatcccag

SEQ ID NO: 59500 - DNA, 601 bp, Human
taattaagagtagcagtccgacacagtgtctcacgcctgtaatcccagcactttgggaggctgaggcgggaggatcatttgaagtcaggagttcgagaccagcctggccaacatggtgaaaccccatctctactaaaaaatacaaaaacagatcagatgtggtggcacacgcctgtaatcccagctactcaggagactgaggcagaattgcttgaacctaggagatggaggttgcagtgagctgagatcatgccactgcactccagcctgggcaacaaagtgaaactacctctctctctcwaaaaaaaaagagtagtgaatgcaaggctcctaaacttccttccctagtgcttccttaagattgaccagactttggtggaaatatgtagcagagactctttatactttttactccataaaactaaagatttgcagttgaccaagccacatgtgttcattaccttgtatgttgccgttatttctctatttcatattcttgccatgtggtttagtaaaatgctgctcttataagccatatgcataagatatggaggtctcaaaaacaattaccaagtatgtggatgtgcctgtctatattatg

SEQ ID NO: 59501 - DNA, 601 bp, Human
aattaagagtagcagtccgacacagtgtctcacgcctgtaatcccagcactttgggaggctgaggcgggaggatcatttgaagtcaggagttcgagaccagcctggccaacatggtgaaaccccatctctactaaaaaatacaaaaacagatcagatgtggtggcacacgcctgtaatcccagctactcaggagactgaggcagaattgcttgaacctaggagatggaggttgcagtgagctgagatcatgccactgcactccagcctgggcaacaaagtgaaactacctctctctctcamaaaaaaaagagtagtgaatgcaaggctcctaaacttccttccctagtgcttccttaagattgaccagactttggtggaaatatgtagcagagactctttatactttttactccataaaactaaagatttgcagttgaccaagccacatgtgttcattaccttgtatgttgccgttatttctctatttcatattcttgccatgtggtttagtaaaatgctgctcttataagccatatgcataagatatggaggtctcaaaaacaattaccaagtatgtggatgtgcctgtctatattatga

SEQ ID NO: 59502 - DNA, 601 bp, Human
tctcatcttttgtagttcatatgttttatgtcttcagagatctctctgtcataggatcactaagatattctcctgtttctttttttgttttttttttttaagaagcaaatagttttaggttttatgtttaggtctgtatgccttcttaaattgatatttgtgtgtgatgttacagaggagttgaaacattttttttcaatacacgaatgcagttgttctagcaccatttattaaaagtctcccctggccccttgaatcaccctggaacctttgttgaaaatcaattgaccatataatgtgrgtctgtttctggattatctgttctgtcctgttgatctgtttgtccatctgatctctctttcttttctctacattatgccagtattacactgtctcattactgttgctttatagtgagtcttatggttacatagtatgagccctccaactccgttcttttttgtatgtttaaggttattttagctattctcagtattttgcaatttgatatcagttttagagtcagcttatatatttccagacaaaatcctgctgtattttgaattgaaattgtgttggatctatagatcggtttgagggg

SEQ ID NO: 59503 - DNA, 601 bp, Human
atataatgtgggtctgtttctggattatctgttctgtcctgttgatctgtttgtccatctgatctctctttcttttctctacattatgccagtattacactgtctcattactgttgctttatagtgagtcttatggttacatagtatgagccctccaactccgttcttttttgtatgtttaaggttattttagctattctcagtattttgcaatttgatatcagttttagagtcagcttatatatttccagacaaaatcctgctgtattttgaattgaaattgtgttggatctatagatcrgtttgaggggaattaacatcttaacaatcttgagtatctttaaacccatctgtagtcaaattagtcaattctgtagtccgtggacatggtctttgctcgtaaggcatagccagtgtgaggtttcagtagaaatcccaaggtgttttaagcccattaattttatggcactcaagcttctaactctttctcctatgggtgggaaacagctgaaatctcagttcctatctttcagcatcctagctcttgctcctgtctggacctcttagagtttcccttgcacatgcacagtttaggaagatg

SEQ ID NO: 59504 - DNA, 601 bp, Human
tggtaattccatctttgctttaagctagtcctttgtctctgcctacagttgtcccttactgcagcaagaagcccagtggtccctgtccagaaagagttgctgataaggaaaacagttaattcataggctaattcacactacagtgatagagattgatgtcatagtactctattcctcttaggtgtgtttgcatattttaaaagatgctggaagagctgctttatccatgagaaatagacttttaatgctaaaattttaatattgaaatctacgggtggggtatattttaggaaccccatawctgttctctgtgtctctgtgcgtgcattgctttttcattttggctcctagactggggctcagcttgagcttgcacgttgctgctgcctttaaaacaccgctcccttgtcacatgcagaggacgtgatggctgcctgtctgtgttaagtaagaaggaaatggagccccccccccccccatttgcctgccacagctgtggcagcaacctggacctggcactgagagcatgtccctagcttgacctcgctcctggaagccaccttagattatgtccagccataatatgacaggttggctggtg

SEQ ID NO: 59505 - DNA, 601 bp, Human
ctgcagtgaggggtcttcactgaacttagatagagcaagaaaaactcttttacattcattgctttgtggaagtctctcacagagctcaaggcgtataaaattatcaactggatcagaaacccctcaccactgttcatcttgttaaaggtgtcactctgcatctgtgcagaattcccctaggcactgaggcagaagtagaagtgatttattattttgaaaaagctgcctaatgtcaatctttattctaactaagccttcctgaagctaagaactggatctgaagtctgatcaaattgaaatktattatagtgatgaaacagccctggatttttaatgcagccttcagattccatcattgttgccatgtgtgtgattgtcactatgttggactaatttttgtctggaagagtggagtagcaaaaaaaagaatagattgaaacaatggaaactgaggaaaatgcattaaactaaattcataactgctttaattggaagagaaacaacagaaagaaattaaagtatgacatcatcttatgtgaggacaaaaagatgtagctggattattatgctactaagaaatatggtgtaagattttacgatt

SEQ ID NO: 59506 - DNA, 601 bp, Human
ctatgttggactaatttttgtctggaagagtggagtagcaaaaaaaagaatagattgaaacaatggaaactgaggaaaatgcattaaactaaattcataactgctttaattggaagagaaacaacagaaagaaattaaagtatgacatcatcttatgtgaggacaaaaagatgtagctggattattatgctactaagaaatatggtgtaagattttacgatttgaagagaacatagtttgcagtaaatgaagtttgcttggactcagggaaccacaaacttaaatggttggcccacaaatraaaaaccagacatgatgtgtctcctgatggaagcccacacaacatcgtgatcttgccaaaaagtagaggtagttttgcccaaaactcaagccttagaccagtcaggcttccagatccaaccaccagttaagaggaaatataggggacagaggagcattttaagttacaccatgggatgtaatcagcaaaatccagactgtggaaaaattttacaggaaaagagacttggtttcttctaccaaacattggaagaaaaaagtaaaggaaagagaaccaaagtaacaagagagaggcatatta

SEQ ID NO: 59507 - DNA, 601 bp, Human
ggtgggcagaggagatgggatagaattgaaacccgattagccatgagttgtttactgaagctgggtgatgattatatgttgcatgtggtttattatagtattctacttttgcatgtatttgaaattttcattaataagttaaaaagtaaaataaaatgacaaatttcaagaatatctgcttcttaaacaaaaaccagaatctgggttatgacatcaaaatgatgcttgaacttgaacattttacctctttccacttacaaattaaagctggagggttttttaatgtatatgttttatccaygattctcagtttttatgtatgatgaaaaagtaagttaaaaattttaaatgactaaagtactgtgcttcagaaagacttttttaaattgctaaataaataataagctgtgagtcaaaaactgcaggtaggaacaggtgagtaagataattccttttgttccgtcataaagttctcactcacagtgaatgacaagtagattatctcctactaacaattacataacattttgcagttgcgaagtttaattttaaggtagtttcctaaaagaataaagtaaatcagaaggattaatggtagaag

SEQ ID NO: 59508 - DNA, 601 bp, Human
aaagacttttttaaattgctaaataaataataagctgtgagtcaaaaactgcaggtaggaacaggtgagtaagataattccttttgttccgtcataaagttctcactcacagtgaatgacaagtagattatctcctactaacaattacataacattttgcagttgcgaagtttaattttaaggtagtttcctaaaagaataaagtaaatcagaaggattaatggtagaagtatctttataaagatagtaagaaaaaggttcttagtgtacttgtttcttccccagagttcccaaggcaaayataaaggtattctattttgtacaagtttttggggaaggaaaacttcctcaaaaacaaaaccctgacaaagaacctgttatttgtgaatttgaagcttgtttagaaaaaaaaggccttttacttctgctaaaaccttgaattgttccttatttgagacatttaatatgtaacttggaaaagatatacatttgtcctggggagacaatggaaaggcacttgaattttggcatctgctttttctctctactaaggcagtgcacaatggtgcagaataagagtctgatctttttctttttgtcc

SEQ ID NO: 59509 - DNA, 601 bp, Human
caacattacagtggcttgaatacagaagcagatatgagaatctagctgtcaggctgggcgcagtggctcacgcctgtaatcccagcactttgggaggccgaggcgggcagatcacgaggtcaggagatcaagaccatcctggccaacatggtgaaaccccgtctctactaaaaatacaaaaaaaaattagctgggtgtggtggtgcgtgcctgtaatcccagctactcgggaggctgaggcaggagaatcacttgaaccagggagtcagaggttgcagtgagccaatattgtgccactgcmctccagcctggtgacagagcgaaactctgtctcaaaaaaaaagaaaaaaagaaaaaagaaagaatctagctgtctttttttttaattaattaattaatttatttattttatttttatttattattattagactttaagttttagggtacatgtgcacaatgtgcaggttagttacatatatatacatgtgccatgctggtgcgctgcacccactaactcatcctctagcattaggtatatctcccaatgctatccctcccgcctccccactagctgtcttcttttaagtcagacattaaa

SEQ ID NO: 59510 - DNA, 601 bp, Human
agaagcagatatgagaatctagctgtcaggctgggcgcagtggctcacgcctgtaatcccagcactttgggaggccgaggcgggcagatcacgaggtcaggagatcaagaccatcctggccaacatggtgaaaccccgtctctactaaaaatacaaaaaaaaattagctgggtgtggtggtgcgtgcctgtaatcccagctactcgggaggctgaggcaggagaatcacttgaaccagggagtcagaggttgcagtgagccaatattgtgccactgcactccagcctggtgacagagcgaractctgtctcaaaaaaaaagaaaaaaagaaaaaagaaagaatctagctgtctttttttttaattaattaattaatttatttattttatttttatttattattattagactttaagttttagggtacatgtgcacaatgtgcaggttagttacatatatatacatgtgccatgctggtgcgctgcacccactaactcatcctctagcattaggtatatctcccaatgctatccctcccgcctccccactagctgtcttcttttaagtcagacattaaagagatttgcaaattgtaaaataa

SEQ ID NO: 59511 - DNA, 601 bp, Human
gccgaggcgggcagatcacgaggtcaggagatcaagaccatcctggccaacatggtgaaaccccgtctctactaaaaatacaaaaaaaaattagctgggtgtggtggtgcgtgcctgtaatcccagctactcgggaggctgaggcaggagaatcacttgaaccagggagtcagaggttgcagtgagccaatattgtgccactgcactccagcctggtgacagagcgaaactctgtctcaaaaaaaaagaaaaaaagaaaaaagaaagaatctagctgtctttttttttaattaattaattwatttatttattttatttttatttattattattagactttaagttttagggtacatgtgcacaatgtgcaggttagttacatatatatacatgtgccatgctggtgcgctgcacccactaactcatcctctagcattaggtatatctcccaatgctatccctcccgcctccccactagctgtcttcttttaagtcagacattaaagagatttgcaaattgtaaaataatgccactctctctatctttggggggatgtttgaaaatgtagttatattttattaaaatgtgtatactaacatg

SEQ ID NO: 59512 - DNA, 601 bp, Human
catgctatggagaaaataaaacagagtaagaggacagagatgggtcctatgtgtatgctgttttgttcaaatcagatggtcagggaaggcccctctgatgaggtatcatttgagccagaggtctgaagaaagggagggagtggaccttgagtctgtctattgggatggggaacaggaagtgcaaatactgtaagggttgcagcagggagaggagtgtagctgggccttgaggtcaggggaggtgcccacatggttgttggcacaactttggtgccctgctaatgtcactttcctcttcaataatacccttgtcacttaagtgatgttcacttatgcttgctgctggcttaccatttggctcactgagcacgtcttttcccctttggttaggggcttgaagagcacagcatcacatctatttatgacttgatgtattttgctaatgcggaaaccattccaaattcatgataacaactttctccagttctgtgaattccctcatggtttctttttgttctaagccaaattaggagccaatccccagcttaataagcattaaaagttcaaattgactgtctggaaatctataacaagtccatgc

SEQ ID NO: 59513 - DNA, 601 bp, Human
atgctatggagaaaataaaacagagtaagaggacagagatgggtcctatgtgtatgctgttttgttcaaatcagatggtcagggaaggcccctctgatgaggtatcatttgagccagaggtctgaagaaagggagggagtggaccttgagtctgtctattgggatggggaacaggaagtgcaaatactgtaagggttgcagcagggagaggagtgtagctgggccttgaggtcaggggaggtgcccacatggttgttggcacaactttggtgccctgctaatgtcactttcctcttcaagcatacccttgtcacttaagtgatgttcacttatgcttgctgctggcttaccatttggctcactgagcacgtcttttcccctttggttaggggcttgaagagcacagcatcacatctatttatgacttgatgtattttgctaatgcggaaaccattccaaattcatgataacaactttctccagttctgtgaattccctcatggtttctttttgttctaagccaaattaggagccaatccccagcttaataagcattaaaagttcaaattgactgtctggaaatctataacaagtccatgca

SEQ ID NO: 59514 - DNA, 601 bp, Human
attcatcgacaaagactgaagcttaactctaggagggaactgtattgatttccttaaacatactaaggaatggcaattcagtaggactctgctgtccccttccagcccctcctcagtgaggacctggtggggacactcagccagagtgtgaaaggaacagcttcagggccctgctcaaatgtgtctgggagctgtcactttttccatgcctctttctcgggtgttggacgtcctcatttgagacttttaattcctacattcttggtctttgcctctctgaatgcttgaaggtcacacttargtacagcctttatagaaccttttgtctgatatgcagaatattgactgcatgctggctgtgtctgtctgtctgtgcctctgtctttctctagccagggattacagactgcccatgggctgaaatcagcctgcagaccagttttgctttgtatgcagcatggaataatgcttttgaggttttccaacttgagctcttcagacagggcagggttctccagtgtcccacatcccctgttgtctgaatttcctctgaattcacacctctatgcctccttctctggcctcagtttgcaatcctgaa

SEQ ID NO: 59515 - DNA, 601 bp, Human
tgcctctgtctttctctagccagggattacagactgcccatgggctgaaatcagcctgcagaccagttttgctttgtatgcagcatggaataatgcttttgaggttttccaacttgagctcttcagacagggcagggttctccagtgtcccacatcccctgttgtctgaatttcctctgaattcacacctctatgcctccttctctggcctcagtttgcaatcctgaatctgagcatttgtcccatgtgtttactgggcagtgtgcagtggccttgggggagactttgaaacatgttttartgagaaggatcacttctttactggagtcaaaactgaaaatactttcccttcgtggaataccatacaggcgtctctcttgcactgttcagcatcccatcctactcagtggcattcccactctaggttttgggtagtacagagtctcactgctttggggagcttttgggggcatggtggagagagaaatctcttcattttttcaatttgtttggatcagaagattagcctgctttcaggtaataggtctacttttagtgatgcctacagttccctgaatgccccccaaaagttaatttctgg

SEQ ID NO: 59516 - DNA, 601 bp, Human
tctttaaaaagacaagtagaaaagtgaaaatggagaaaataaacaaaaagaccccagttggatttgaaacatgggttgcttttctatgactccatccttatgttacttcaaccgaacccatatgacctgaacctggcccctgctaatttatctgaaccataagctcctacttatcttctcagtgctctctctagcccagactgtggggtcatccctgcagtgctaactcagtgatgcccaggggtcacttgaccctttaatcttccttcatgcctgctgtgccaatgcctgacctgagcartcatctcacagatgattggatgttgctggctggacccatggcatataaatttttggcattaagcagatacttagcaaaaacggaagcattcttcttgtgttggtttctcagcaattctaaaacttttacacctgaaagccccttcccactttttttcccactcatgttctctttctcttactctgctgaaaaaatcctgcaagatctgccatctttatgtgcctgctgtccctcagtgtggccatctcttttcttcctttctgctggctgccagggaacctctcttcctacagaagctac

SEQ ID NO: 59517 - DNA, 601 bp, Human
gctgaaaaaatcctgcaagatctgccatctttatgtgcctgctgtccctcagtgtggccatctcttttcttcctttctgctggctgccagggaacctctcttcctacagaagctacaccttttcctgggtggatccatcctctctggcctcttaacacattctcacatgttcatttacctggactgaccacactttgtttagtcccttgctctcctttggctgcttctcctgtggtgatttaaacagaaaaaaaaaattcttcacctgatcatagtatcctcagctaccatcctatttctktcccccctttgcagccaactatcttgacaaacgttttgtatctgcgtctcaccaccaactttctactcagctcctgcttcgctcttgcccagacactttctaattacaaagtgtacctctcctttctctgcaatctttcgtgtgaccgtgatgctgcatttggttctgtttcatgttctccctttgggcacctcaaacgactgcaaacccttggcctctattctgagtggtggtccccagcaccccagctccttttctcccattcccttcagtgatgacaaccttcatcatttcttttta

SEQ ID NO: 59518 - DNA, 601 bp, Human
tcctctgtttccttcctgggctcttgtgttcttcactatcttagaagtgggcgcccattctcatagggcctttcatctgcagggacactctcagtggttaccttcaggccccatttttcctgtgagccctggttctgtgctgtctttcaaactcctctggctcagaccccagttgtcattttcctcccatatcagcactgtcttcactccatttctgtcattgccttcttctgaacactgaagcttgaacacacacattttccccacctacacattttgtctttcctactaacttaaaagyaatttgaagtgtgtgttctattgtgtacctgtgcacctctccctccccaacatggtgatatgtgagggtataaagtgaggcaaagaaaaggcaaaaagatgaagttcctgtcatttcccattttaacaagagttgcagagggtccccctaccccccatctcccacagcaactttgacattaagtgatcacttcaggggtggtatttgtggaagaggtttcacccacacttccatttccttaggagagctgaggaagggggttagccattgaaggatgaagatatgtaatcaatttaatga

SEQ ID NO: 59519 - DNA, 601 bp, Human
ctctccctccccaacatggtgatatgtgagggtataaagtgaggcaaagaaaaggcaaaaagatgaagttcctgtcatttcccattttaacaagagttgcagagggtccccctaccccccatctcccacagcaactttgacattaagtgatcacttcaggggtggtatttgtggaagaggtttcacccacacttccatttccttaggagagctgaggaagggggttagccattgaaggatgaagatatgtaatcaatttaatgaggactgtcatttggggattttacaggaatttttgacwgcatttactttaggctacactatgtggaatcttcctttccctttgggtagtggatcccttaatgccatatttgtctggttccatatctttcctgtcaccttcagttttttaaaaaaattgtgataaaatgcacataaaaatctaccttctgaaccatttgtaagtgtatagtccagtggtattaggtacactcacattattgtaaaaccatcaccaccatccatctccagaattcttttcatattgcaaaactgaaattctatacccattgaatactaattctccattccctctccctcc

SEQ ID NO: 59520 - DNA, 601 bp, Human
tctgccccttcctaaattcccattgtggtttcaaatgaagaggccattgttcactttccttcctaaaagaagcaatatatttaacttctggctctttgcctgactgatggcgagttgatctctctgaagccaacacccgtggcttcctatcaagagaaacactctgcctccatctgatttccttcttgggttgaagttatttagatcctacactggctcagtaggaggcttgcctgccgttatgtcctactaggtggtgacagggcccttgattccctccctgtgtttaatagaaataaaracagagtcttagcgctttagggcagctagttattctcccaaagacctattataggaatttaaaagcaaatgtctgatgtgaaaatctatgctattttagggactttgaagcacaacacaaaagagtatcactttgttgaatagtttgggtccaggcaggtgtcctagagcagaagttttcatttatttttaagcaacaaaattctttctttcccaaatgaaatctcctacagaatccaaatactgaagggtttctcaaccccagcatgcttggtattttgggccagataattcttgttgt

SEQ ID NO: 59521 - DNA, 601 bp, Human
aaatgaagaggccattgttcactttccttcctaaaagaagcaatatatttaacttctggctctttgcctgactgatggcgagttgatctctctgaagccaacacccgtggcttcctatcaagagaaacactctgcctccatctgatttccttcttgggttgaagttatttagatcctacactggctcagtaggaggcttgcctgccgttatgtcctactaggtggtgacagggcccttgattccctccctgtgtttaatagaaataaagacagagtcttagcgctttagggcagctagttrttctcccaaagacctattataggaatttaaaagcaaatgtctgatgtgaaaatctatgctattttagggactttgaagcacaacacaaaagagtatcactttgttgaatagtttgggtccaggcaggtgtcctagagcagaagttttcatttatttttaagcaacaaaattctttctttcccaaatgaaatctcctacagaatccaaatactgaagggtttctcaaccccagcatgcttggtattttgggccagataattcttgttgtagaagctgttgtgtgtgttggaagatgcttag

SEQ ID NO: 59522 - DNA, 601 bp, Human
aatagtttgggtccaggcaggtgtcctagagcagaagttttcatttatttttaagcaacaaaattctttctttcccaaatgaaatctcctacagaatccaaatactgaagggtttctcaaccccagcatgcttggtattttgggccagataattcttgttgtagaagctgttgtgtgtgttggaagatgcttagcagcattcctggcttctaccctccagatgacataagtggcacccacattctctagttgtgacaacaaaaatgtctccagacattgcaaaatgtccactggggagcamgatcacctccagttgagaatcaatgcaatataatctagaaaacagacttttaattaagctcctcctttagaactctgcccagggtccctgactgttagtgtttgagacctggtggggcgttctgggctacacagatgcactgtcctagagggttaagttgtcattttaaaaacctggggcatagagaacttgttataaacaaagcaaaagagctaaaattagacaaatccacaagtactttgaacccacatgtacactaaatatttctgtctatgtattatgtatacattgtgtacttgg

SEQ ID NO: 59523 - DNA, 601 bp, Human
tagagaacttgttataaacaaagcaaaagagctaaaattagacaaatccacaagtactttgaacccacatgtacactaaatatttctgtctatgtattatgtatacattgtgtacttggatgtgtagcataagggaagagtcgaagggtggtgtctgccttactccttatgtgttgaggtttggctaccacaatttgccctgttttgccagagatgccagttgaaggcctgtgactgacagcccagtgatagagtcaccctcactgcacaaaatactcagcttctgtgggactcagtggcmctggccctgctcatgggcattccgtggtgagtgggccagcacctgcagcctctttcaaccagactggttggttggagcttggaccatggttattccaaggtggatttttatccttctgccctttgtactaaatgggtcatgtgtgcctctgtacgtgtatgtgtgcgtgtatgtgtgtgactacacgtgtctgtgtctgctcttctcctttcagaagcccagagccactctgggcctggccactctgagcattggttgtgtgggggatgctgggagcttggcacatgctactcctccttt

SEQ ID NO: 59524 - DNA, 601 bp, Human
aaaagagctaaaattagacaaatccacaagtactttgaacccacatgtacactaaatatttctgtctatgtattatgtatacattgtgtacttggatgtgtagcataagggaagagtcgaagggtggtgtctgccttactccttatgtgttgaggtttggctaccacaatttgccctgttttgccagagatgccagttgaaggcctgtgactgacagcccagtgatagagtcaccctcactgcacaaaatactcagcttctgtgggactcagtggccctggccctgctcatgggcattccrtggtgagtgggccagcacctgcagcctctttcaaccagactggttggttggagcttggaccatggttattccaaggtggatttttatccttctgccctttgtactaaatgggtcatgtgtgcctctgtacgtgtatgtgtgcgtgtatgtgtgtgactacacgtgtctgtgtctgctcttctcctttcagaagcccagagccactctgggcctggccactctgagcattggttgtgtgggggatgctgggagcttggcacatgctactcctcctttttcctcccttagaatgatgaaagt

SEQ ID NO: 59525 - DNA, 601 bp, Human
ttactccttatgtgttgaggtttggctaccacaatttgccctgttttgccagagatgccagttgaaggcctgtgactgacagcccagtgatagagtcaccctcactgcacaaaatactcagcttctgtgggactcagtggccctggccctgctcatgggcattccgtggtgagtgggccagcacctgcagcctctttcaaccagactggttggttggagcttggaccatggttattccaaggtggatttttatccttctgccctttgtactaaatgggtcatgtgtgcctctgtacgtgtrtgtgtgcgtgtatgtgtgtgactacacgtgtctgtgtctgctcttctcctttcagaagcccagagccactctgggcctggccactctgagcattggttgtgtgggggatgctgggagcttggcacatgctactcctcctttttcctcccttagaatgatgaaagtgttgttggagcctgtcccacagacagaaactgtacctcatttatgtgggcatcagtataaacaagaacaataccactatgtgagtcaccctcacctgcggggagacgcataggctcagggagggaatttgctgcc

SEQ ID NO: 59526 - DNA, 601 bp, Human
tgtatgtgtgcgtgtatgtgtgtgactacacgtgtctgtgtctgctcttctcctttcagaagcccagagccactctgggcctggccactctgagcattggttgtgtgggggatgctgggagcttggcacatgctactcctcctttttcctcccttagaatgatgaaagtgttgttggagcctgtcccacagacagaaactgtacctcatttatgtgggcatcagtataaacaagaacaataccactatgtgagtcaccctcacctgcggggagacgcataggctcagggagggaatttgcwgccagagggtctcagcttcagtctgtctccccggcagactcatcctaacttcattccacagctcaagtgcagtgtgaatcagcaggcagcctgtgcctagctaaaggactctctctgtgttttgtttgtttggttgcttgtgaagatctctgggcacatacagcagtgttttattttcccaaaagatcgcatgaccactacagttagccttgggaacagattgagtaagcacaattcatttgatctatctgcagatctccagcccttctaagaagctcacttccaaaaatgtttcaggag

SEQ ID NO: 59527 - DNA, 601 bp, Human
tgtggtaagagctttggtcttggtgctaggggagctgtaaggagggcaccaagccttgacttgaagggattagggaggcttctccagtaaggcatctccaaagtaagtcattttagtgtgaggtggatgggagagttaggagaggagaggaagaaagagattagggcaggtgtggaccccaggctagacagggatggatgagtgataaggtcttgatagtgggtagtgccagatgcaggtgtatagttttgaggactttgccctaaggcctgaaggcagccattcaatgtttttgttttttgtttttttgagacagggtcttactctgtcacccaggctggagtacagtggcgcaacaatggatcactgcaacctcgaactcctgggctcaagtgatcttcccacctcagcctcatgagtagctggggctataggcatgtactaccatgcccagctaaatattttgtttttctgtagagacagggtctctctatgttgcccaggctggcctcaaactcctggcctcaagcgatcctcccctcctgccatggccttacaaagtgctgggattataggcgtgagccacagtgcctggccaatt

SEQ ID NO: 59528 - DNA, 601 bp, Human
ccccattttttttaaaagaagcagaaacattgcagtaggctaatcttattgagggcctggtttatacattatgtgtgtgcacacacgtatgcacacacccccacatacttgatctcattcatgcttatatctgtatttcttttatttttattttctttgatcctgtcattcaaatatccatatttcttaagaatgtccggtataaatttgctatgctacaaatgtttgattgaatgaatgaatgaagttgcccaaatttacgtgtgaagatgtgttggagcctaagttaaaattcataggygattccgaggcaaggccctttcacagcatcactcttacaccacagttgctacactgagatggcctttgaaaagcaggcagtcccactgaaccacagtatcctagagactaagaaacggggacaagagatctttaacttgcattttataattttcagtggcacatcaataatctgcagggatacactaataagatgggtattggacactcattacgacagaccctggaggatccaaaactgtaaaatctagctctgatctcctacaaatttttggtctacttgagggtaaaaggcagaaat

SEQ ID NO: 59529 - DNA, 601 bp, Human
tgagggcctggtttatacattatgtgtgtgcacacacgtatgcacacacccccacatacttgatctcattcatgcttatatctgtatttcttttatttttattttctttgatcctgtcattcaaatatccatatttcttaagaatgtccggtataaatttgctatgctacaaatgtttgattgaatgaatgaatgaagttgcccaaatttacgtgtgaagatgtgttggagcctaagttaaaattcataggtgattccgaggcaaggccctttcacagcatcactcttacaccacagttgytacactgagatggcctttgaaaagcaggcagtcccactgaaccacagtatcctagagactaagaaacggggacaagagatctttaacttgcattttataattttcagtggcacatcaataatctgcagggatacactaataagatgggtattggacactcattacgacagaccctggaggatccaaaactgtaaaatctagctctgatctcctacaaatttttggtctacttgagggtaaaaggcagaaatacacagacagttgaatgattgtgccagatcgtgacagttacctggagta

SEQ ID NO: 59530 - DNA, 601 bp, Human
tgggcaaatttttaaaaagtcagctcaggctgtttgcttcagagggtgcaagccccaatccttggtggcttccatgtggtgttgggcctgcaggtatacaaaagtcaagaattgaggtttgggagcctcagctgagatttcagaggatgtatggaaatacctggatgtccagtcagaagtctgctgcaggggcaaagccctcatagagaacctctgctagggcagtgcaaagggaaagtgaggggttggagcccccacacagagaccccaccgtggcactgcttagttcagctgtgagaaragggccaccatcctccagaccccagcagatggtaaatccatctgcttgcactgggcacctgaaaaagccacaagcactcaacaccagcctatgaaagcagccaggagggggatataccctgcagagccacagtggtagagctgcccaaggctatgggagcccaccccttgtatccacatgacctagatgtgagacatggagtcaaaggagatcattttggagctttaagatttaataactgccccactggatttttgacttgcatcaacctgtagcccctttgttttggccaatttatcc

SEQ ID NO: 59531 - DNA, 601 bp, Human
ggaaggaactaacttgattttgattttacaggcttataggcagaagggacttgccttgtctcagatgagactttggactgtggacttttgagttaatgctgaaatgagttaagactttggtgaactgttgggaagccatgattggttttgaaatgtgaaaagatatgagatttgggaagggccagggctggaatgatgtggttaggctttgtgtccccacctaaacctcatcttgaattctaatccccaagtattgactagagacctggtgggaggtgattagatcatggggggtggtttagtccatgctgttcttgtgatattgagtgagttctcatgagatctgttggttttataaggggctcttctcccttcacttctcccacacactctctgtctcacctgctgccatgtaagacatgcctgcttccccttctgccatgattgtaagtttcttgaggcctttccagccatgtgtaactgtgagtcaattaaacttcttttctttataaattacccagtctcaggtatgtctttacagcagtgtgagaacagactaatacaataaccatgttctcttctttctggagatctccagcca

SEQ ID NO: 59532 - DNA, 601 bp, Human
taaataacccaacttcctcacccgctgagggtgttcaaccaggtccttgaaattcccgacaggaatcgagcctcagttgcccaccctggaaacctgctcagtaatacgcttatcgttggtttccttccctttcctgtctcacttctgtaatcccctggtgcatctgggggttccttcccgaataaactacttgcaacttaagtccctatcttgaactctgctcctgggggaatccaaacaagaacaggtggagacagagtagaacaaggataagcaaagcaagagaggagatctgaagacrtctctaaggttgtttgagtgactccaaggatagtggtacaattagctaggagaaagagagggtggaggaggccgagaagagggttcagcccaacaaatgccaagttttaggtagcttggggataccttgaagagatgctgacaagctacttagaaataagtttattagctagaagccggagctggccaggcacagtggtatgcacctgtagtcccagctactctggaggctcaggtgggaggatggcttgagtccagaagctgtttgaggtcagcctgggcaatgtaatgagacctcatc

SEQ ID NO: 59533 - DNA, 601 bp, Human
cgtggatgctatgagccgtaggtcctactcaagagagtcagtctagtaacaaattattttcctctccttcttttgccatcccatttagtttgcaggatggttggtgtttgtgtgggctgagattcctcagagggaaccaaagccctgagaaacatgtgtagcagctgttgatttgggtctccacagtgagatccgggtctaatacagtgagtccaaccactttatctgagtttggaaataactatgagttacatagttaagctgttttcaaaaaacacagaggattctgtactgctagtgycattgagggggcttttgctgccatttattttcaacttatttttttgaggtggagtctcactctgtcgcccaggttggagtataatggcgtgatctcagctcacagcaacctctgcctcccaggttcaagcaatcctcctgcctcagcctcctgagtagctgggattacaggtgcccgccaccaggcctggctaatttttgtatttttaatagagatggggtttcaccatgttggccagacggtcttgaactcctgacctcaggtcatctgcccgcctcagccttccaaagtgctgggatt

SEQ ID NO: 59534 - DNA, 601 bp, Human
tgctgccatttattttcaacttatttttttgaggtggagtctcactctgtcgcccaggttggagtataatggcgtgatctcagctcacagcaacctctgcctcccaggttcaagcaatcctcctgcctcagcctcctgagtagctgggattacaggtgcccgccaccaggcctggctaatttttgtatttttaatagagatggggtttcaccatgttggccagacggtcttgaactcctgacctcaggtcatctgcccgcctcagccttccaaagtgctgggattacaggcatgagccgcyacacccggccttgctgccatttttaaataccaaaaccttttgttgcagtctttgtcacaggtgctggcacaaaattcctggtaccttctccctgctctaattcaccaagttctccttcctcttttccaaagactactaacatggaagtcttccttaattagttacaggactatatctgcaactcctgtgatttattcgctcagtgcccgtgtcactgtcacccactggtggggtgtgcttgttgtaaatacccatttaaatgtttacattttcaagtatataaaaccaggattgtaaaat

SEQ ID NO: 59535 - DNA, 601 bp, Human
aacccacttctggtgaggcagaccagggctccaggccagcacccctctggagattggaatgtgaatttccgtgctgggacacagagccagcttcctatttatttagagccattgggcacctaaggagccaaacagaagttgtgatgcaagttttggctgcagagcatgttagggttgcctgacgtgtctaactaaaacatgatctgagagatttctcaaagccctggttgatttaagcaccatagtattcaatagggtttttttttagtccttttaactcagtcctaagtaaacaggaggyggtgcaaacaatgaggaagttccctctgcattccgatggtgaagtggggttggagtctgtaggcaagtgaagagcgtgtgggagagctgtttccttttgctcatggcagcagtctagaacatggtgacagtgaaagtcattggaagccatgggggcccattttctttatgtgaccaaatgtcttgcaaagtcccaggtgtgtgtgtaggtgcatgagtgtgtatgtttgttttctaaacgaagcacacgtgcaaaataatgtaaaagggcagagtgaagtttgtccatgtccctgtatga

SEQ ID NO: 59536 - DNA, 601 bp, Human
ggctgtttgccaaagattacacctacctccaaacaaaaactgaggcaggtataattttaactgtgctggaatctctgaagatgttggtgtcttggccaaattcatttggactctttctgcatttcactctttgagatctattgtgtagactctaatttctttgacaggtattgtcacattggtctccacaaaaattattattgaaagccaggcatggtggctcacgcctgtaatcccagcactttgggaggctgaggcgggtggatcacaaggtcaagagatcaagaccatcctggccaasatggtgaaaccctgtctctactaaaaatacgaaaattagctgggcttggtggtgtgcacctgtagtcccagctgcttgggaggctgaggcaggagaatagcttgaacctgggaggtggaggttgcaatgagctgagaacacgccactgcactccagcctggtgacagagttaaactctatccaaaaataaaaataaaaaataaaaaattattattgaaataactacattttttttcttttttttttttggagagaaagtcttgctctgttgcccagctgaagtgcagaggtgcaatcatg

SEQ ID NO: 59537 - DNA, 601 bp, Human
ctagagatttggggcaatatcttactagacatacaactgaagcttaagtctcagtctcagtggcaaatgtaaaataaatttaagcagtagttatctttagtgataaattaagcatacttatttggaaagggaagaaagaaagatgccctcacacacccatctcagaaggagaaaacacagtttggtagcgtgaaaggagatctatatttttgttgtcaactttaattattttgtttagtgaaggcagaagcccttggatcagagcagtttctgaatgttgatcaattactttgtattttgktttctgtgattattttggattttatatcttcaacagtcagaacctagggctagttagtatttctgacatttttaatcaagaaacaacgattttgagatgctaaaccagctgtagatatgaagccaacaaatgtgtcataacatttattgtatttagggaaaaaattgtattacttttttttgggaaaaaattagcagccctggcgtctttgagttcacgtttcctctttgcatgaggctgcactcgacttagccacagccccacctctctgtggtttgctcacttgtgacctaagggtgc

SEQ ID NO: 59538 - DNA, 601 bp, Human
acctagggctagttagtatttctgacatttttaatcaagaaacaacgattttgagatgctaaaccagctgtagatatgaagccaacaaatgtgtcataacatttattgtatttagggaaaaaattgtattacttttttttgggaaaaaattagcagccctggcgtctttgagttcacgtttcctctttgcatgaggctgcactcgacttagccacagccccacctctctgtggtttgctcacttgtgacctaagggtgcttgcctcttgcagtgtatttcatgtcacacttttctgtttcytttacatgacctgccaggcccctgtaggcattagtggtgatggcccctgacctgaactgacattcataatggaaacttatttgatcatttcactgacttttttccaccagagaaacattaactgtacccaaccagcctttaacgctccccgcctccacacccatacactgtcaccctcatactctctctctcacacacacttaaaatattggtgtatatattaatatatatggctaagagtatggactctgacatccagtctcatcaccaactgggtgtgtgacttagtcaagttgcgta

SEQ ID NO: 59539 - DNA, 601 bp, Human
agcagccctggcgtctttgagttcacgtttcctctttgcatgaggctgcactcgacttagccacagccccacctctctgtggtttgctcacttgtgacctaagggtgcttgcctcttgcagtgtatttcatgtcacacttttctgtttcctttacatgacctgccaggcccctgtaggcattagtggtgatggcccctgacctgaactgacattcataatggaaacttatttgatcatttcactgacttttttccaccagagaaacattaactgtacccaaccagcctttaacgctccccscctccacacccatacactgtcaccctcatactctctctctcacacacacttaaaatattggtgtatatattaatatatatggctaagagtatggactctgacatccagtctcatcaccaactgggtgtgtgacttagtcaagttgcgtagcctgtcaatgtctcttcatttgcaaaatagacacaacaatcttattttacttgtataataaactttcatatagtacttaaagggccaggcactattgtgagcattttatattacaacttttaatcttcattagagccctgtgcagtagga

SEQ ID NO: 59540 - DNA, 601 bp, Human
atgaggctgcactcgacttagccacagccccacctctctgtggtttgctcacttgtgacctaagggtgcttgcctcttgcagtgtatttcatgtcacacttttctgtttcctttacatgacctgccaggcccctgtaggcattagtggtgatggcccctgacctgaactgacattcataatggaaacttatttgatcatttcactgacttttttccaccagagaaacattaactgtacccaaccagcctttaacgctccccgcctccacacccatacactgtcaccctcatactctctctstcacacacacttaaaatattggtgtatatattaatatatatggctaagagtatggactctgacatccagtctcatcaccaactgggtgtgtgacttagtcaagttgcgtagcctgtcaatgtctcttcatttgcaaaatagacacaacaatcttattttacttgtataataaactttcatatagtacttaaagggccaggcactattgtgagcattttatattacaacttttaatcttcattagagccctgtgcagtaggaacggttatcattagtcccttttatggatgaggaaactgt

SEQ ID NO: 59541 - DNA, 601 bp, Human
ttggccatattttagacaatgtaaaggggacgtttttatttctaaagccaggatacctaataaattttcattgtttaaagtcttgtctctgcagtaacatgagagtactaaaaggtaatgtgattttgtgagcatactcttaaattttgaagataaacttttgttttttacaatcctattgataatagatagggatgaaaagtagcacactgctgttttctctttttccccgtccagggaacataagctattatccaagttgttttttgaaatgttatgatttcaaaaaaaaaaaaaaaaagtgagaaatgttcaaagttaagctgtcagtgatcttgtaagttactacatgttatatttagttttcacaatctaagatgaaaccaatttactagtgtttctagcataattggaaagaaatacaatggcaggaatggaagaagagccctcagtcaggtggtttagccaggcccatcaggcttgcctgtcatttgggttcccccttaacctttgacatgagtatcatcacatagtttatacacatggtacctgtttcactatgtggatgattgataaaatagcaccacatatcctagagcag

SEQ ID NO: 59542 - DNA, 601 bp, Human
agttctctgggcactttcaatttggttctcctgagaattgaatctgatgaaagctagatttgttttaaggtatgatgctatttactgacatgtcacctctctttatgtagttaatcctaaaaccttccacatgtcttgaaagatcttaagatgatatacatttttatactgcttcattgcatgtgtttatcctttgatgacaagctcaactatctgcagtatatcacttatctagatgagaatgaaaaaaatgttattccgaaagttctaaatatttcaacagttgattaagccattcagsaaacatttattgaatgcctcctctgttcaaggcatcatgcaaggaattctgagggcattacaaggctgggtggaaggtttgaaatgaaggggcaggctaagggttgtgggagatcagaggagggcaggtggtttcagtctagaagtggggatggggtagagtattttcatggaagagacattttctgagttacatcttgtcctaaacttaagatttggttagttgataggcaaaaaggatatcccagggagagaacagggcatcgatagtttgttggaagggtccaggaagagcaaccca

SEQ ID NO: 59543 - DNA, 601 bp, Human
ttaatttcctagtgtgcacctgtgtcgtccataaacgctgccatcatctaattgttacagcctgtacttgccaaaacaatattaacaaagtggattcaaaggtaagaggatagcagtttgctgattaaatgtgcgtgtgtattgtgtatgctgtgtaccgccgtctctctccctccctccctcctttcctccccctcttttccttctccccgtccccaaacctctgctttcctccccctgccacctcccttccacattctttgaagccaagggttgtattagaatagaaatgtctctctcyctttttttaaattatggcatttatatttctgtatttatgtggcatcatccctcctttgtgaggaccccattagtggttggctgggtataagctatatggattggttctacttatttggagagacttttggcagagtgaaaggagccctgaacttggcatctgacagcctggatttgaatgctgaatccagcctctgttagccatcttctctatgagctgcggcaaggcctacaatctctcttttcctcagtcttaaaacaggatcaatgtttccctcacacagtttttgtaagttaaaca

SEQ ID NO: 59544 - DNA, 601 bp, Human
gagtgaaaggagccctgaacttggcatctgacagcctggatttgaatgctgaatccagcctctgttagccatcttctctatgagctgcggcaaggcctacaatctctcttttcctcagtcttaaaacaggatcaatgtttccctcacacagtttttgtaagttaaacaacatagaattgatgtgatacatatgttaataactgtaaattatgtttcctaagtaaaaagattgctggctttctccagcctcttaagaaatttcagggaagatgtctctctctctctctctctctctctctccgtgtgtgtgtgtgtgtgtgtatgtgtataagcttcaacatcattcttgccactcatattgcattcatctgcaataggcatacattttaaattctagaggtaaaagcagatggagtgttgctgacatttagcagtagatttgcagaggcattggaagaatgactctggaacacaatggttctttatagtacacatataggattgctaaagagtatacctagaggtataaaccacagcttttccaagaaagaggccataaaagtttcaagaggagtaatgattgccctactccttgtcatgc

SEQ ID NO: 59545 - DNA, 601 bp, Human
gaggcagaggttgcagtgagccaagatcgtgccattgcactccaacctgggtgacagagcacgactttttctcaaaaaagaaaagaaaaaaaagcagcaaaggagattttctaatgctgagatagaggtatacaattttagttttgctgtcgttgttgccttctttgaggtttgcaaggtatcggactccacagtacacatagcatttgctcgctgtgcattcgtctgttggaagtccttatttactgttgtaaaactatccccatttactgttggaaaactaactataaagaacagaaagtgttacttgctatgagaagttacagcagaaagatgcttactttttagctgcccagtgttgcaggccctggcttctcaagtaagatgctaatcagtgtgtaatgctgaactgtgacagtctcccctggagaatttaggagtgagagggggtgttggagccactctacctgcaaagcatttcattgtgagggcctttgtaaaaacagcactctcctcatgcagccctgtggaatcagtctctctgaagcccagagcagggcagtaactagccgaggatcccttagattgtaagtggcagaga

SEQ ID NO: 59546 - DNA, 601 bp, Human
gggtcaaatgagagaatgcagaatattttgtacagtgcgaagtgctgttcaaaagtgagtcagttcaactgtggtgatgaccccctccatcctcacaccaaaggaaaaatgtcccagggcttcccaatggccagcccagacacccacatggaggggacagcaaacattgagaaggtaagtattttataggtccttttgttcttggcaaaaaggaaatagtaagcaaatttcaaatatttgataatttatcaagattgctacaaaggtttatgaacccatagattatttcccctttttttttataatcatatacactgcttacaagtatataaatgggcatccttatctgtttctgatagcactgcaaatcctaatagtttgtgactaatttgataacctgtactaaaactcacaaaatgtatactcctggatctgtttttctgataatctggactacaaaaataatataaagaataaaatgttattcataaagatgtttaattttcagtgctttgtttatatatatttttttggtcaacatctctctaatcctccagcctctggtaaccactattctattctgtttctatgagtttggctt

SEQ ID NO: 59547 - DNA, 601 bp, Human
ataaaatgttattcataaagatgtttaattttcagtgctttgtttatatatatttttttggtcaacatctctctaatcctccagcctctggtaaccactattctattctgtttctatgagtttggctttatttgattacacatatcagtgagattaagcagcatttgtctttctgtgactggcttatttcaaataatacaatgtcctccaggttgatccatgttgcaaatgacaggatgtctttctttttaaaagctgaacagtattctattgtgtatatattccgttgtttctttgtccrttcatccactggtgaacacttaggttgattccatatcttggctattgtgagtaatgctgcagtgaacatgagagtgcaggcatcttttcgacatgctgatttcattttctttggatgtatatccagtattggaattgctggagcatatggtagttctattttaattttttgaggagcctccataccgttttccaaatgagtatactaatttacattcccaccaacagtgtacaagggttcccttttctccacatcctcttcaacacctgttatttttcatcttttcaataatagctgttc

SEQ ID NO: 59548 - DNA, 601 bp, Human
agtattctattgtgtatatattccgttgtttctttgtccgttcatccactggtgaacacttaggttgattccatatcttggctattgtgagtaatgctgcagtgaacatgagagtgcaggcatcttttcgacatgctgatttcattttctttggatgtatatccagtattggaattgctggagcatatggtagttctattttaattttttgaggagcctccataccgttttccaaatgagtatactaatttacattcccaccaacagtgtacaagggttcccttttctccacatcctcttyaacacctgttatttttcatcttttcaataatagctgttctgacaggtatgacataatatctcattgtggttttaatctgcatatccccaatgattagtgatattgagcattttttctatacctgttggccatttgtgtgtgtggttttgttttgtttttttttttacttttcatttatttttactttaagttctgggatacatgtgctgaacttgcaggtttgttacataggtgtacatgtgccatggtggtctgctgcacctatcaactggtcatccaggttttaagccccgaatgcat

SEQ ID NO: 59549 - DNA, 601 bp, Human
taagataggtgcaattattatcctcattatgtcaaatggaaaagtgagacactgagcagttaagtcatttgcctaaaatctatcacagaaaatggtaaaaataggaggttagaatccaggaaataatacagaggttatgatgatgaacagtctgtatccaagtcaggttctgcccaagatagtgaattggcagacccgttcccctccccagcctcaaaaaagactgccaggaaattatgccagtaagctatcagggactggattaaggtagtggaattatgaaggatttttttcctatttrccaaatttggtaataggattacatttcttcaacaatgggggtaggaggaataagccattattaagtcagggaccagacccctggtctctcagaacctgggatacggcctagtacatgctgtctccctgactcatttatggcgaaattcacatcacactccttttatctgaatcagtgagggttgtgtcagcagctgagtccctggcatggatgtgctggaatccaggcctcccatcccccatccccggctcgcaggggcctccccttcggttctcctcctggagagagaggaacaaagac

SEQ ID NO: 59550 - DNA, 601 bp, Human
ggcgaaattcacatcacactccttttatctgaatcagtgagggttgtgtcagcagctgagtccctggcatggatgtgctggaatccaggcctcccatcccccatccccggctcgcaggggcctccccttcggttctcctcctggagagagaggaacaaagactagggggtgagggatggaggggggctatcacaggaagggggagcagcaaagtaaatattggtctgaggctttgttcggagacccagtttatggaagcaaaggtttccatttggaaaacagaagacacttgtggccagtkcccgaaacagcctctcactagcaggccctgggactgggtgagagggctgagcgaagtactcctcattgttttgggaatgccttaagtttgagtttaggatccaccgctttcaggtgggctacaggacgctccgatgccggtcgcttttgcctcctcccgctcctctgcctgctggggcttctttacgatgtcagcctgcaaggatggagttcctggcaggaccatagctttccataagaaaccacttctcaaatggccaacaaagttgaaatcctggtttttgaaggtcagaatatcttg

SEQ ID NO: 59551 - DNA, 601 bp, Human
aggggggctatcacaggaagggggagcagcaaagtaaatattggtctgaggctttgttcggagacccagtttatggaagcaaaggtttccatttggaaaacagaagacacttgtggccagtgcccgaaacagcctctcactagcaggccctgggactgggtgagagggctgagcgaagtactcctcattgttttgggaatgccttaagtttgagtttaggatccaccgctttcaggtgggctacaggacgctccgatgccggtcgcttttgcctcctcccgctcctctgcctgctggggcktctttacgatgtcagcctgcaaggatggagttcctggcaggaccatagctttccataagaaaccacttctcaaatggccaacaaagttgaaatcctggtttttgaaggtcagaatatcttggaatcttgtgaaataaatgccatcgctgcatacatgctggcacaaaatgatctcacgtgtgctcagtgtacctgcagcttgagtgcaaaggaacattctttcctttgtattactttctccattgttgttgtattaaatattagcgaagaagtgggagaggcagagagcagccaggcagc

SEQ ID NO: 59552 - DNA, 601 bp, Human
aaggtagtcatgtggccctggaattcatctttcagaattttcccaggcagggaactgcactgtgaccttcagcacaagagctctgagttctaattctggcttagctggcccacttgtctttaagaagttcccctgccttttattttgagataagcctctccacctaaatgtgtgttccttatttctggacctgttggccaacgtacctttagggagtgcccctccagctggcttcaacatgtggggtcgtagcggggctgcagcctgccctgtccagctctgatgcttcccagcgcctccrgctcccctttcccttcctgaggcctcactgagcatttggctgagcccctgccagccgctggacgtggggaggagaaggcatgctcagaccctacagtggcattactgcttgtgctctgtgttgctgtgacacccagcgcaaggggaagaggccctgtgacagagggttagacaaggagaaggggaagtatagccgaaaggctgggagactttcccctttacaggcatgggaattctgaagaagcctctgttcatgccttggggtagttggttgattcctggggactgaatggtgcccact

SEQ ID NO: 59553 - DNA, 601 bp, Human
gccgctggacgtggggaggagaaggcatgctcagaccctacagtggcattactgcttgtgctctgtgttgctgtgacacccagcgcaaggggaagaggccctgtgacagagggttagacaaggagaaggggaagtatagccgaaaggctgggagactttcccctttacaggcatgggaattctgaagaagcctctgttcatgccttggggtagttggttgattcctggggactgaatggtgcccactttgcaggaggggatgagcgaagaaggaaagggcagttcatgagaccctagcatmtgtcctaggtgctcatattcattaccaatgtctatgaaactaaactgcacattggcattccgtaaatatccattgaacaaaatatctcatttaatacccaaagcatccagggaagagtatcatcctcattttaaaggcctagaaactgagatccagagaaattaaacaacttgccccagatcacacagtaagccagagtcagtgcatggattcctgacctgactgtcctgccaaataatatacaagccatttccattatatcacaaatagaagttttgagtctctaatatgtacaactga

SEQ ID NO: 59554 - DNA, 601 bp, Human
attcattaccaatgtctatgaaactaaactgcacattggcattccgtaaatatccattgaacaaaatatctcatttaatacccaaagcatccagggaagagtatcatcctcattttaaaggcctagaaactgagatccagagaaattaaacaacttgccccagatcacacagtaagccagagtcagtgcatggattcctgacctgactgtcctgccaaataatatacaagccatttccattatatcacaaatagaagttttgagtctctaatatgtacaactgagaatactgtcattagaygggaatagaggcagttttccacaataggtggtttttggccttttgggaaatacctaaggatatttcctctgatctgtttggaaccaggtttccccctttccctgagcagtggctgctacaaatacaatctggtttgctgcgggtcatttgttgcagtttgcctttggctcagatcaaaatagaaaatgagccagaacatggtgtttcctgtctctgcatgttcctaccttattcatagtgttccatcttttttttaggttattaattgtggatttatttccatagtaagacaggatctga

SEQ ID NO: 59555 - DNA, 601 bp, Human
ctggacccaacttggaacccttaaagcctgccaagttatagatactctggcttcagtagggccctgtattgaaacaccaagtgccaggactgctcaaaaggtgaaaatgagatgggtgttctgccaggtggtttagtgaaaaatcagtcaatccaggatcccactgactgaatgctaggcaaaagaaacagttcttttatttgttttcattttttgcagagttggaggtcttgctatgttgcccacactggtcttgaactcctgacctcaagcaatcctactgccttggcctcccaaagtrttaggattacaggcatgagccaccgtgcctggctagaaacagttttttaaaaactcattctaattaggaagagaagaccaatacacatggaagaaaagtgtacagtagatagcatgtagtaaatatagtccttatgctacaaaaggaaaggtagttgaaaatgaacattgggttctaggggaaactcttaagtatgtgccagtctgtgctcagaagtacaacctgattggctgtgagactaaagccaactgatagctttaagcagcccctcgggtgtgggctgcagatggttccctagga

SEQ ID NO: 59556 - DNA, 601 bp, Human
ccaagtgccaggactgctcaaaaggtgaaaatgagatgggtgttctgccaggtggtttagtgaaaaatcagtcaatccaggatcccactgactgaatgctaggcaaaagaaacagttcttttatttgttttcattttttgcagagttggaggtcttgctatgttgcccacactggtcttgaactcctgacctcaagcaatcctactgccttggcctcccaaagtattaggattacaggcatgagccaccgtgcctggctagaaacagttttttaaaaactcattctaattaggaagagaaraccaatacacatggaagaaaagtgtacagtagatagcatgtagtaaatatagtccttatgctacaaaaggaaaggtagttgaaaatgaacattgggttctaggggaaactcttaagtatgtgccagtctgtgctcagaagtacaacctgattggctgtgagactaaagccaactgatagctttaagcagcccctcgggtgtgggctgcagatggttccctaggaagctgggttgactcctgctgtgatgagctgggactgccaggtaggacctgaagcggctgccaaggggctgccaccc

SEQ ID NO: 59557 - DNA, 601 bp, Human
ggcatgagccaccgtgcctggctagaaacagttttttaaaaactcattctaattaggaagagaagaccaatacacatggaagaaaagtgtacagtagatagcatgtagtaaatatagtccttatgctacaaaaggaaaggtagttgaaaatgaacattgggttctaggggaaactcttaagtatgtgccagtctgtgctcagaagtacaacctgattggctgtgagactaaagccaactgatagctttaagcagcccctcgggtgtgggctgcagatggttccctaggaagctgggttgastcctgctgtgatgagctgggactgccaggtaggacctgaagcggctgccaaggggctgccaccccaccctgaagacaaaatcatgcagtctaaaaacctgactgctttggatcaaaatcataccctgtaatatgttctagtttttaaataacttgggttttccttaattacttaatctctgctgagaacccagctgcatccatctcttctaggtccggaattatccacagcatctcatgagcagaaacagccatgtcaacataaagttagcagactcgtcgtgtagagagttgtgcactg

SEQ ID NO: 59558 - DNA, 601 bp, Human
aaagtgtacagtagatagcatgtagtaaatatagtccttatgctacaaaaggaaaggtagttgaaaatgaacattgggttctaggggaaactcttaagtatgtgccagtctgtgctcagaagtacaacctgattggctgtgagactaaagccaactgatagctttaagcagcccctcgggtgtgggctgcagatggttccctaggaagctgggttgactcctgctgtgatgagctgggactgccaggtaggacctgaagcggctgccaaggggctgccaccccaccctgaagacaaaatcrtgcagtctaaaaacctgactgctttggatcaaaatcataccctgtaatatgttctagtttttaaataacttgggttttccttaattacttaatctctgctgagaacccagctgcatccatctcttctaggtccggaattatccacagcatctcatgagcagaaacagccatgtcaacataaagttagcagactcgtcgtgtagagagttgtgcactggcaggttaggggggaaggtgttcattcattcagcagatatgcactgagtgcttgcaaggcatagggctcgccttcaagccttg

SEQ ID NO: 59559 - DNA, 601 bp, Human
aagcagaatggcaagagtagcagccccagtaggctgcatttgctcccgttgccacttgcacgatctttctcatcccgctggcaagactagtctgttcactggcagcccctgcatcaggctgtgaggacgccctgtctacctcccgtctccatccctgtattaacccatgtgctatcaagagcgactgactctttctttacaaggttctttttccttccttccccgtaagctaatagtttggctcaggctcgccagcagaccctccccttttttgctggagggctttggcatgccctgtctyttctttggggccacccagggagttcctgtttcctttctgtgggaggcttccaattcttagttatagcaaaagagcctgtattttttagctcactcctgcccacttctggtcttgaatgacttatggcttaggtgttacaaatgggagtcctggaactcttcccagaatctcttaattccattcttgtggtatatgacgttctaaacattaaaatgatgtaatatataactcccaaccaaaacaaaagaggagatccctgctagccaaattcttccctcctctccatacacgtttttccgt

SEQ ID NO: 59560 - DNA, 601 bp, Human
taaaatgatgtaatatataactcccaaccaaaacaaaagaggagatccctgctagccaaattcttccctcctctccatacacgtttttccgtcgctgtgcagtgaatcctgggatgtgtttgtcagtcagcttccttgttcttctggctcctcactccccagggaccaccgagccacagactccacggttttctctgagggcatgcgaagtggaaactaacctatccctgcagccagcccagaccttctacaatcatatctaccagtggtgaaaggcagttcaagatgagttggacacaaycaagaaaaatagggaacaaatatgtcatagctcctctctgtctgctgtctatagaaggaggctaatagcagcagatctggtgagggccagtggcccatggacctgcctgccccaaggcagcaatcatgggagtggggtcaaggaaacactaaggaggtacacctgataggactttttaaagaggagtggccagggttctggccggtttgaagcctggagagaatggaatggcatgagttcagttttggggacattcagtggtaagactggtttctgttttctcttctggaagctcataga

SEQ ID NO: 59561 - DNA, 601 bp, Human
agactccacggttttctctgagggcatgcgaagtggaaactaacctatccctgcagccagcccagaccttctacaatcatatctaccagtggtgaaaggcagttcaagatgagttggacacaaccaagaaaaatagggaacaaatatgtcatagctcctctctgtctgctgtctatagaaggaggctaatagcagcagatctggtgagggccagtggcccatggacctgcctgccccaaggcagcaatcatgggagtggggtcaaggaaacactaaggaggtacacctgataggactttttaaagaggagtggccagggttctggccggtttgaagcctggagagaatggaatggcatgagttcagttttggggacattcagtggtaagactggtttctgttttctcttctggaagctcatagatacaggatctgctcattcacttgatttgtgcctcttatttgggcttcaggacacatctctggccaatcgcaattaaaacaccatgcccagttagccatcatcgccactcagagctgtctgctttaccgggctaaaaaaaatgatctttatcaccagttgtaagtgacttaaaaaaaa

SEQ ID NO: 59562 - DNA, 601 bp, Human
ctccacggttttctctgagggcatgcgaagtggaaactaacctatccctgcagccagcccagaccttctacaatcatatctaccagtggtgaaaggcagttcaagatgagttggacacaaccaagaaaaatagggaacaaatatgtcatagctcctctctgtctgctgtctatagaaggaggctaatagcagcagatctggtgagggccagtggcccatggacctgcctgccccaaggcagcaatcatgggagtggggtcaaggaaacactaaggaggtacacctgataggactttttaargaggagtggccagggttctggccggtttgaagcctggagagaatggaatggcatgagttcagttttggggacattcagtggtaagactggtttctgttttctcttctggaagctcatagatacaggatctgctcattcacttgatttgtgcctcttatttgggcttcaggacacatctctggccaatcgcaattaaaacaccatgcccagttagccatcatcgccactcagagctgtctgctttaccgggctaaaaaaaatgatctttatcaccagttgtaagtgacttaaaaaaaaaaa

SEQ ID NO: 59563 - DNA, 601 bp, Human
taagtggaaactataatataaaatctttcaggccaggtgcagtggctcacacctgtaatcccagcactttgggaggccaaggtgagtggatcacctaaggtcaggagttcgagaccagcctggccaacatggcaaaaccctgtctctactaaaaatacaaaaattagccgggcatggtggcacgcacctgtaatcccagctactcaggaggttgaggcagggagaatcgcttgcacccgggaggcaaaggttgcagtgaaccaagatcacgccattgcactccagcctgggcaacagagcragactctgtcttaaaaaaaaaaaaaatcaaaaatcttttagtagatgtttatagagagagaagagaggagacttgaagaaggaattctaagtaagggttaaggttgagtggaaaaaagaagaagaatcagaaggaagtggtttcatagtaggataaatcaagtgctgagatgaagtcagttcactaacagactcagagttctattggatatggcatgaggttcttggtgtcaccatcttaggatctgctcatttttggggttttaagaacctgtctgaactccacttagccaactgaagc

SEQ ID NO: 59564 - DNA, 601 bp, Human
ttgaggcagggagaatcgcttgcacccgggaggcaaaggttgcagtgaaccaagatcacgccattgcactccagcctgggcaacagagcaagactctgtcttaaaaaaaaaaaaaatcaaaaatcttttagtagatgtttatagagagagaagagaggagacttgaagaaggaattctaagtaagggttaaggttgagtggaaaaaagaagaagaatcagaaggaagtggtttcatagtaggataaatcaagtgctgagatgaagtcagttcactaacagactcagagttctattggatayggcatgaggttcttggtgtcaccatcttaggatctgctcatttttggggttttaagaacctgtctgaactccacttagccaactgaagcttgccttcaaagttaacacaatgtgctttctcccatataaaccttttaagctgtttctgatgactgttcctcttcctgttagagctccacctcttttaatttagcctccatacctttagagtaaggtctgcaactttcttccttaattgacagtggagatcaatatgtaacccagattgcaaaaatggtttgggaacactgcatgttctca

SEQ ID NO: 59565 - DNA, 601 bp, Human
ggcaaaggttgcagtgaaccaagatcacgccattgcactccagcctgggcaacagagcaagactctgtcttaaaaaaaaaaaaaatcaaaaatcttttagtagatgtttatagagagagaagagaggagacttgaagaaggaattctaagtaagggttaaggttgagtggaaaaaagaagaagaatcagaaggaagtggtttcatagtaggataaatcaagtgctgagatgaagtcagttcactaacagactcagagttctattggatatggcatgaggttcttggtgtcaccatcttagkatctgctcatttttggggttttaagaacctgtctgaactccacttagccaactgaagcttgccttcaaagttaacacaatgtgctttctcccatataaaccttttaagctgtttctgatgactgttcctcttcctgttagagctccacctcttttaatttagcctccatacctttagagtaaggtctgcaactttcttccttaattgacagtggagatcaatatgtaacccagattgcaaaaatggtttgggaacactgcatgttctcactcataggtgggagttgaacacatggacaca

SEQ ID NO: 59566 - DNA, 601 bp, Human
acttgaagaaggaattctaagtaagggttaaggttgagtggaaaaaagaagaagaatcagaaggaagtggtttcatagtaggataaatcaagtgctgagatgaagtcagttcactaacagactcagagttctattggatatggcatgaggttcttggtgtcaccatcttaggatctgctcatttttggggttttaagaacctgtctgaactccacttagccaactgaagcttgccttcaaagttaacacaatgtgctttctcccatataaaccttttaagctgtttctgatgactgttccycttcctgttagagctccacctcttttaatttagcctccatacctttagagtaaggtctgcaactttcttccttaattgacagtggagatcaatatgtaacccagattgcaaaaatggtttgggaacactgcatgttctcactcataggtgggagttgaacacatggacacagggtgggaaacatcacacactggggcctggcaggggatggggggctgggggagggatagcattaggagaaatacctaatgtaaatgacgagttgatgggtacagcaaaccaacatggcacatatatacc

SEQ ID NO: 59567 - DNA, 601 bp, Human
aggataaatcaagtgctgagatgaagtcagttcactaacagactcagagttctattggatatggcatgaggttcttggtgtcaccatcttaggatctgctcatttttggggttttaagaacctgtctgaactccacttagccaactgaagcttgccttcaaagttaacacaatgtgctttctcccatataaaccttttaagctgtttctgatgactgttcctcttcctgttagagctccacctcttttaatttagcctccatacctttagagtaaggtctgcaactttcttccttaattgrcagtggagatcaatatgtaacccagattgcaaaaatggtttgggaacactgcatgttctcactcataggtgggagttgaacacatggacacagggtgggaaacatcacacactggggcctggcaggggatggggggctgggggagggatagcattaggagaaatacctaatgtaaatgacgagttgatgggtacagcaaaccaacatggcacatatatacctatgtaacaaacctgcacgttgtgcacatgtaccctagaacttaaagtataattttaaaaaaaatttttaatagtttgg

SEQ ID NO: 59568 - DNA, 601 bp, Human
ctcttaagttttagtgtatttcaaatgtggatagtttttgactaggaggtttgttcaaacgttcttctcgaccactagggggtgctctaaaggttagtgatgtctaaatgattgaccaatcaattaaaacaccgtgcccagttagcaatcatctccactgagagatgcctgctttaccaggctaaaaaaatgatctttatcatggcatagagactataaaagctgtgtccttttattttcattaacctaattagaagtcaagctaattgtaggacttcatagaactggcatcgggaatagyatgcaactgttaaaaaaatcatggtcttgatgactaattatatcaggaaataatatgcaatataaatgaaaagagaagtgtatgttttttactttttcctttctgtttttaaaacatgctataaaatgttaagtataattaggacacaaaggaaaaattaaatctagttaacattaccttgaaaacttcttatttgccctgaaatctccagttctttggaagctaaaagcttgagacttctatatctggttgtcaggattagggtgattttatttgaattttctttattttcttctcaat

SEQ ID NO: 59569 - DNA, 601 bp, Human
tctcgcttacagtaatatgtttttagtacataaggagggcatttgttttgcaataataattattataaagcccctaaaatagaaaatatgaattaccagtcagtgttagaaaacttatcagaactgaaacctttgttagtatgttttggttatcaaatctagttttgtaaccccttgcttagcaagcatttcccagaaagaaaagtccttacccggtcaaggccattaccatatagcatcgggaaacatccctgtgtcccagcagctgggctaggactccttccacctccttcgaccctcyatacccttgtcccacactgagggttgggggagctgctgcagttgctgtttcggctgctgtttcattcctgtccacttgtgagtgtgtgtgtacctccgccagtcttggaggtctgtgaaggaggcctcgagacccagtgcatgcagctcactgccacgtgtgccacagccacagccaaggggccttcctatgcctcatgcatcaggccctttggagccctgggagcagacggccatggcggctgaagctgcagtggatgcactcatgatgatgaggataataatagttgctaacatttct

SEQ ID NO: 59570 - DNA, 601 bp, Human
caataataattattataaagcccctaaaatagaaaatatgaattaccagtcagtgttagaaaacttatcagaactgaaacctttgttagtatgttttggttatcaaatctagttttgtaaccccttgcttagcaagcatttcccagaaagaaaagtccttacccggtcaaggccattaccatatagcatcgggaaacatccctgtgtcccagcagctgggctaggactccttccacctccttcgaccctctatacccttgtcccacactgagggttgggggagctgctgcagttgctgttycggctgctgtttcattcctgtccacttgtgagtgtgtgtgtacctccgccagtcttggaggtctgtgaaggaggcctcgagacccagtgcatgcagctcactgccacgtgtgccacagccacagccaaggggccttcctatgcctcatgcatcaggccctttggagccctgggagcagacggccatggcggctgaagctgcagtggatgcactcatgatgatgaggataataatagttgctaacatttcttgagcatttcacttatggtatgccagacactattcaaagcccttagctta

SEQ ID NO: 59571 - DNA, 601 bp, Human
cactgagggttgggggagctgctgcagttgctgtttcggctgctgtttcattcctgtccacttgtgagtgtgtgtgtacctccgccagtcttggaggtctgtgaaggaggcctcgagacccagtgcatgcagctcactgccacgtgtgccacagccacagccaaggggccttcctatgcctcatgcatcaggccctttggagccctgggagcagacggccatggcggctgaagctgcagtggatgcactcatgatgatgaggataataatagttgctaacatttcttgagcatttcacttrtggtatgccagacactattcaaagcccttagcttaaatcatttaatcctcacaaacctgtgagttgggttgtcttattatccccattttgcagaagtgagttttgtgagagagaagctaaatacagcacagcaggagttgctcttggacctcaagcatcctggcccagagcccaggtgtcgccactgccctgggcttcctcttagtcataccagggacttgggcactgggcacaaaatctcctctttatataatgtagtggtaccaatagcttctattgattgagattcttttctgggct

SEQ ID NO: 59572 - DNA, 601 bp, Human
ggtctgtgaaggaggcctcgagacccagtgcatgcagctcactgccacgtgtgccacagccacagccaaggggccttcctatgcctcatgcatcaggccctttggagccctgggagcagacggccatggcggctgaagctgcagtggatgcactcatgatgatgaggataataatagttgctaacatttcttgagcatttcacttatggtatgccagacactattcaaagcccttagcttaaatcatttaatcctcacaaacctgtgagttgggttgtcttattatccccattttgcagawgtgagttttgtgagagagaagctaaatacagcacagcaggagttgctcttggacctcaagcatcctggcccagagcccaggtgtcgccactgccctgggcttcctcttagtcataccagggacttgggcactgggcacaaaatctcctctttatataatgtagtggtaccaatagcttctattgattgagattcttttctgggcttggcactgtatgaggcacttggcttctggtttaatctttacatgatcactgtagttatagatgttattatcccagatttataaataaataaggaa

SEQ ID NO: 59573 - DNA, 601 bp, Human
aacagcccttaatgagggggccttagggaatgcaccttacttatactgacagccattattcgggggatatttttagccccttgggcctggggaaggaatagttctgaactgatagccagggcagagagtggacccagactgcagcaggtcagtggcatcagagcaagtgacgacaggaattctattatcaccaggcagcagctcctctgcctcccacacctgtaactcacaccaggtgtgggacaaagggatttctgagttgctttcactcccaccggtgttcatcaccccatgttaatgwcttgtacttgtggttggctgaatcagggacaaaagagaggagcagggacaaagggcttagccacttggctttagaagtgatgttaaaccggtctcctggccttgagatttcctaccacacaggtcagggcagacttcacctgacagaagccaaaagcctcaggtaaagctgtacagatgtgcaggctcagtttctaggaaaatggactttagaaaaaccaaaatggttctatgcacaggtttaaatacagaaacagtcatctttgccatctctgtctagagtgggatttgggaaacccct

SEQ ID NO: 59574 - DNA, 601 bp, Human
tccaacaagcctggttacctcaggcagcagaaaggccattatgggacatgggtggttactcgtgtcccttaataatgggcaacaaggatgcaacaatttctttttgtagctgctttctgactcccattgcctaaacaagggctctctcaaacagcctcacaactgtgtctttcccatgtcttatcttccatctttcagatgaaaataagaaaaacatggaggaagcacatgtgactttagtttgcttctaattgcaagagtaatacacactcatcatagaaactttgaaagatactgaaargtagaaaaaagaaatgtcaccccgatcccacaacaaaaaactgacttctgtcactctatagccatcttttttatcctttctatgcatctgtctgcatttttggctataactaaaatcatcctgcacattcacgtttgtgatctttttttaaattgaaaatacctacatgagagcacaagcattggcagcttcagcagcagctatcacttactgcacacttgcccgaagggacctgaggacatacttaatacaattttacttctgatgatgactcctcaccccaccacccaccacctgatg

SEQ ID NO: 59575 - DNA, 601 bp, Human
tctcccaggctggagtgcatggcgcgatcttggctcactgcaacctctgcatcccgggttcaagtgattctcctgcctcagcctcccaagtagctggaattagaggtgcatgccaccatgcccagctaattttcttgtacttttagtagagacggggtttcaccacgttgcccaggctggttttgaacttctgacctcaagtgatctgcccgcctcagcctcccaaagtgctgggatgacaggcatgagccaccacgcctggcctggatcttcttttctaaacactagagattttttgtcrtttatctccttctcttcaaaagtaatcttggagaaattgctgccaaatctttgcctctctgcagcaaacattttaaaatggggtgaacagaagtgcaggtcaacagagggtttcctcacagcaaaaacattttgcttgttgataaacatgtctttgttttttatacctggtgacgttatttgaggtctttgataggatggaccagtactctgcattaagtcgtcgtcgtgtctcagctggcctgtgtctcctgcctgcttcaagagttgctcataacctgagggctgtgaattacactct

SEQ ID NO: 59576 - DNA, 601 bp, Human
tgtctcagctggcctgtgtctcctgcctgcttcaagagttgctcataacctgagggctgtgaattacactctgtgttccaggtggtgccagacaggaggttagaaatgagactctgaatgaaaagaaacaggtacagcagaacccatctttctggaattctaaagcttatggtccctcactgtgtagcagaggtgaatctgccagagtctggcattatctgagaatctgcctccagggctgtagatggggctgggctaaagcaagactagagggcaggattttctccccccagatctggartttagcccacagtctggcttttagattttaggctttcgatgcctactgccttaaaactcttgccaagtgcgccacttatagcagcctaaggaatggccacttccccactgacccagttccagtagccaggtgttcagagcaattggaattcatgtgactgccagtcagatccacgaggaagatgaacaggctggttaacgaaaacatgtaagactgacctccttgcccagagatgattcagggtggctttttgtcttagtcttcctcaggccatcagtggccatccctccaaatggacag

SEQ ID NO: 59577 - DNA, 601 bp, Human
aaaactcttgccaagtgcgccacttatagcagcctaaggaatggccacttccccactgacccagttccagtagccaggtgttcagagcaattggaattcatgtgactgccagtcagatccacgaggaagatgaacaggctggttaacgaaaacatgtaagactgacctccttgcccagagatgattcagggtggctttttgtcttagtcttcctcaggccatcagtggccatccctccaaatggacagatacagcattggcataaaaccttactatgcagatgcagctttttgggatgttyccggtgtgtgtatatcctccgcccaacctgttgctaacctgctaattctaccttaatccttcccatttagaaaatacaggacagccattgctcatcaaagcttgtcccacccaattctgcctctccccttgtcagtcaccctcaaatgaaggccaggagcttaggcagatggcttgctgtatttacatagtttgcctgttggcttacattggccaacccgaagagttgttttggtggtggtggtttttgttttgtgaatcttgccattccttcttcactattaaattcttgcttcgcttt

SEQ ID NO: 59578 - DNA, 601 bp, Human
ttacacttagataaatcttggatcactttttaaatgagacctacacgtttctttcatgaagcagtcatgatttccatagcactttattcacactacttgcatagtatttagtacactgcatagtgacttttaagagtccacttttacctgctaggttgagagtcacttaagggggagatggcatctcgctcatttctacattccgactcttgactcaatcttttgaaggactgagtggtatttccaatgtggatgctactgtgaggctgtcatttggcttcctttttttttttttttttttggaagaaggagtcttactcctgtcgctcaggtgggagtgccgtggcacaatcacagctcattgcagcctttacttcccgggctcaggtgatcctcctgcctaattttttttttatttttttgtatagacaacctcttgctatattgcccaggctggtcttgaacccctgggctcaagggatccacccacataggcctcccaaattggtaggattacaggcatgagccactgcacccggcctccacttctgtttggctgacttgtctaaaggggtgttctttttctgtgattgttctctgc

SEQ ID NO: 59579 - DNA, 601 bp, Human
agaaggagtcttactcctgtcgctcaggtgggagtgccgtggcacaatcacagctcattgcagcctttacttcccgggctcaggtgatcctcctgcctaattttttttttatttttttgtatagacaacctcttgctatattgcccaggctggtcttgaacccctgggctcaagggatccacccacataggcctcccaaattggtaggattacaggcatgagccactgcacccggcctccacttctgtttggctgacttgtctaaaggggtgttctttttctgtgattgttctctgcccayttgtgagaactagagcacctgctaggtgtcctttactttgggtaattaaccccacatgttccagattaaaggcatttacctttcgatttacattctctctccaggtacatgacctttaaggtacagagctggaactcgagtcaaaggtttctgatgccttctgtacttttgatttcatgtagcaattcaaggctgtgtgaaatgaactacaggagatccaggtgctgctctgcccaggggatctaatcccaccagaccggttgcactgcaccctgacccatggtcaggatgtttcctgga

SEQ ID NO: 59580 - DNA, 601 bp, Human
ctgctaggtgtcctttactttgggtaattaaccccacatgttccagattaaaggcatttacctttcgatttacattctctctccaggtacatgacctttaaggtacagagctggaactcgagtcaaaggtttctgatgccttctgtacttttgatttcatgtagcaattcaaggctgtgtgaaatgaactacaggagatccaggtgctgctctgcccaggggatctaatcccaccagaccggttgcactgcaccctgacccatggtcaggatgtttcctggaatacatccacttgacagtstcctctctgtgccacagccttaggcaatatgctgctgatggagctctaggttaattgctacaccacattgggccctctcttgtgtttgtatccaggatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctataggtgagttttggttgctgccctgtcttctaattcactgcctcttccctctc

SEQ ID NO: 59581 - DNA, 601 bp, Human
gtcctttactttgggtaattaaccccacatgttccagattaaaggcatttacctttcgatttacattctctctccaggtacatgacctttaaggtacagagctggaactcgagtcaaaggtttctgatgccttctgtacttttgatttcatgtagcaattcaaggctgtgtgaaatgaactacaggagatccaggtgctgctctgcccaggggatctaatcccaccagaccggttgcactgcaccctgacccatggtcaggatgtttcctggaatacatccacttgacagtctcctctctrtgccacagccttaggcaatatgctgctgatggagctctaggttaattgctacaccacattgggccctctcttgtgtttgtatccaggatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctataggtgagttttggttgctgccctgtcttctaattcactgcctcttccctctcctggcatga

SEQ ID NO: 59582 - DNA, 601 bp, Human
ctctgtgccacagccttaggcaatatgctgctgatggagctctaggttaattgctacaccacattgggccctctcttgtgtttgtatccaggatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctataggtgagttttggttgctgccctgtcttctaattcactgcctcttccctctcctggyatgatccatccttccacttctcatgataatcagttgaaaccttttttggaattaaattcacagaagttttgttttggtttttgtttttgagacagggtctcactccatagcccgggctggagtgcagtggcgcaatcatggctcactgcagccggtccatctggacctcccaagtagatagctgggactacaggcacgcaccactacacatggctaatttttattttttattttttgtagagacaggggtcttgcaatgttgcccaggcctcacaaaggttccaaggatccattaggata

SEQ ID NO: 59583 - DNA, 601 bp, Human
ttctaattcactgcctcttccctctcctggcatgatccatccttccacttctcatgataatcagttgaaaccttttttggaattaaattcacagaagttttgttttggtttttgtttttgagacagggtctcactccatagcccgggctggagtgcagtggcgcaatcatggctcactgcagccggtccatctggacctcccaagtagatagctgggactacaggcacgcaccactacacatggctaatttttattttttattttttgtagagacaggggtcttgcaatgttgcccaggcytcacaaaggttccaaggatccattaggataaattaataacagtaataaacactgcctgcaatctaaaatttgcctcactttgtattcataaaataggcccgacagtctcagaagagactgtttattcatgaattggttcagccccagtttgctaagaacctgtcatagccaagacctgcagggtgctaaacacactgttgttctctttttttcattttaacatttgaagtgaatcccttaaccatgattctattccattttaagaatctacaccttaactaaagggtgtggctaacctgc

SEQ ID NO: 59584 - DNA, 601 bp, Human
agtttgctaagaacctgtcatagccaagacctgcagggtgctaaacacactgttgttctctttttttcattttaacatttgaagtgaatcccttaaccatgattctattccattttaagaatctacaccttaactaaagggtgtggctaacctgctctaagttacaagaattacagtcatgtggagcatggctcaccagtcaggagctaggtgagccacttgtgagcagtgtcctgcatgataatatcttccgtgtgtagccccctcccaaatatttgattctccattttgtgacacacartcttttgatcataatataccatactttgaatggactccgaatctgcttgatgttgttaagtctcagaattcaacagatatcaaatgtaactttagtcagagagaaggttggagacagtgagaagtgtaatagtgaatgttagataatttttattctcacattttcctgtttttttttctgctgttagtgtcctcacctaattgcacatatgctcttttttcttttttattgttttatttcttttctttctttctttctttttttttttttaagacagtgtcttgctattttggctaggtc

SEQ ID NO: 59585 - DNA, 601 bp, Human
cccctcccaaatatttgattctccattttgtgacacacaatcttttgatcataatataccatactttgaatggactccgaatctgcttgatgttgttaagtctcagaattcaacagatatcaaatgtaactttagtcagagagaaggttggagacagtgagaagtgtaatagtgaatgttagataatttttattctcacattttcctgtttttttttctgctgttagtgtcctcacctaattgcacatatgctcttttttcttttttattgttttatttcttttctttctttctttctttytttttttttaagacagtgtcttgctattttggctaggtcggtcttgaactcctggcctcaagcaatcctcccaccttggcctcctaaagtgctaggattacaggcatgagtcaccacacccagctcacataaactctttttctcttgagatgcaattgttgctttccttagagaaaaattttcgtatattaggggcatgaatgccaaagtaaaggatttcctgattgaaatttgctatttattaaccttgttaaatgcagttcctatcataaactcatgacagtattgacatcattatta

SEQ ID NO: 59586 - DNA, 601 bp, Human
actctttttctcttgagatgcaattgttgctttccttagagaaaaattttcgtatattaggggcatgaatgccaaagtaaaggatttcctgattgaaatttgctatttattaaccttgttaaatgcagttcctatcataaactcatgacagtattgacatcattattaaattataagagctttaaaaacagtgaatattcttaaataccgtgggagtcaaaataggaagagaacaagtagtaactctcttagagagagtgcagtaagactggtgggtggtgctggagataagtgggaacgyaagcactgcatagcaggtgtggcaggtaccacagagacacttctctaattcattctcagtgcagatcccctagacctcaactccatacagtgcatttatcacagcctcacggcactgtgcaggagggaagagggtgcagaactgggaaccagcctggataaggacagtgggagccacctgtttgaaagcagtctaggatctctgctcgttcttaggtcacggggctgcagcaggttgattaggcagcttgttttgagctttcttgaccaggctgtggggattagatcacagcattttttt

SEQ ID NO: 59587 - DNA, 601 bp, Human
ggtgcagaactgggaaccagcctggataaggacagtgggagccacctgtttgaaagcagtctaggatctctgctcgttcttaggtcacggggctgcagcaggttgattaggcagcttgttttgagctttcttgaccaggctgtggggattagatcacagcatttttttcccactctccactttctttccagtgtatgctttgtggaggttgctggtatgatctctgatggtgaagggagttaagcgtcgtcctcatgctatcagactccaggcagtaaattccatttttgttctcctctcygcggctaatccagccatctccactccgcttgccccaaagagagacgtttccacatgtagttttaaaaactacatgtaagtaatgactcccctacttgacagggacttctgctgcagatcaaaataatattaacaacaagacctaactgaacacttggactgggtgtggtgactcacacctctaatcccagcacctcggaaggctgagcggggaggatcgcttgagcctggaagtttgaggccagccggggcaacataaggagacccctatctctacaaaaaaaaaaaaaacatatacata

SEQ ID NO: 59588 - DNA, 601 bp, Human
ttctcctctccgcggctaatccagccatctccactccgcttgccccaaagagagacgtttccacatgtagttttaaaaactacatgtaagtaatgactcccctacttgacagggacttctgctgcagatcaaaataatattaacaacaagacctaactgaacacttggactgggtgtggtgactcacacctctaatcccagcacctcggaaggctgagcggggaggatcgcttgagcctggaagtttgaggccagccggggcaacataaggagacccctatctctacaaaaaaaaaaaaaacatatacatatatgttaaaaaattagccagccaggcgcggtggctcacgcctgtaatcccagcactctgggaggccgaggcgggcggatcacgaggtcaggagatcgagaccatcctggctaacaccctgaaaccctgtctctactaaaaatacaaaaaattagccgggcaaggtggcgggtgcctgtagtcccagctactcgggaggctgaggcagaagaatagtgtgaaccgcagggggcggagcctgcagtgagccgagatcgcgccaccgcactccagcctgggcgacagcgagac

SEQ ID NO: 59589 - DNA, 601 bp, Human
ctccgcttgccccaaagagagacgtttccacatgtagttttaaaaactacatgtaagtaatgactcccctacttgacagggacttctgctgcagatcaaaataatattaacaacaagacctaactgaacacttggactgggtgtggtgactcacacctctaatcccagcacctcggaaggctgagcggggaggatcgcttgagcctggaagtttgaggccagccggggcaacataaggagacccctatctctacaaaaaaaaaaaaaacatatacatatatgttaaaaaattagccagccrggcgcggtggctcacgcctgtaatcccagcactctgggaggccgaggcgggcggatcacgaggtcaggagatcgagaccatcctggctaacaccctgaaaccctgtctctactaaaaatacaaaaaattagccgggcaaggtggcgggtgcctgtagtcccagctactcgggaggctgaggcagaagaatagtgtgaaccgcagggggcggagcctgcagtgagccgagatcgcgccaccgcactccagcctgggcgacagcgagactccgtctcaaaaaaaaaaaaagaaaaaaattcg

SEQ ID NO: 59590 - DNA, 601 bp, Human
gcacctcggaaggctgagcggggaggatcgcttgagcctggaagtttgaggccagccggggcaacataaggagacccctatctctacaaaaaaaaaaaaaacatatacatatatgttaaaaaattagccagccaggcgcggtggctcacgcctgtaatcccagcactctgggaggccgaggcgggcggatcacgaggtcaggagatcgagaccatcctggctaacaccctgaaaccctgtctctactaaaaatacaaaaaattagccgggcaaggtggcgggtgcctgtagtcccagctamtcgggaggctgaggcagaagaatagtgtgaaccgcagggggcggagcctgcagtgagccgagatcgcgccaccgcactccagcctgggcgacagcgagactccgtctcaaaaaaaaaaaaagaaaaaaattcggcaggcatggtggcatgcacctgtggtcctagctacttgggaggctgaggtgggagaattgcttgagcccaggagattgaggctgcagtgagctgtaactgtgccactgtattccagcctgggtgacagagcaagaccctgagtgtcaatcaatcaataaatcaata

SEQ ID NO: 59591 - DNA, 601 bp, Human
aggggcatgcatcccattgaccagacatctttcagcatgtttcatcaactgtattaaagggaaactcagctgtcattgacatttcaaccccaaactcctgaagccagccagcacacatttgattggctgtttttgacaaagtgtggaatactgtatctgaaatatgttgggtgaggaatagtttatagaagggcacagtttaaatttcacttcctcctcaccatgttacccctgggcacacagcactttccaacacatgcttttcgactcatgagtctgactgctttgtgccttatgcagytgttggcatgctgggtgcacggtaattagtgtttaccctgaaagctccaaatgcttcccgtggtatttcgccatcccattttgcagatgtggcccacagaggaagcttttgccccacagaggctcactgccaagtctgacatgccgccttttactcccatgattacgtggcacatgaacttttcaactttgagctgctgatttctcctcagattgagagaaaaatgtctacttaatttgactcttttaaaaattcagaatttgggaagagtagcaatctcactcgcaagattaagccctg

SEQ ID NO: 59592 - DNA, 601 bp, Human
accagacatctttcagcatgtttcatcaactgtattaaagggaaactcagctgtcattgacatttcaaccccaaactcctgaagccagccagcacacatttgattggctgtttttgacaaagtgtggaatactgtatctgaaatatgttgggtgaggaatagtttatagaagggcacagtttaaatttcacttcctcctcaccatgttacccctgggcacacagcactttccaacacatgcttttcgactcatgagtctgactgctttgtgccttatgcagctgttggcatgctgggtgcrcggtaattagtgtttaccctgaaagctccaaatgcttcccgtggtatttcgccatcccattttgcagatgtggcccacagaggaagcttttgccccacagaggctcactgccaagtctgacatgccgccttttactcccatgattacgtggcacatgaacttttcaactttgagctgctgatttctcctcagattgagagaaaaatgtctacttaatttgactcttttaaaaattcagaatttgggaagagtagcaatctcactcgcaagattaagccctgttaagctagtctctgaaca

SEQ ID NO: 59593 - DNA, 601 bp, Human
ccagacatctttcagcatgtttcatcaactgtattaaagggaaactcagctgtcattgacatttcaaccccaaactcctgaagccagccagcacacatttgattggctgtttttgacaaagtgtggaatactgtatctgaaatatgttgggtgaggaatagtttatagaagggcacagtttaaatttcacttcctcctcaccatgttacccctgggcacacagcactttccaacacatgcttttcgactcatgagtctgactgctttgtgccttatgcagctgttggcatgctgggtgcayggtaattagtgtttaccctgaaagctccaaatgcttcccgtggtatttcgccatcccattttgcagatgtggcccacagaggaagcttttgccccacagaggctcactgccaagtctgacatgccgccttttactcccatgattacgtggcacatgaacttttcaactttgagctgctgatttctcctcagattgagagaaaaatgtctacttaatttgactcttttaaaaattcagaatttgggaagagtagcaatctcactcgcaagattaagccctgttaagctagtctctgaacat

SEQ ID NO: 59594 - DNA, 601 bp, Human
agtagcaaccatgactagtgctatgaagaggagaaatacaatgcagtgaatgagaacctagaatagggtgattctatccagttagggaaagatggaagatttttataaggaagtgactcttgggctgaggtcacggtaaagagggaaggaaggaacatttgagacagaagaaacagcaaacgcagatagatgcccagtaacaggaaggagtgtggcaaggtcaggggtttttagagcaggccagcctggctggagtctaggaagcgcatcttacttcacttggcattttattatcctacastgttcagtcagctgatgacttcaagattttattaaacactccttgtaaataatttatttgaaggttaggtaaggccggtcatgttgccaatccctggaggagccatctattcacagtgagttctctgtgtccaggtctgtgcatttatactcaacaatgggtttataaaatattagagccagaggagacctcaaacgttgctaagggccaagttatcttttacagatgagggacttcaggtgtgaaacgtccaaaaattgtttctcatagtggatattctcttcggatgactcatctgct

SEQ ID NO: 59595 - DNA, 601 bp, Human
tacaagatgagtagatgagatgtctgccctttgaggcgctttctgtggggtgagagagatagccattaataagtcatggcagctgggttccaaaattggagttttcccagggtatcttgggagcagacagaatggccacttgccctaagatggatgttcaggcaaacttcctggaggaggtgatgcctgagctgagtgtgaagagttaaaagctgaacaaagataaggagggtgtttaggtaggggagcaagtttgagcaaagcagagaagtgtggtgaatgtgtagttaaagtggaaaaygacaggaactttggtagcactggagcctgaagttggaggcatgggaagagggaaggctagaggaggctgcagaaatgaagtattaagcacttactgttcttgagatgtttgaattctgggtcacttaggactttgctccattgcctatcacaggaaacataaaaatgacagtggcttaagccagatggaaacatagtgctctctcacatgaaaagcccggaggtaggtagtccagccccgccatggaagctccgtggagtcatttgcaacccagatttctgtgctttctgttctgctgta

SEQ ID NO: 59596 - DNA, 601 bp, Human
taaagctgataggacttagtatttgggtggattcagggtaaaaaagaaaccggaaatcatttccaggtgtttagctagaaggttgagtggatggcagtgccattagctaggagagatcatgtgcctaggaagaagtctaggcaaaagaggaagaagttttagaaaggttgtatgacaggtgcctgaggtatactccagtggagatgctccatggataggggcataggagtctgaagctcagtaaagaggatgggctgaattaaatatttggaagtcatcaggacatagctattagttgagrccacgagactgaatgagatcacccaataggagtctcttaaatggaacagtgtgagtcaaggacagaaccctggggaaccagactccattagaaatctgcctaaatttggctccagggttatagaaacaattggtatgttcatcatttagagtaagtatccccaaagtgccagtgtattaaaaatataattccataaaagtatagaaaaagatcacttactttagagtatgtgtgtgatgctacatatattcttcctactgaaagaatgctggacatggttttcagaagccctgcatgcta

SEQ ID NO: 59597 - DNA, 601 bp, Human
ttggaagtcatcaggacatagctattagttgagaccacgagactgaatgagatcacccaataggagtctcttaaatggaacagtgtgagtcaaggacagaaccctggggaaccagactccattagaaatctgcctaaatttggctccagggttatagaaacaattggtatgttcatcatttagagtaagtatccccaaagtgccagtgtattaaaaatataattccataaaagtatagaaaaagatcacttactttagagtatgtgtgtgatgctacatatattcttcctactgaaagaawgctggacatggttttcagaagccctgcatgctagacccagccctggtcctggggatgtgggcaggttgctgaatgcccctagccctttggcccatctgtacagtggaggtgccattggcacagcttcccagcagggtccttgtaaaactcaaatcagatggaagtagaaatgcgaatgctttttggaacatgccgtgtcaatataagaggttatctttgcatatgtgctgtcacctgatttgggttttcttggtatccataggcataggcagcaattattctcaagacactgcctgaata

SEQ ID NO: 59598 - DNA, 601 bp, Human
ccattagaaatctgcctaaatttggctccagggttatagaaacaattggtatgttcatcatttagagtaagtatccccaaagtgccagtgtattaaaaatataattccataaaagtatagaaaaagatcacttactttagagtatgtgtgtgatgctacatatattcttcctactgaaagaatgctggacatggttttcagaagccctgcatgctagacccagccctggtcctggggatgtgggcaggttgctgaatgcccctagccctttggcccatctgtacagtggaggtgccattgrcacagcttcccagcagggtccttgtaaaactcaaatcagatggaagtagaaatgcgaatgctttttggaacatgccgtgtcaatataagaggttatctttgcatatgtgctgtcacctgatttgggttttcttggtatccataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgta

SEQ ID NO: 59599 - DNA, 601 bp, Human
gtatgttcatcatttagagtaagtatccccaaagtgccagtgtattaaaaatataattccataaaagtatagaaaaagatcacttactttagagtatgtgtgtgatgctacatatattcttcctactgaaagaatgctggacatggttttcagaagccctgcatgctagacccagccctggtcctggggatgtgggcaggttgctgaatgcccctagccctttggcccatctgtacagtggaggtgccattggcacagcttcccagcagggtccttgtaaaactcaaatcagatggaagtrgaaatgcgaatgctttttggaacatgccgtgtcaatataagaggttatctttgcatatgtgctgtcacctgatttgggttttcttggtatccataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgtattttcacaatattttgaaattgcaagtgattgatatacttaccatgaa

SEQ ID NO: 59600 - DNA, 601 bp, Human
gaaaaagatcacttactttagagtatgtgtgtgatgctacatatattcttcctactgaaagaatgctggacatggttttcagaagccctgcatgctagacccagccctggtcctggggatgtgggcaggttgctgaatgcccctagccctttggcccatctgtacagtggaggtgccattggcacagcttcccagcagggtccttgtaaaactcaaatcagatggaagtagaaatgcgaatgctttttggaacatgccgtgtcaatataagaggttatctttgcatatgtgctgtcacctsatttgggttttcttggtatccataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgtattttcacaatattttgaaattgcaagtgattgatatacttaccatgaacttaccataaacccttgagataattttcttaggaagtcctagggcatatgtgacaggttgtacaacctgaa

SEQ ID NO: 59601 - DNA, 601 bp, Human
ggtccttgtaaaactcaaatcagatggaagtagaaatgcgaatgctttttggaacatgccgtgtcaatataagaggttatctttgcatatgtgctgtcacctgatttgggttttcttggtatccataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgtattttcacaatattttgraattgcaagtgattgatatacttaccatgaacttaccataaacccttgagataattttcttaggaagtcctagggcatatgtgacaggttgtacaacctgaagactatactctggcattttgtttcaatttcaacagtttctaatgtttaggggaagcagttgacctcattttgagtttacgccttctggtattaaagcagatgtttgatggttaatttgagaggagattcaagaaccttttcagaccattagtggagtgaacatcctgaggatgtaatcccagtaatgcagtttctcaa

SEQ ID NO: 59602 - DNA, 601 bp, Human
tctttgcatatgtgctgtcacctgatttgggttttcttggtatccataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgtattttcacaatattttgaaattgcaagtgattgatatacttaccatgaacttaccataaacccttgagataattttcttaggaagtcctagggcatrtgtgacaggttgtacaacctgaagactatactctggcattttgtttcaatttcaacagtttctaatgtttaggggaagcagttgacctcattttgagtttacgccttctggtattaaagcagatgtttgatggttaatttgagaggagattcaagaaccttttcagaccattagtggagtgaacatcctgaggatgtaatcccagtaatgcagtttctcaaaggacctaactttataacagatagacatttaagccctgggacaccttgatcatttttctgtacttcatatattaaacca

SEQ ID NO: 59603 - DNA, 601 bp, Human
cataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgtattttcacaatattttgaaattgcaagtgattgatatacttaccatgaacttaccataaacccttgagataattttcttaggaagtcctagggcatatgtgacaggttgtacaacctgaagactatactctggcattttgyttcaatttcaacagtttctaatgtttaggggaagcagttgacctcattttgagtttacgccttctggtattaaagcagatgtttgatggttaatttgagaggagattcaagaaccttttcagaccattagtggagtgaacatcctgaggatgtaatcccagtaatgcagtttctcaaaggacctaactttataacagatagacatttaagccctgggacaccttgatcatttttctgtacttcatatattaaaccagaatgctgatcctggcatacctcctcagggtttggccttttcat

SEQ ID NO: 59604 - DNA, 601 bp, Human
cctggactcccctaccctccagattccatctaggttaggtgccccctctgttcccatggcatcccatgaaacccttcccttagtgctttccataggctgtgcccctgtgcatatgggttcatgaaggcagggactgtggctgtccaagcccagcccctaggacaatgacaggagtgttaggtgttcttaggtgttcatggaattgaccaaggcctcaaattctacgctttttttattttaagatgacaggtcagggctgagaatatattatgattgctaccatttattgaacatctactaygagccaggctctattctgagctctctgcattaactcacctactcctcatgacagcgctatgatatgacactcagcttgggaagagctgcccattgattgtcttattctggcccaaacccatgattttctcataactcaaagcagtcttttttaaataagtgaaagccttctggaaagtttctctgattgaccgaaaaggatgtttgcacatctgtagtagtgatgcatttatatcctcatacatatttatttggatctgacttcgattctttccttagaacagattcctggaaaggcaca

SEQ ID NO: 59605 - DNA, 601 bp, Human
atacatatttatttggatctgacttcgattctttccttagaacagattcctggaaaggcacacaaattaacgacttttagagctggcattgtggataagagctggggctcctgagtagaatggacctgggtgtttccagtcttggttctgccacttctctgttgtgggatcttgatcaggttactttacctctctaagcctcagtttcttcaatgataaaatggaagtcctggaaatactcacctgagggtggttgttagaattaaatttgtgatgtggaggtgcatgtaaagcctttagmccagagcctggtatgtagtacatgctcagtgatgttcacttttaaacattctgtttgctaccacttttgggaaaagcatcaaacacatgttccagtgacgggtattggtgccatttttctagttcccctcatagatcttaagtgcacaattggataaattttgacatatgtacacattgtgtaatcaatactccaaatactatatggaacatttctgtcatcctagaaagtttttagtgcccctttcagttagtccccaaacacccccataggcacccagtgattctgtgttgatattat

SEQ ID NO: 59606 - DNA, 601 bp, Human
actacatgagtgtaatggcagttatgatcagaagagactacccaaagaaagacttcatcccatcagtcagttttactctctgtagagaaaagtaattacaggaggataaacaccagcacatcaacagttgttgtctgaggtaatataggtgatttttattttctttttgatggttttcaaatgttctgtattgaacaagtgttgtctttttatcattaaaaaaatgccatcctatttatttatttatttagagatggagtctcactctgtcacccaggctggagtgcagtggcttgatctyagctcactgcagcctctcctcccgggctcaagcgattctcctgcctcagcctcccaagtgcctgggattgcaggcatgcgccaccacactcggctaatttttgtatttttagtagagacggggtttcaccatgttggccaggctagtctcaaattcctgacctcaagtgatcccctacctgggcttcacaaagtgctgggattacaggcatgagccaccgcacctgggcagaaatgctattttagaagtgatctcatgtgatactatgtttttcaacatgatgtcagaaattggtaacct

SEQ ID NO: 59607 - DNA, 601 bp, Human
tggagctctattttgaggtgtgttgagaccaaatccttctcctagatcccagtacttaagcctggcaggaaaaaaagctgagtacactgtggttttagagtgtaccttttgataaatagtttgcagcatgtccctgaaaggggaattttttcctttgtcttgcaaatgtcaaattgtacttttctgtaaactttgtaagtagaaatgtgaagtggtacaagtgctctgttgctttttggtgaaaatgctcacacatgatgaatttctcagttcagttgcaaagagaagttagtgaaacctracaggcaaactaccccacaccctggagaacagtgtcctgggggtgtctggtttgctaggtgtgtggctggtgcagcaatgggaaggtggcgctttgactgcctggcccctcacatcttgctcctcccttttcactgctcctctggcctccagagtagccatgtaagcctgtgctttcacgtacagaattgctgctctaccctgttcttggcatttgcgtaaaaatttactgtgttccgctgacaaaattctagaatctcaaagctggaatggagttcaaagttatatacccttcttcttt

SEQ ID NO: 59608 - DNA, 601 bp, Human
gtgctctgttgctttttggtgaaaatgctcacacatgatgaatttctcagttcagttgcaaagagaagttagtgaaacctgacaggcaaactaccccacaccctggagaacagtgtcctgggggtgtctggtttgctaggtgtgtggctggtgcagcaatgggaaggtggcgctttgactgcctggcccctcacatcttgctcctcccttttcactgctcctctggcctccagagtagccatgtaagcctgtgctttcacgtacagaattgctgctctaccctgttcttggcatttgcgtmaaaatttactgtgttccgctgacaaaattctagaatctcaaagctggaatggagttcaaagttatatacccttcttctttcaaagcatgaatatccaacatctgccgagcagtcatttttttctgtacttaaacacctataagcaaagaggaacttacttcctccactttcagggatgtacggcttttggaaatttcgcctttctgttgactcaaacattgtttcccagtagcttcagttcactggttctggaccacctataaggggtagacttaaaaaaaaaaaatacagctctcttac

SEQ ID NO: 59609 - DNA, 601 bp, Human
tcatttttttctgtacttaaacacctataagcaaagaggaacttacttcctccactttcagggatgtacggcttttggaaatttcgcctttctgttgactcaaacattgtttcccagtagcttcagttcactggttctggaccacctataaggggtagacttaaaaaaaaaaaatacagctctcttacaagaaagctgtggagatatgtgaaggcagtctgggtctcccaatctagtttacctgttaacaaaggaaatactattagcctgatagtcgctcgttctagctgtttcttcaggrttactgatttctcagtaatccataaaccatccatgttattaggcattctagatacttggatcaatatccggttgacttgtcacgttcttctcttacgaaatcagaactatctgaactagcagttggctaactgaactgagttatgttattatagctcatgttacttcttttgggtaagacttggtctttttttttgagacacggtctccctctgttgcccaggctggagtgcagcggtgcagctcactgcagcctagagctcctgggctcaaaccatcctcccacctcagcctcccaagt

SEQ ID NO: 59610 - DNA, 601 bp, Human
ttatgttattatagctcatgttacttcttttgggtaagacttggtctttttttttgagacacggtctccctctgttgcccaggctggagtgcagcggtgcagctcactgcagcctagagctcctgggctcaaaccatcctcccacctcagcctcccaagtatctgggactacaagtgtgtaccagcacacccagctaatttttgtaatatttttagagatggggtctcgctatgttgcccaggctggtctcaaactcctgggctcaagcaaccctcccactgtggcctcctaaagtgctggaattacagcttgaaccaccatgcccatccttggtctttaactggatattgttgatgctgactatagagtagcaagcacggtggaaagttaattggtgtggtgatctcaaaaaaggatatttaaattttcctgttgtaaggatctcaggaatttaattcctgcatccatttgagagtatagcttcagcctgtatgtgcacatgaaaatagagaaggtagtcataaatcccagaactgaggatctctgtgcacagcccactctgcaaaggtggatattttcctctcaaatcaatctgtgact

SEQ ID NO: 59611 - DNA, 601 bp, Human
aggtacctatggaactccttcaaatggtccatctcaaagttggaaataccaggataatgtttaagactggccacagactcaggttgattgcatggaacagcatgaaaatgagacagtattggcttacagttaagaacgaggctttgaagtcaaacttagatttaaaacttacccccacaatgtactgtaattctgtgatattgtaccaactctttaattctctaagcctccgtttcttaatctacatgaggataacagtactatccattccatggagttacagtgaaaattaattcatgtrgcttgcttattccagtgtctgacatcagcaaatcctccatatacattatcagttgttaagaagaaaagtgatccagggaaggaaattaaacaatgaatttacttgaaagacagattccataaggaaattgttgaataaattatggttatacccgtactgtggaatattatgcaacaattaaaagaaagaatacattagatctacatatattgacctggatggtttgtccctgatagataaataaatgaaaaaaagagagatgtgtgctcattttaatcccattaaaaaaaaaagcagtag

SEQ ID NO: 59612 - DNA, 601 bp, Human
aatctacatgaggataacagtactatccattccatggagttacagtgaaaattaattcatgtggcttgcttattccagtgtctgacatcagcaaatcctccatatacattatcagttgttaagaagaaaagtgatccagggaaggaaattaaacaatgaatttacttgaaagacagattccataaggaaattgttgaataaattatggttatacccgtactgtggaatattatgcaacaattaaaagaaagaatacattagatctacatatattgacctggatggtttgtccctgatagayaaataaatgaaaaaaagagagatgtgtgctcattttaatcccattaaaaaaaaaagcagtagcgaaagctacaccaagagtctcatacgtttcctcatttgtcatggctacataagggcttgcatcttgagctcttttttgttcatttcatttgttatccctcaatttctggcacagggcatggcaatatttcttttttcttgtcttcatttctgttttatttctagcaactgagccaacatttgtctgcaggaattcatggtggggagtaagtgatgagaagatgggtggaaacacagt

SEQ ID NO: 59613 - DNA, 601 bp, Human
attaattcatgtggcttgcttattccagtgtctgacatcagcaaatcctccatatacattatcagttgttaagaagaaaagtgatccagggaaggaaattaaacaatgaatttacttgaaagacagattccataaggaaattgttgaataaattatggttatacccgtactgtggaatattatgcaacaattaaaagaaagaatacattagatctacatatattgacctggatggtttgtccctgatagataaataaatgaaaaaaagagagatgtgtgctcattttaatcccattaaaaraaaaagcagtagcgaaagctacaccaagagtctcatacgtttcctcatttgtcatggctacataagggcttgcatcttgagctcttttttgttcatttcatttgttatccctcaatttctggcacagggcatggcaatatttcttttttcttgtcttcatttctgttttatttctagcaactgagccaacatttgtctgcaggaattcatggtggggagtaagtgatgagaagatgggtggaaacacagtatcatttattgactaaagagcagtgtcactttaatttaattttaaaatgt

SEQ ID NO: 59614 - DNA, 601 bp, Human
aatgctaaatcctcttcatacccttgtccccagtctctcaattcctcttcctcaagacatgtccttatatgtccttccagaaatggtctatgcatatgcaagctctgcatttgaatgtctcctgttgaaaaacaaatggtggtatattatctacctgaagaacagagattttttcctaagtctttagagagatgaaatctaaatccttaaagaaaggtagtaggtaggcaatcttttcttttcttttcttttcttttttttttttttttttttcgagatggagtctcactctcactcaggyaggagtgcaatggcatggtcttcactcactgcaacctccacctcccaggttcaagtgattctcctacctcagcctcttgagtagctgggactatagcacatgccaccacacccggctaatttttgtatttttagtagagacgggtgtcactatgttggccaggctggtcgcaaactcctgacctcgtgatccgcacaccccagccttccaaagtgctgggattacagacatgagccaccatgcccattcaatcttttcttttatcagaagggtctatgggtgacagttcaagtcctggaa

SEQ ID NO: 59615 - DNA, 601 bp, Human
caggtagagcagttgcaccagtcattatttataactggattaaagagtagcagcacatacttctaccgtggttatagagtgccttctgttgtacagagtggactgcttattcaccagggagttctcaaacacctttctctatgggcgctgtcccaaataatgtcaagagagaaaaaattaaaaatgagctcctgccctctaagaacagatgggagcagccccaaatcttgcaaatgaagcaagagggggtattcagtctttaatccaagcagctagaagcttgcctttcccaagttcaccsagtgaggattttaacactcctttgacaaagaaatggggccgagcagcagaggaaggcaggtgacactgagtcatggaattcaccctttcgagcccttcctgggggatgtgtggctcttgggttggttcttgaaggaaaggaatgaatgtaagagaggaagggaagcaggcttttttttttttttttttttgactcctacacagaagatggaattgagaaaaatatactgtggcggtgaaatcaacttacaaaactgaggaggaaaattttgacaaaagcaaacccaaaatctgattactg

SEQ ID NO: 59616 - DNA, 601 bp, Human
cctgccctctaagaacagatgggagcagccccaaatcttgcaaatgaagcaagagggggtattcagtctttaatccaagcagctagaagcttgcctttcccaagttcacccagtgaggattttaacactcctttgacaaagaaatggggccgagcagcagaggaaggcaggtgacactgagtcatggaattcaccctttcgagcccttcctgggggatgtgtggctcttgggttggttcttgaaggaaaggaatgaatgtaagagaggaagggaagcaggcttttttttttttttttttttgactcctacacagaagatggaattgagaaaaatatactgtggcggtgaaatcaacttacaaaactgaggaggaaaattttgacaaaagcaaacccaaaatctgattactgtggggctgtccattttattgctgcaccaaggagcagggtagatactattttggcctaaagaacactgaaattttgttttctcatttgcaaatagacaggttcaaacccgtcagaggccgtaactgagtttccctgtgactgatttgtatgtgtgttagtggttttttttttttttttcctgtaagaatct

SEQ ID NO: 59617 - DNA, 601 bp, Human
attttggcctaaagaacactgaaattttgttttctcatttgcaaatagacaggttcaaacccgtcagaggccgtaactgagtttccctgtgactgatttgtatgtgtgttagtggttttttttttttttttcctgtaagaatctggttgagtaattcagaaggttaaaaaacaacaaaacagaaataagtgagaaaagttaactgaggtctgccacatatgccgggaaggtgcccacagactggcagaatctgtgcagtctttgtctgtttctgcctatgcaaatactaagccacgctcarcagagcttgagcgttgtatctgttcaactgccatttaagaaataggactctgttctcaacagcttattccttggggtttcagaatgtaaaatattaagtgtgtataatcacaggccaggttcccagcatttctcggcatttcagctttggcaggaggaatgggaaaaactgaagtttttatgtccaggaaggctgagtgtaatctttgttctgtggcactgggaaaggaagtgaatctgttacaaagcgctttacctctgaagcatgtctcaggggcagctgtgctttgtgccatgtatt

SEQ ID NO: 59618 - DNA, 601 bp, Human
agagatggggtctcactatattggccaggcaggtcttgaactcctgaatttaagtcatctactcacctcggcctcccaaagtgctgggattacaggcatgagccaccgcacccagccgtctgaggcccattttgggcggtacactgcatggtcatcatacaaagaggtgtctgcatttctacttttttttctttaagatggtagaaccaaacaaaaaagggtgtttttacaaattgagaggggtccctctgtaggaggggaatttctccagcattttcctttgatggagtattctcctctygttcagaaataggaaatttagtaactaaagcattaagaacagatttattttttaacatcagtcactaccttagtttcagagacacactgggggaaattgcctttcccttacgcctcttgttttatgtcctttatatgagatgttaatatatttacatgaggtataaatttgtctgtaactttataggtttgtattcatttattaatccatccatccattcatttactcattcaacaaatgttaattgagacctattttttgcctggagatataatagtgaccacaataggcctgctccct

SEQ ID NO: 59619 - DNA, 601 bp, Human
ttgcctggagatataatagtgaccacaataggcctgctccctgcccacaggaagcaggcattctagtgtaagcacacaaacaagtaaaagtaattaccaattgtgaaagttacatggaaggaaataagtgagcttttatttgtggttttatttcatagagctgaaggaagtgaagagacagatacctctctccccacttctttcattgctgaatgtctgaagtatttcttactccattggactactatgacagaacactatcgattgggtggcttgtaaacaacagaaaattatttctcastgctctaaaggctggaaagtgcaaggtcaaggtaccagcagatttggtgtcgggtgagggcctgtttcttggttcacggatagctgccttctcactgagacttcacatggtggaagccgtgagagagctctctaggatttgtcttttcttttcttttcttttctttttttttttttttttttttttttgaggtggagtcttgctctatcgcccactgcaacctccacctaccggcttcaagcaattctcctgcctcagcctcctgagtagctgggattacaggcatgtgccaccacgcct

SEQ ID NO: 59620 - DNA, 601 bp, Human
tttggggatacataaacattcagtctatagcagtattttatctggggtttcaaactcaaataccttcagagtagaggccaatggggacactcctgtctcatggttctaaccagaggggacttgcatatccattcacctaaagctccgttaagaaaggtgaggagccccgagccagacccacaggaagtgtccccaggttgcatttggctctggtcacatattcactttttccagagtccccaaggtatactttagttccacatcaatgcctaccaggcctggttcagtcttacatttcaawaggtccccttgtgggtctcggagaaaaagagagcagcattagaattttactaccacagtgagtttttccacttcactttggaaacattgagctattcctacgcagtttggatgacagaaatactgtgctcagtgcaatctactggaaaatctgagtgcttggaaaaatgtcaggaatactctcttttgtcatggaatttctccatattgcggcggtacttcagtgtgagtcagcaggaggaacttcggtgcaccaagcaggcctcacatcagtggggttgtgcgtcccagctctgattga

SEQ ID NO: 59621 - DNA, 601 bp, Human
gatctgataaggggttagtatccaaagcatataagcaacttatacaacccaatagcaaaaactaataataataacctgattaaaatggacaaaggacctgaatagacatttctccaaagaagatatgcacatggccagtaggtttatgaaaagttgctcaacatcactaaccatctgggaaatgcaaatgaaaaccacaatgaaatatcacctcatacgtgttaggatggttatccaaaaacctgaggacaagtgttggcaagggtgtggagaaaagggaaccctatgcactgttggtggraatgtaaattggtgcagccactaagcaaaacaatatgtaggttcctcaaaaaaattacaaatagaactatcatatgacccagcaatcccattcctggatctataaccaaaggaattggaatctggatctcagagatgtctgcactctcatgatcattgcagcgttattcacgatagtcaaaatatggaaacaatctaaatgtccttctgcagacaaatagataaagaaaatttgctatggaatattattcagccttaaaaaagaaggaaatcctatcattccggacagtgtggatgggcc

SEQ ID NO: 59622 - DNA, 601 bp, Human
aaaaaaaccacagctcacaaaatgcccatgattgctgatttgattaaaacaactgtactagcagctggcaagtgtttttttagccactagttttaaggaacattcctgtttcagaagtatcaaaggggagggagcagcacagatcatagaatcaaagtgatacagagattagagttgtgttcccctctaggtagtgatagaggaattgtttcctctctaggcacagtgatagagggtggcttcgttaacagtattattaaggccatcttactgacagcaaaagggaaacaagacagagtcytgatagttgggtaaaaggatcagttaaatttgaaagcgcttccttttgtatgttccggtcagtcttctgcaggaggaggatgtataaagtccactgtgtcagaaaagcagtcagtctacccctccccagtttccatctgggtatctttgtgctcctggtcatttctttcccagaaattgggggatctggtctcagataagaggagtgggtttggatgtcccaatatcacatatggtaaggatgaaaaacatggataagatgattgagtttatcttgtatatgaggccatgtgttgtaaat

SEQ ID NO: 59623 - DNA, 601 bp, Human
tatgcagagatagaagtggactccagaaagaggcccccgaatcctgccattccctctccaaggtgccagagtttgcagtttccaggaattgcatgtgatgcagattgtaaattacgcgtaaatatgtatttgtgtcttaaatgacttttttagtttggagaatgcccttcaccctatgactggcataccgcaacacactcattagccctttgttggctgacactttgaaaacatgcagcctcaaagaccattgttaagtcatccatggggtttgtttgaccatgaaggagacttcttcacsattgagttaccaggttcaacaggtcctgggcatctgctttgtgctgtttacctctgaagatcaaaagataaatcagaatctttgctctcaggatttagtctactgggaattctaaacacacataaattgacgatgtaagatatggtaccataaatgctcagagtgaaatgcaaacagaatacagtgggtgcttagaaaaggcaactatgaatgttggctgggtgtggtggctcacgcctgtaatcccagtactttgggaggccagcgtgggcagatcacttgaggtcaggagttcgaaac

SEQ ID NO: 59624 - DNA, 601 bp, Human
aaggagtaggcgttaaagatgactccgagatttccagtgaaggagcttttaactgagtagggatagcaacagagtacagtttagtttttgtttttttgtgtttaaagaaacacttctggtagttttgcccataaagcagttagagatgcggcctggctctccggagagaggtgtcaggatagggatttagactggggagccatctgtctaagggaatacttgaactcacgggactcaactgcaaggtaaagtgtcaagcagggcaactgtgcacaactgggcagattgggccctgaacaamcctagggagtgccaccgtatcctagtcattgtagatttgtgcaatgattgaattttctggcagatggcagtcagatgtcttgagaaaggggcacctttttctaatgtgcacaaaggtaccatatggtgtggcaggaatgctggaagtaaacccaggcaagagccaagaacagaaccttagggaaccagctatcctataagggagggtggaggaggaggagcctccggaggagacacttaggggtggtgagagacttaggtaggatttaagtgtttagttgcctccaatttgcctgaaaat

SEQ ID NO: 59625 - DNA, 601 bp, Human
tgcccacacatgcttgtcattgctgcttcctggcgcttgtgacctcctttgcatcagtggaaagttacaggaggagagatagcaccacctttctagtcaggaatctgtcacgcaacccagatcaaaaacttcaagttcacttctgtgtcaatgggatcccgactctgtgggtggatagaacattgtgtggaaaggctgtaaaactcagagtgtaactgcagtttttatctgagtggctggaactctagcttgtttattacctagatcagacaggtaaaatgttctactttcaaataattcrtgtttttcagatcttgaattttggtaaatttttttcatcagttgattctgtttcttaatttgaggaatagagttccttttctaatgggaaaatatatcacttgtcatgtctgtggtgctttcttgtgttctacaaactctacgtgagcataggctgtctggctctggggatcagaagcactcagggagctctgaggacaggatttcatatactacatcctgaaactgggcagatgatcacatgaccctttttttttttttttttttttttaaagcagggctcagaagcagagagagaaag

SEQ ID NO: 59626 - DNA, 601 bp, Human
caggtaaaatgttctactttcaaataattcatgtttttcagatcttgaattttggtaaatttttttcatcagttgattctgtttcttaatttgaggaatagagttccttttctaatgggaaaatatatcacttgtcatgtctgtggtgctttcttgtgttctacaaactctacgtgagcataggctgtctggctctggggatcagaagcactcagggagctctgaggacaggatttcatatactacatcctgaaactgggcagatgatcacatgaccctttttttttttttttttttttttaaagcagggctcagaagcagagagagaaagagaatttttccacagcctcagagagaaaatccaggaaaatccaggagtagaactcatgaggctgaggttctggaactgtgttcccaaactgccttctctggaaaaaatgcagagggaaccagccgattcctagtaaaaaatttttgacttactgactttcaaaaagaaatgagttccatatgatgggaattgcattctttgatttggacttaaaggattttctgagcttttaaatggtttcctatgtaatattccatctcttctggtttg

SEQ ID NO: 59627 - DNA, 601 bp, Human
aacttaagaaatttcatcattccttttcttcctggctgaccttttaattttacgcaagatatacaggagtgatttgtcttgtctggtttgtaaggatttttaatcaccagccacacacattagtcactggcttttgtacgtacaagcccaattttctttgttttgggggttttttaaataagtttgtttgttcatttatttggagacatggatcctgttctgtcccccaggctggagtgcagtggcatgatcatatcctcaaactcctggattcacgtgatccttccacctcagtctcccragtagctgggactacaggtacacaccaccacacccagctagttttaaaaaaaattttatagagacagggtctcactgtgttgcccaagctgacacttacagtaacagtaggatcagactgagagctggaaaaggaacagcgcaatgggattggtagcataaaagatttaccaccagatgcagaaagcagttctcaccattgcttcctcagttccttagcatccaccacgcgcagaactttacactttacactcaaggggtgtatgaataaagggaatgcaaccaaagtttaaggtaagaa

SEQ ID NO: 59628 - DNA, 601 bp, Human
agcgcaatgggattggtagcataaaagatttaccaccagatgcagaaagcagttctcaccattgcttcctcagttccttagcatccaccacgcgcagaactttacactttacactcaaggggtgtatgaataaagggaatgcaaccaaagtttaaggtaagaaactcagagcttgttcagttcagttagtacttaattggctacccagccttgtgccaggtaccttgttctggggctagagagctgaaataagcatggagaagatctgcagggaaaccaacagatgcaatcagtgcaagaratgctgtcattagaagtgtgtaccaaacaccattggagcacaggcggagagacaccaaacttggcctaggaagggatgcagaggctttggagacagagaagcttcagttaagagtgaaaaagtcagcccaggagagaaatgagctcttccatttatctgtggtgataaatcaatgtgttttaatttttcctttttcagtccgtttaggaccaatactttttataaaatgtattaaaagtaaattactagaaaaatgaaatttccaaatacatataaaacagaagaccacatttttattat

SEQ ID NO: 59629 - DNA, 601 bp, Human
caaggtactggtgccagaccatgtcactgtatgacccatctggctttggctcctggctctattacccagagagcagtttataagccagatgtgtcacttaatagtaggcatacctgcccaaaatgcaaaagcttacagtagttatctagaatttacgaagcttgtttttactctttatcagtgttgattcttataaaaatcatgacagtaggccatgtagatattatctttcttgttgatgaataaataatagccaagggctctacagcacttaatgcattccaggcgctatgctaaacctaattcacattaagtaactcatcatttctatgaggcaggaactgttgttatctacatttcttgatgaggaaataagcccagagtggttaagtaacttgcccaagatcacacagctagtaaaactaaaactaaactcggctaatcaggctctaaagtctgtgcccgtagcctcacaatatgctgcccattgaaatcagacagacagatgagatgtggtatgacctccccaagccacttgggtaggggagggaagcagattgagggaggcaactgtaaaagcatggttgggaagttgtccttg

SEQ ID NO: 59630 - DNA, 601 bp, Human
aggtactggtgccagaccatgtcactgtatgacccatctggctttggctcctggctctattacccagagagcagtttataagccagatgtgtcacttaatagtaggcatacctgcccaaaatgcaaaagcttacagtagttatctagaatttacgaagcttgtttttactctttatcagtgttgattcttataaaaatcatgacagtaggccatgtagatattatctttcttgttgatgaataaataatagccaagggctctacagcacttaatgcattccaggcgctatgctaaacctaattcacattaagtaactcatcatttctatgaggcaggaactgttgttatctacatttcttgatgaggaaataagcccagagtggttaagtaacttgcccaagatcacacagctagtaaaactaaaactaaactcggctaatcaggctctaaagtctgtgcccgtagcctcacaatatgctgcccattgaaatcagacagacagatgagatgtggtatgacctccccaagccacttgggtaggggagggaagcagattgagggaggcaactgtaaaagcatggttgggaagttgtccttggc

SEQ ID NO: 59631 - DNA, 601 bp, Human
cagtactgattctagtgggcaggctgcctcccctctgatactgtgtaaggcattactaatgctggcaacagtttgcatatagccaattgccaaaagcagcctgcacatccctcctgaggctggtcccgtaaattcttctctttcctgtcgtaaagcattcctcatcaccacctcccttttcacactttatgcaaggccgtgcactgggacagcaaatggctgcaactttcactgcttgcttttcccaagtcgaagaaaagttccaacgctggcaaagcaaggacattgctattttctgacratcgaatgtcttcgaggaactagcttcagtgctgatagggtctgtgttcctctagtaagaatagcactgtttccattagaggggaccaggatgggtagacaggctaagacgtctgattactctttgctctgtgtatttgtatgacagctcgggtgtctggcttaccttcctgaggatgagagccatagcattatccatttaataacagccacagtgacagtgctgataatggctagcatttacctagcactgtgtgccctagaacatttaatagtttcactctatgaactcgtttgttgg

SEQ ID NO: 59632 - DNA, 601 bp, Human
cccttttggaaaacagtttctctacatctgtttaaatttaaaatatttatgccctttgatatggcatttctacttctaaaaaaatgtatcctaaataaacactcccacaagtgtgcaaatcatgttcattactccattgtttgaagttgcaaaaaatttaaaacaacccaaatgtttatgtagaggaactggttaaattgtggtagatttttatagtggaattgtatgcaaccattatagagaatgagccagaggcataggagatataaatatgtccaagacaattgttgagaaaagtatkttactgtataatattgtgttagtgtagcattgagaagaaaagtttgaaagactgaacccatcatcattttctctatacctttttcaggaatgatcaattttatataatgaaaatattacttttataatcaaaaaaacattttcagataacatttaaaaattctattataaacatttccttacatttttagtccttcataaaaatttggcagctttcataagattctgtcatagaaataccattatttatttagccattccacggttgatacataatttagctttttttcaaattatatat

SEQ ID NO: 59633 - DNA, 601 bp, Human
taaacactcccacaagtgtgcaaatcatgttcattactccattgtttgaagttgcaaaaaatttaaaacaacccaaatgtttatgtagaggaactggttaaattgtggtagatttttatagtggaattgtatgcaaccattatagagaatgagccagaggcataggagatataaatatgtccaagacaattgttgagaaaagtattttactgtataatattgtgttagtgtagcattgagaagaaaagtttgaaagactgaacccatcatcattttctctatacctttttcaggaatgatyaattttatataatgaaaatattacttttataatcaaaaaaacattttcagataacatttaaaaattctattataaacatttccttacatttttagtccttcataaaaatttggcagctttcataagattctgtcatagaaataccattatttatttagccattccacggttgatacataatttagctttttttcaaattatatatgatgcagcaaccaatatctttgtaaaataagattcttaattttacactcacaagagtatcatatcacatagcagagattgagaatttaacctgaa

SEQ ID NO: 59634 - DNA, 601 bp, Human
gagccagaggcataggagatataaatatgtccaagacaattgttgagaaaagtattttactgtataatattgtgttagtgtagcattgagaagaaaagtttgaaagactgaacccatcatcattttctctatacctttttcaggaatgatcaattttatataatgaaaatattacttttataatcaaaaaaacattttcagataacatttaaaaattctattataaacatttccttacatttttagtccttcataaaaatttggcagctttcataagattctgtcatagaaataccattayttatttagccattccacggttgatacataatttagctttttttcaaattatatatgatgcagcaaccaatatctttgtaaaataagattcttaattttacactcacaagagtatcatatcacatagcagagattgagaatttaacctgaaaataatccattgggtgattctgaatgtacaagattgatgtttttctaatctttttattttattttattaattttttttttttaagatagagtttcactctgttgcccaggctggagtgcaatggtgtgatcatggctcactgcagccttg

SEQ ID NO: 59635 - DNA, 601 bp, Human
cccatcatcattttctctatacctttttcaggaatgatcaattttatataatgaaaatattacttttataatcaaaaaaacattttcagataacatttaaaaattctattataaacatttccttacatttttagtccttcataaaaatttggcagctttcataagattctgtcatagaaataccattatttatttagccattccacggttgatacataatttagctttttttcaaattatatatgatgcagcaaccaatatctttgtaaaataagattcttaattttacactcacaagagyatcatatcacatagcagagattgagaatttaacctgaaaataatccattgggtgattctgaatgtacaagattgatgtttttctaatctttttattttattttattaattttttttttttaagatagagtttcactctgttgcccaggctggagtgcaatggtgtgatcatggctcactgcagccttgacctcccaggctcaagtgatcttcccgcttcggcctcccaaagggctgggattcaggcgtaagccactgtgcccggccttaatctttttaaagcttacctggactataggtg

SEQ ID NO: 59636 - DNA, 601 bp, Human
ctttaagtataaacccaggcactcaaaacacaagccagtcctaagtagttttattctaaaattaagaccataacccacattcactcacttggcagatgcccccttttcacacttacctacatgctagttcctcctcctcagtggaaggcagcaaatgatctgcacatttgaccacttgagagatttgctgtgcactcccctatgcctgtatcctcaaggactctgtaaaatccattgaactctatgcacaagctaagaaaaaaaccttgctttgcagtatttcgattatgcatttcatagyaatatgcataaaacatccctctatcatagtgccatcttagaatatttattgattccctcaggtggttcttgtttcaattaaagtccttttgggaaacaatctatccgggggattggccggtgacactgctacatagaagggattgggcctggtgtagtaagtcacaagcccaggccttggaggtgagcagaagtaaatctgaatcctgattttacccctgtctagctatataatcttggggtagagcctacttcatagagttattttgaggataaaataagaatatagataaagcactta

SEQ ID NO: 59637 - DNA, 601 bp, Human
agtagttttattctaaaattaagaccataacccacattcactcacttggcagatgcccccttttcacacttacctacatgctagttcctcctcctcagtggaaggcagcaaatgatctgcacatttgaccacttgagagatttgctgtgcactcccctatgcctgtatcctcaaggactctgtaaaatccattgaactctatgcacaagctaagaaaaaaaccttgctttgcagtatttcgattatgcatttcatagtaatatgcataaaacatccctctatcatagtgccatcttagaayatttattgattccctcaggtggttcttgtttcaattaaagtccttttgggaaacaatctatccgggggattggccggtgacactgctacatagaagggattgggcctggtgtagtaagtcacaagcccaggccttggaggtgagcagaagtaaatctgaatcctgattttacccctgtctagctatataatcttggggtagagcctacttcatagagttattttgaggataaaataagaatatagataaagcacttagcatttgatgaacattcagtatatgttaaccactgaagacact

SEQ ID NO: 59638 - DNA, 601 bp, Human
ttcagtatatgttaaccactgaagacactgttattcttgttattcacaaaagcttttttccaggttttctagacagacccacagactcaccacccccaaatgagcaacagacaaatggcagtatgctgacaatcataaattgactgtgtattttatgataatgggtatcaaagttgtactctattaaagaattattatctttgagattcagatattaaaatgtgtatagatgaaatagctcatatcctggatttgtttcaaaataatctgataaaagatggatcagggagggagggagtcratgtagcgagggagcatgtttggacgtgcattggcaggtgccgaggctgtgtgatcagtatgggagttgtgtcattctccctacttttgtctgttttgaaatttcccataataaaagttgaaaaatatgttaaaaatagttcatataaatagcctcctagattcattcttgttcaaggagccagctctcaactcgctttcctttatttcttttggaagagtaactgattctagtgatctaagcagtaagactcatgtcaatctgttttattactctcaggatagcttatggtggaaacaa

SEQ ID NO: 59639 - DNA, 601 bp, Human
gatgaaatagctcatatcctggatttgtttcaaaataatctgataaaagatggatcagggagggagggagtcgatgtagcgagggagcatgtttggacgtgcattggcaggtgccgaggctgtgtgatcagtatgggagttgtgtcattctccctacttttgtctgttttgaaatttcccataataaaagttgaaaaatatgttaaaaatagttcatataaatagcctcctagattcattcttgttcaaggagccagctctcaactcgctttcctttatttcttttggaagagtaactgaytctagtgatctaagcagtaagactcatgtcaatctgttttattactctcaggatagcttatggtggaaacaaaataaatccaatttctgaatctcctttgtcttcaatcacttgggaattctctctgaaactactgtgggcattttaagtaaccctgattacccagcaagaacaatgtagctttcagacaagcacagaggatagaataactctttctacccttctatgcttgcatgacaaaagctgtagctattaaataccggtgctcaatgagctaatgaatggcaagccggtaactgt

SEQ ID NO: 59640 - DNA, 601 bp, Human
ataattgacccttcaaaaccactttctttctccagcttcatcaaagagaagaatttaaattttgatttcaggtttcttcttttccctcttgagtctatctttaaggggtaaaacatgtggctttttataagtttaagtactttggagcaaagtttatggagtgtccttccatcccctaaaaataagataggctctgagttggccagggcagtcccattggggtccatctgaaatgcttctgtttatccctttggtcagcacctcctgccaggaccatgctggagctgctaagaaggaagasaggtgcacagacagagccttctggaatacagtgcggggtatgctatcatagaagtataaactgggcaccctaggagcagagttgatattgctatgactgtctggggacatcaggacagacttcatagagcaggtatgagatacttgggctgagggcagcactggtagcctggaattacattatgctcttaattgaaccctcttgggatcccagtttgagtgatctgtcttattaaatagcacttggtatgagaacagccatggcgtttcctttacagctcatacagttctgagaatgcct

SEQ ID NO: 59641 - DNA, 601 bp, Human
tctgagaatgcctaaaattagattgaaatcaggattaaggtgtctaacctgcctttgtggcctcgggcatcctgtgaccaggatgagtcacatccctgtcttgcccacttgcgtcttctgagagctgcgtcccaagacttccccatgcagagctgattgtaatagttgactgacaaaactgatggcccagcactttctctccctgcgcgattcctgctgcccatgacagcagctgagtaataagcagtcagacctcttacctgggacattagtcacaagctcttaagcaactgcgggtcarcgcttgagaccgttttggatttctgttagcacttgtttctgttgcccaagaagatcctttccaagacttcagcaggcatactggcttcgggaaaattcagaaactcagtgaccttgtttggaaatgtgagtgatagtgttctgggctcaggtccacacaggcctggcttgtcaggctaggacacagtgtcgataaagctgggctcatgggctttgtccccccggccgtgctctctcctggggctgcagactagtgtgtctaacctcagccaggcgcctctctactgtgtgcccgcagtcc

SEQ ID NO: 59642 - DNA, 601 bp, Human
tactgattttgctttcaccgaagccctgcttcctttcccctgactaactccttattttccattccattcatcactgtcctggttcaggtcttaacatctcttccctggacggtttcagcctcccccaactgatcttttcttgtccagccaggaatctgttactcccttaatgagggagcatcaatgagttccttttgcctaatatgtaaaaatcaaaattccttcgtgtgacattcaggacccttcatggtttgaaggacttaactttcctctgtagccctgagatttttcatggccccarcactcctctgtcctgtgctgcccgcccctcagcctcctccaccatacccagggttctctgagtccacctgcacagccatactgctgggcttgctgccgtgtccctgccccatccgcctgtccatggcggccttctcactcccccttctctgcctgggagactctgactcatgctatcagacccagctcaatttctgcttctgctgtgaggctgtctctctctcctcccactagaaggaattgttctctcttatgtttctctcgtagcacttggttcataccttcatcgtgccactaggat

SEQ ID NO: 59643 - DNA, 601 bp, Human
ggtgcaatgttgtaatggatcatgttgagaaagtcttttctgtgtgtgcatttaaggcactgtgctggatgcctttgaattgaggataaacatgtactggacgcctttatgttgaaaataaagtacatgtaatttgggtcagttctgtaaccacattagttgagctccaaaatcatgtattttcacctactatatgcagaggggttgtaaaggcaaataaaagatcagtttttcaagaagggataaatcagaacaatctatattctgttggatagtatctatggcataagaattactatcyttaagttatatcctttcagtaatttgagacaaaagcaaaatgtgggaaatatttgctatcttgttgaaagacttgtttctctttagaaacttctagccctataatcagtgccatttcagggacattttttatgtgggtcactgtgtactggggctgaaggcttgattgtccctgagaattctctacatcgctaaaagagaaataatcacagaaatccttctgaggcaaatattaccaaagtgaatcataacacatagctcaatcctcaagctgaggtgtcagtaccctcctgaaactgag

SEQ ID NO: 59644 - DNA, 601 bp, Human
agaacaatctatattctgttggatagtatctatggcataagaattactatctttaagttatatcctttcagtaatttgagacaaaagcaaaatgtgggaaatatttgctatcttgttgaaagacttgtttctctttagaaacttctagccctataatcagtgccatttcagggacattttttatgtgggtcactgtgtactggggctgaaggcttgattgtccctgagaattctctacatcgctaaaagagaaataatcacagaaatccttctgaggcaaatattaccaaagtgaatcatwacacatagctcaatcctcaagctgaggtgtcagtaccctcctgaaactgagaaagcactaatttcacagaaataaaagcacagtactttgggattctaccaaatatctcctatctaacatgtttttgtaagaacagttcatttgttatattagtagaaattttagaggaaaccataaatatggcttttataattttatggaaaaaaaaagtcacagagaagggcttgtcttcgtggatttgtgccatgaagtttcttaacttcctgaagggaaatgtactcacctaggttggctgcagcc

SEQ ID NO: 59645 - DNA, 601 bp, Human
aatccagatcagtgtttctctgatagataccctatgccttttgaatctaggtctagtagaaatcttaagaggccacatcaccatttgagttggacattcctaattttttgtctttacatttttagaagtcctcaacctcattctcgtgtttcagagtcctcttgagagaatgctttccaactaaatctgaaactaggtatcatccccttagcctagaacctaggacaagtactaagcaaggttaagattcctatggaatttttaagacttgtttctttttaaccgggtgagctcagttacytcaagctatatcttttatgtaaatatggatatttttggtaacgagcagatacactgtccagtaatagcctcatggtctttcctccaagaggaaacagcctctggtgcctaaggagaatcacatccagtggagactgagttgttctctctccttgcaggttcacttttgggaagctacaagtcccttcacttctctttatttcagctcctttctcatgccagctgctccactgatggaggcagcagctgcgattgttacatatcatgcgtctagcactcattttcctaaataacactcgac

SEQ ID NO: 59646 - DNA, 601 bp, Human
tttagaagtcctcaacctcattctcgtgtttcagagtcctcttgagagaatgctttccaactaaatctgaaactaggtatcatccccttagcctagaacctaggacaagtactaagcaaggttaagattcctatggaatttttaagacttgtttctttttaaccgggtgagctcagttacttcaagctatatcttttatgtaaatatggatatttttggtaacgagcagatacactgtccagtaatagcctcatggtctttcctccaagaggaaacagcctctggtgcctaaggagaatcrcatccagtggagactgagttgttctctctccttgcaggttcacttttgggaagctacaagtcccttcacttctctttatttcagctcctttctcatgccagctgctccactgatggaggcagcagctgcgattgttacatatcatgcgtctagcactcattttcctaaataacactcgacgctgtctctgggtatcttccacataggaaggagcaggggctctgggctcacagtgccgggcctgcctcccagtcctgttaccttctggctgagtggccttggtgagcctctgtgcctctc

SEQ ID NO: 59647 - DNA, 601 bp, Human
gaaggagcaggggctctgggctcacagtgccgggcctgcctcccagtcctgttaccttctggctgagtggccttggtgagcctctgtgcctctctgaatctcagtgtccttgcttgtaaaatagaggtaataaaatccataccatagggtgattgtccagattatatgaaataatataggtaaacttcccgggcacataataagcattctgttttttcctccttcaaggcatgtaccttcaatgtaattttcttaaaaacacttaaatgttgtcagataaaattactaaaaaaaaaaaaaatcactaagaggatttctgggatttttttttttttgtgtgcattttactctccatgcctaaaaacaagaagcttaaatggtatagatgaaaacattcagctagtctttgcaggggactgagacatttaaatagaaatgtgatcaaagagaaaaaagaaatgttcagagcactcaagacttgaggagacacactgaggagggaaaggcatcagaattgggttggttaagaacctgcctccagagcagagctgcctgggggcagatcttggctctttgactaataggctgtgtgaccttgggc

SEQ ID NO: 59648 - DNA, 601 bp, Human
tagggtgattgtccagattatatgaaataatataggtaaacttcccgggcacataataagcattctgttttttcctccttcaaggcatgtaccttcaatgtaattttcttaaaaacacttaaatgttgtcagataaaattactaaaaaaaaaaaaaatcactaagaggatttctgggatttttttttttttgtgtgcattttactctccatgcctaaaaacaagaagcttaaatggtatagatgaaaacattcagctagtctttgcaggggactgagacatttaaatagaaatgtgatcaragagaaaaaagaaatgttcagagcactcaagacttgaggagacacactgaggagggaaaggcatcagaattgggttggttaagaacctgcctccagagcagagctgcctgggggcagatcttggctctttgactaataggctgtgtgaccttgggcaaatggcataattcttgcatgccttagtttcctctccatttccttgggcaaatggcctaattcttccatgcctcagcaggtggggtgtacaacccacagggctactgcgtggttggcatgagataacatgtgtgggtgcctgaa

SEQ ID NO: 59649 - DNA, 601 bp, Human
tctgaagtgccaacgtaagtctttgaagaattccaagcaagcatgagtgatgcaatcactacttcatgtgtaaaagatcaccctggctattgtataaggagtggaccaacagactggagtatttgctgattaagtgacttctaggatttctttcaaattaatccaggagttgtggggaggaacagatgaaacaatattgggcatgtgtcagtaaccatcaaggctgagtgatgagtacatgagggtctgtgttactgtcgtctaaaatttccacatggaaaagttgttaaaaccaccatayaaatgaatatcttttataaacaagctcagcgtgtgtgtatgaagaaacatttctagcctgtatagaaaaagtgatctccatcttcacaaatgaagggaaatggtttacaatacaaatatacagaaagagcaaatgatgtgagccacatacaagctcccctgtggatcctggccacatctcttaaatccagtctcgggttcctggcctgggagtctatgtcaccctcatgattttttgccacagacaaaattaaccagtggttttagcacaactcatttcttcagcatacctgaagagtat

SEQ ID NO: 59650 - DNA, 601 bp, Human
tttagcacaactcatttcttcagcatacctgaagagtatctatgccttctcaagaagtgtccttcaacctccagggtagtaatgaagggtaccccaaagaagcatttttaacagaaaagagaccagagaaggagagaatcctcactgttggactttgccccatgctgcctccttgggaccctgggagatcctttcccggcctgctggatctgccctttccccctgagaggcaggaagagctgagatctccaagccagaccttcacagtgcctctctctacagtcttagtgtgggaggggcrtctttccatggcttcctgagatggagatttatttaagaaggaaagcttgttgaattccctcttacctttttaaatgaaaggtattattattattctatatctggggaaactggtcagacacctgtttatgttacatgccatagagttacagatgttaaagacctcagggcttcatctggcgtgatgtcagcgagggcctacattcagggttggggagggtgtgtactgtccagcattcctctaaaagtgtgtgactggcaaggcaggctccagcatcttctgaccactaatctaatatta

SEQ ID NO: 59651 - DNA, 601 bp, Human
gttgaattccctcttacctttttaaatgaaaggtattattattattctatatctggggaaactggtcagacacctgtttatgttacatgccatagagttacagatgttaaagacctcagggcttcatctggcgtgatgtcagcgagggcctacattcagggttggggagggtgtgtactgtccagcattcctctaaaagtgtgtgactggcaaggcaggctccagcatcttctgaccactaatctaatattactgtccccacaggccctccctgtcatcacctttaccactgccctctccmcccgcaacacccccgaggttgtggacttgtgagttctttgtgtatagctgttcaaacatttcctatagacgtgggtagtggacaaaggacttgcttgtgagaacttttcccatggagtgcagaatcagtgggtgcgggggtagtttgagcacacttagtttttagcccaggatttctacttgaaaagaattccccaaatcattaaccagtaatcgcacatctaaaagtaactttatatgcacccaaataggcacactgggaagactatttttcttgcttccccttctgtctttctcatct

SEQ ID NO: 59652 - DNA, 601 bp, Human
ttgtggacttgtgagttctttgtgtatagctgttcaaacatttcctatagacgtgggtagtggacaaaggacttgcttgtgagaacttttcccatggagtgcagaatcagtgggtgcgggggtagtttgagcacacttagtttttagcccaggatttctacttgaaaagaattccccaaatcattaaccagtaatcgcacatctaaaagtaactttatatgcacccaaataggcacactgggaagactatttttcttgcttccccttctgtctttctcatctttgcttcaaatgtttctgytcaatacttaacgtgtgcttgcctcaaaagcagcctgacctgcgactcgcagagaatggagtattcacactggcaggatcctcagaaattaacacaaaaaaggcatatgacgatgacacacacatttgtgtaaagaaaaaataaaaggcattccagctgttatttcttaattttttttaacttggtttgggaatatatactacctgttttctggtgtcaacatgccatcaggtttcttaggctgactaaatcatcccaaaatgctgataatgatgggacaaaagaaagtctatcattttt

SEQ ID NO: 59653 - DNA, 601 bp, Human
ctgccaggaagataaagatgtcaaagcttttgtaaaatgaccacggaaacttttcctgtgtggagatttgctaaccggtgtctgtgggtcagaaaagctttttgtttcgagttagaaaaactcttgtcaacaaaagtatttgactttgttgttttttgtttgtttgtccttgccaactatcaaaggtcagtaatttggggcagttgatcattagatttggtttggatgccaaagataatgcgcatccaggataaagaagggtactggccttgatttcatcagaggaggataaaggacattrtatagtccccactagagaatctttgtttagcactcacttctcttcagtagctacatttggggaatcatacctggaaaaaagtagttcgtatagcttgggcatgtagggtagcagcagctttttcttaacacttggaagtcattggagagcattgaaatccgccccatcagtcagagctgcttgagactggtttgtcaggaatagaagcatgttgtctaacaacgggcattggcacaactgcatgaccttgggtttccatctccgagacttgcctctaacctttacctacggttaatcaac

SEQ ID NO: 59654 - DNA, 601 bp, Human
gagttcaaaaccaggctggccaacatggtgaaaccccgtctctactaaaaatacaaaaattagtcgggcgtggtggtgcacacctgtaatcccagctactcgggaggctgaggaaggagaattgcttgaacctgggagggggaggttgcagtgagccaaaattgtgcaccattgcactccagcctagacagcaagagcgagactccatatcaaaaaaaaacaaaacaaacaaaaaactattgtttgtattctcgttttaagattgtcttagaaaaggttttctgtcaggaaaaaaaaaaaagttttccaaatagggtttggtggtatgtgcctataatcccagctactcaggaggctgaggcaggaggatcacttgagcttaagagtttgagaccagcctgaacaacataggaagatcttatctcagaaattaaaaaaaagcaagaaaaaggaacattattttccaaagaccattcctcccactgcactactggagcctaggacagtgaaggcagaaagagatcttgttctctcttacctggctgtagaggaacagggagagccagatgagcctcagggtcaaggctgacctcagagtgta

SEQ ID NO: 59655 - DNA, 601 bp, Human
aagcaaataatgaaagttttctgcaaaaggattatgctgtcaccattcacagcagtaggaacagagagtttagggaaaggcctgtgcccagcctaggatggcaagctatccacctccaactccacaccatctgcaccaacgtgaactgtgaaagatttcaggcctgggactaatgttaaatgttcccttaactcctcatctccacatcactggacgggggtagtggtagaagggccaccccaccaccaccacaacacacaaagcttctacccccttagtatcaccccggaccctccttctyccggtcctggtttctgtttcatggtattcatcctcctctggcctcttcatggcatcctccagctgccactctggctgcttctcaccctacgccaggggtcaggagccatgaaagtccgtgagtgataccagccaggtgggaggtgatagggagtggtggggcatgtgactgactgggcatctggtgccccatgaaaagcagaagcccctgctcaactccaggccgtttctatgagaggagtgcaggcccagtgttcccgagtatctcattttccacgagaagttggaaaacctgactttt

SEQ ID NO: 59656 - DNA, 601 bp, Human
cctaggatggcaagctatccacctccaactccacaccatctgcaccaacgtgaactgtgaaagatttcaggcctgggactaatgttaaatgttcccttaactcctcatctccacatcactggacgggggtagtggtagaagggccaccccaccaccaccacaacacacaaagcttctacccccttagtatcaccccggaccctccttctcccggtcctggtttctgtttcatggtattcatcctcctctggcctcttcatggcatcctccagctgccactctggctgcttctcaccctacrccaggggtcaggagccatgaaagtccgtgagtgataccagccaggtgggaggtgatagggagtggtggggcatgtgactgactgggcatctggtgccccatgaaaagcagaagcccctgctcaactccaggccgtttctatgagaggagtgcaggcccagtgttcccgagtatctcattttccacgagaagttggaaaacctgacttttcatgtgatgtgacatttcctagcgtttaaatatttgagaagtaattaaaattatttcaaaacacactaggtaggccaaataaaatgtgtct

SEQ ID NO: 59657 - DNA, 601 bp, Human
attatcctgtactaatccttgctcaggaagtgatcaaaacacctttcctggctattttgtgaaagcagatttagcccagcatattttgataggagcccagcactaaggaagtttcccaactgatggaaatacagagaatctctatgcacacatcgcttagctgtgtggcagcgctcgttttagtttttggtctatggagcaatggaatctcagtcattgaacctacttcgaaacagcagtggtggggggaacatcttgaagaaaagcctttcatctagagctatgatatcttcgctgcatraagaaaagtggccaactttgttttttctagagccaggacacagaccttttcagtatgtcacctttgctgcttcttcacacagatcttcaaaaataacgactctctctcctctctgtggtctcgtcagagagcaggaatcctggccagctggtcaggtcactcagaaaaatggcacagctgtttctgaaagtagccccattcataagatgtctgctgcccacaactgcagtgttggggaaaggcacactgttataaagagcttcttttctttaaagaggaaagaaaaatacatggtgttta

SEQ ID NO: 59658 - DNA, 601 bp, Human
aacgactctctctcctctctgtggtctcgtcagagagcaggaatcctggccagctggtcaggtcactcagaaaaatggcacagctgtttctgaaagtagccccattcataagatgtctgctgcccacaactgcagtgttggggaaaggcacactgttataaagagcttcttttctttaaagaggaaagaaaaatacatggtgtttacagaaaagaaaactggaccctcctgctttcttttagtggccatgtctgaaatggaagtgggaaaagccataaatccacacaggcaatcgcgcctwtaaggcatgattcatactgactgtgctgcctgtgatggaaaacccagctagttaagcaagacctgccagaaagtctcgcacagctcctctgccatggctgatgcctgctgtcttgtgacgtgctggttgtatgtgaatgaatgattgacactttctctctctctcactcagttcatgaccaagaaccccaccatgcgcttgggcagcctgactcagggaggcgagcacgccatcttgagacatcctttttttaaggaaatcgactgggcccagctgaaccatcgccaaatagaaccgcct

SEQ ID NO: 59659 - DNA, 601 bp, Human
ccaagagaaggtggaggagctctaaagtctgtgtcactgttcgctgctctgccatgggatgcaggtcaagctgggcctggtagccctactgaagctccctcccgatccgaccccctactccggtctgctgggtgtcttcatctggctgaggtctaactctgcatcagctgatagaggcagggtcaggcatgctccaccccagcagggactcagctgccctgggatgtagggggtggtcagccggcctgagggtgaaggccgctagtcctaggggactgtgcccaggggtgtgacttggggagggaagcagggctctgcaggacaaggtgccaggctcacgtgtggcccctgcggagagtattctgggaggaggatgagccgcatggcctagatctcatcttgagcagcatcaagcccacccagagtcagcatagtctccatccacacctgctagaccctgggaaatggcacggtcgtggcacagacccagctgctgctgcaggttaaaagaggccgaggggacaggacagggctgaactcatgcactcatggcccaggagcgtcctagggcacgaaggccgtcaacagacagggaaagctg

SEQ ID NO: 59660 - DNA, 601 bp, Human
cctctggtgtcagtctgctcctctgtaaaataggctccagggcccaacgatctacaatgccccatgcttcactcccagtgagagagaggtgcaggccagcggggaccctacaccagggaatggccctcctgtgcagggagagggccccagctgacggctgcgggagaaacgcggctggtctggactcctctgaatttccaagagaaggtggaggagctctaaagtctgtgtcactgttcgctgctctgccatgggatgcaggtcaagctgggcctggtagccctactgaagctccctcccratccgaccccctactccggtctgctgggtgtcttcatctggctgaggtctaactctgcatcagctgatagaggcagggtcaggcatgctccaccccagcagggactcagctgccctgggatgtagggggtggtcagccggcctgagggtgaaggccgctagtcctaggggactgtgcccaggggtgtgacttggggagggaagcagggctctgcaggacaaggtgccaggctcacgtgtggcccctgcggagagtattctgggaggaggatgagccgcatggcctagatctcatcttgag

SEQ ID NO: 59661 - DNA, 601 bp, Human
agtgagtcacacacctgcatgtcttagggttgcaacttcagaagagaactgaatgctttccctgcacagtgccgccccaaaacatgacttgtcagaactgtggagaagcatgggatgagggaccctgggaccagggtgctagaccttgccctgtggaaccacacacaagtcctgtagaagcacaagcaaggcctgtgatccctctggtgtcagtctgctcctctgtaaaataggctccagggcccaacgatctacaatgccccatgcttcactcccagtgagagagaggtgcaggccagcrgggaccctacaccagggaatggccctcctgtgcagggagagggccccagctgacggctgcgggagaaacgcggctggtctggactcctctgaatttccaagagaaggtggaggagctctaaagtctgtgtcactgttcgctgctctgccatgggatgcaggtcaagctgggcctggtagccctactgaagctccctcccgatccgaccccctactccggtctgctgggtgtcttcatctggctgaggtctaactctgcatcagctgatagaggcagggtcaggcatgctccaccccagca

SEQ ID NO: 59662 - DNA, 601 bp, Human
tgtgattttcaaggcaatatttctaaagtgagtcacacacctgcatgtcttagggttgcaacttcagaagagaactgaatgctttccctgcacagtgccgccccaaaacatgacttgtcagaactgtggagaagcatgggatgagggaccctgggaccagggtgctagaccttgccctgtggaaccacacacaagtcctgtagaagcacaagcaaggcctgtgatccctctggtgtcagtctgctcctctgtaaaataggctccagggcccaacgatctacaatgccccatgcttcactcycagtgagagagaggtgcaggccagcggggaccctacaccagggaatggccctcctgtgcagggagagggccccagctgacggctgcgggagaaacgcggctggtctggactcctctgaatttccaagagaaggtggaggagctctaaagtctgtgtcactgttcgctgctctgccatgggatgcaggtcaagctgggcctggtagccctactgaagctccctcccgatccgaccccctactccggtctgctgggtgtcttcatctggctgaggtctaactctgcatcagctgatagaggc

SEQ ID NO: 59663 - DNA, 601 bp, Human
ccccaggcctccccagtaacttgtttctctatgccaatgccaaggattaactgaattccgctacctatgacccagggggcagggacactggatctattctaggaaggttctcatgtgatgatgaaatttcggcaaacttccagttcctggcattcagtccacagagcatctcattcctgccatttaacccagaggtatttttcctcatttctcactaggagatgagatgctcacatacattgatgttttaggccaataaacattgcttcccacgtgcttccattccaggtgtgattttcamggcaatatttctaaagtgagtcacacacctgcatgtcttagggttgcaacttcagaagagaactgaatgctttccctgcacagtgccgccccaaaacatgacttgtcagaactgtggagaagcatgggatgagggaccctgggaccagggtgctagaccttgccctgtggaaccacacacaagtcctgtagaagcacaagcaaggcctgtgatccctctggtgtcagtctgctcctctgtaaaataggctccagggcccaacgatctacaatgccccatgcttcactcccagtgagagag

SEQ ID NO: 59664 - DNA, 601 bp, Human
tgccagctggcagggatgccatgccccaggcctccccagtaacttgtttctctatgccaatgccaaggattaactgaattccgctacctatgacccagggggcagggacactggatctattctaggaaggttctcatgtgatgatgaaatttcggcaaacttccagttcctggcattcagtccacagagcatctcattcctgccatttaacccagaggtatttttcctcatttctcactaggagatgagatgctcacatacattgatgttttaggccaataaacattgcttcccacgtgcytccattccaggtgtgattttcaaggcaatatttctaaagtgagtcacacacctgcatgtcttagggttgcaacttcagaagagaactgaatgctttccctgcacagtgccgccccaaaacatgacttgtcagaactgtggagaagcatgggatgagggaccctgggaccagggtgctagaccttgccctgtggaaccacacacaagtcctgtagaagcacaagcaaggcctgtgatccctctggtgtcagtctgctcctctgtaaaataggctccagggcccaacgatctacaatgcccc

SEQ ID NO: 59665 - DNA, 601 bp, Human
aggtaattcctcataatacagcatgtatgttcacagaaacccccatgtatgtgaatgtatgtgcacagacacccccacacatatgtgcacacacatatactcacacacccacacctatccatgcataaacccccacacttccccaacacatccacacacccacttgcacacactcacgtgcacttccccacacaaacctatacttggaaacacatatgcatctccacgtgtacacacactcaggcacatgcacacgtaccctgcagaacatgtgcatcacacacacacacacacacacacacccctctgcagtgtatgactggccctggacccatataaggcacatacccttttcagatgtggctggtcatggaaggggcagttgtccaagttgggctgggtcttggtacacgtggttcggcccagctccacgtccaagaagtagttcaccccagctacgatctacacatgtgaaagagcaggaggcagggacagcacgttctgtcagtttcttacacacacaggcacttcactgtgaccgggtcactgggcttgcctggggcttcaagcctaccttcatgagctgcccacattgtcacct

SEQ ID NO: 59666 - DNA, 601 bp, Human
ataacagttgtacctgtaccctgaaaaaagtaaatgtcaattttttaaatgcttttggacttttttatttgggggacaatgtgacatttcagctatagttcatattctgtgtccacacacccaagagctttgaaatctaacatgcctttctgtggaggcactgtgactccacaggacttatctggtggatgttagtacctgtgtaagctgggtgtcctcccttctaatccccactcacccaagaggtttgctgcttctagcttatcatggggattatggctgccattttgattctgtcctyatgtcatttgtgtttctaccctcttaagaaacctgccttctctgccttcccagttcctcctgagtgagctcatgatagactttcctagactcagcagctgacgagcatttcattggtttggttggcctttattgggccagtgaccactcttcccttcaacatggtccactgtctttaccaaggggctgtcatgtctgttgcaagcattcaggaaagagtggccttccatactcaaatgtactctattttataaaatgtgattttaaaaattcgtggtccaatcaggcctccttatcctct

SEQ ID NO: 59667 - DNA, 601 bp, Human
agaaacctgccttctctgccttcccagttcctcctgagtgagctcatgatagactttcctagactcagcagctgacgagcatttcattggtttggttggcctttattgggccagtgaccactcttcccttcaacatggtccactgtctttaccaaggggctgtcatgtctgttgcaagcattcaggaaagagtggccttccatactcaaatgtactctattttataaaatgtgattttaaaaattcgtggtccaatcaggcctccttatcctctgggaattgattccagcagcccccctasccccacaacagaccaaatctgctgatgctccaagtccttgatataaaatggcgttaaggccgggcatggtggctcatgcctgtaatcccagcactttggggggccgaggcaggcagatcacctgaggtcaggagtttgagaccagactggccaacatggcgaaaccctgtctctattaaaaatacaaaagttagccaggcgtggtggcgggcatctgtattcccagctacttgggaggctgaggcaagaaaatcgcttgaagctgggaggcaggtgttgcagtgagccgaggtcgcgcca

SEQ ID NO: 59668 - DNA, 601 bp, Human
gtgattttaaaaattcgtggtccaatcaggcctccttatcctctgggaattgattccagcagcccccctagccccacaacagaccaaatctgctgatgctccaagtccttgatataaaatggcgttaaggccgggcatggtggctcatgcctgtaatcccagcactttggggggccgaggcaggcagatcacctgaggtcaggagtttgagaccagactggccaacatggcgaaaccctgtctctattaaaaatacaaaagttagccaggcgtggtggcgggcatctgtattcccagctayttgggaggctgaggcaagaaaatcgcttgaagctgggaggcaggtgttgcagtgagccgaggtcgcgccactgcactccagcctgggtgataaagtgagactgtcacaaaaacaaaatggcatagcacagtcagcccaacgtatttgcaggtttcgccctgaggttggctgaatctgtggatgcaaaaccctcagatatggagtgctgactataactaaatgtttttaaactaaacacttaaggtatactatctcagtttgccacagtggtaatcccatcttaacagtgagcaaactgag

SEQ ID NO: 59669 - DNA, 601 bp, Human
ggaattgattccagcagcccccctagccccacaacagaccaaatctgctgatgctccaagtccttgatataaaatggcgttaaggccgggcatggtggctcatgcctgtaatcccagcactttggggggccgaggcaggcagatcacctgaggtcaggagtttgagaccagactggccaacatggcgaaaccctgtctctattaaaaatacaaaagttagccaggcgtggtggcgggcatctgtattcccagctacttgggaggctgaggcaagaaaatcgcttgaagctgggaggcaggkgttgcagtgagccgaggtcgcgccactgcactccagcctgggtgataaagtgagactgtcacaaaaacaaaatggcatagcacagtcagcccaacgtatttgcaggtttcgccctgaggttggctgaatctgtggatgcaaaaccctcagatatggagtgctgactataactaaatgtttttaaactaaacacttaaggtatactatctcagtttgccacagtggtaatcccatcttaacagtgagcaaactgagtcttagtaaaattaggcatttttaggcattgggtactatttgagc

SEQ ID NO: 59670 - DNA, 601 bp, Human
ctgggtgtggagcggtgcacgccttcacgtctggtcaatgtccactgagtgctgttgagagggaggctctggagtcccgcccgccccggcgcggctgagccctgggtacctgcattaagtccgcccggttcagggcgctggccgccaccttcaggaggacttcaccctcccccgggctcggcttggccacctccttcacgtagaggttttccggtcctcccggcttgtcaaagtgcacggctaacatattgtctgaggacacagggcagggcagggcaggacaggacagggcagggcagggcaggacaggacagggcagggcaggacaggacagggcaggggccgctgtatcctcgcggagcagcccagcctcaggctggcaccgcagcgccccctgccggccagcgcctcgctgccctggtctgccgcggacccggcctccgccccgagctcctgcctgggaagtcctcggccgcctccagaccgatcccacccggaacacagatgggaacggcgggaagtgggatggcggtacagggctggatgcggcagagcaggacaacgccgaagaggatcaggcaaatcacactccctctgagtt

SEQ ID NO: 59671 - DNA, 601 bp, Human
gctgggtgtggagcggtgcacgccttcacgtctggtcaatgtccactgagtgctgttgagagggaggctctggagtcccgcccgccccggcgcggctgagccctgggtacctgcattaagtccgcccggttcagggcgctggccgccaccttcaggaggacttcaccctcccccgggctcggcttggccacctccttcacgtagaggttttccggtcctcccggcttgtcaaagtgcacggctaacatattgtctgaggacacagggcagggcagggcaggacaggacagggcagggcagagcaggacaggacagggcagggcaggacaggacagggcaggggccgctgtatcctcgcggagcagcccagcctcaggctggcaccgcagcgccccctgccggccagcgcctcgctgccctggtctgccgcggacccggcctccgccccgagctcctgcctgggaagtcctcggccgcctccagaccgatcccacccggaacacagatgggaacggcgggaagtgggatggcggtacagggctggatgcggcagagcaggacaacgccgaagaggatcaggcaaatcacactccctctgagt

SEQ ID NO: 59672 - DNA, 601 bp, Human
gtagagtccttagctatttacctcatctgaaccccttgctttacagatggagaaactgagtcccagacgggaaataatagtagtgggattaggaaccttgacgatggttcccatgcatcaagcgctaggctctgtgctcactcaccccagtcctcagaagctgtagagcagagggacttaaccaggagtgtgtggcagaaccacctgaggagtatttcaaagtacacgtgcctgggcccccatcacgtttcttttgtgccccgggggattctgatgcacatttctgaatgaccccaaccaatgcagctggcccaggtcagtaaatcagcatcagacagaagaaaattcttaagagtactgcccgctgtcagctccgggactctcagagtggaaagagttaagaggtctttggagccacaaagacctcagcttgaatcccagctcttctgattgctagtgtcacggccttgggcgtactgcttaacctcactgaacttcagtttccttatctgtagaattaagatggcgaacagggtagcctggggagtaagtgtgcccacaccccacaacaatgttagttccgccctcatctggaggcctg

SEQ ID NO: 59673 - DNA, 601 bp, Human
agggtcaatccctctgggataggcatgaggagcccttcggggacagtgacgtactgagcctggcccccaccggggagcagagccatggctgtgtccccgatcttccagtgtccctggcagccaggccccagctctgccacatgtccagatgcctcaagtcccaaaatgttgctggctcctggaggtgggtcatactggccttgtctctgcagagaaagaagtgcactaagtggtgagcatgatcagaaatctgtatgtcactacccctggccccccttccaagatcccctcttttttttttcaaaaataaatttcagaatgaagtcaggtttttgtaagtaaggagaagaaaaaggagaggccattagttttatgcaaataaactggaggtcacatgatcagtggatgttataactggtagagtccttagctatttacctcatctgaaccccttgctttacagatggagaaactgagtcccagacgggaaataatagtagtgggattaggaaccttgacgatggttcccatgcatcaagcgctaggctctgtgctcactcaccccagtcctcagaagctgtagagcagagggacttaacca

SEQ ID NO: 59674 - DNA, 601 bp, Human
aaaaatggaggccaggcatggtggctcatgcctgtaatcccagtactttgggaggctgaggcaggtggatcacctgaggtcaggagttcgagaccagcctggccaacatagtgaaagcccgtctctactaaaaatacaaaaattagctgggcgtggtggtgcgcctgtgatctcagctactcaggaggctaaggctggagaatcacttgaacctgggaggcggaggttgcagcgagccgagatcaagccactgcacgccatcctcagtgacagagtgagactccatctcaaaaaaaaaaaagaaagagaaacggaaagggatgagccaaaaatagacacgtctggctttggaatacagaggtgtgcacatctacttactcatttagggtgctaccacccaaccctaccatggctggctccaaactggtctctgcctccaagcctcctgttaactaagtgtggaatggctggttgggaagaaaaggtgctggataattccagaccaagtctgcatggtctaaagtgtggatgaatcttatctcttgcaagaatgcacatggaaaccatcttagatttaaatatgactgcctgtctccagtgg

SEQ ID NO: 59675 - DNA, 601 bp, Human
actaggttattggaatcataggctttctagctttggtttcatctctccttttctactcacataaaaaatggaggccaggcatggtggctcatgcctgtaatcccagtactttgggaggctgaggcaggtggatcacctgaggtcaggagttcgagaccagcctggccaacatagtgaaagcccgtctctactaaaaatacaaaaattagctgggcgtggtggtgcgcctgtgatctcagctactcaggaggctaaggctggagaatcacttgaacctgggaggcggaggttgcagcgagcygagatcaagccactgcacgccatcctcagtgacagagtgagactccatctcaaaaaaaaaaaagaaagagaaacggaaagggatgagccaaaaatagacacgtctggctttggaatacagaggtgtgcacatctacttactcatttagggtgctaccacccaaccctaccatggctggctccaaactggtctctgcctccaagcctcctgttaactaagtgtggaatggctggttgggaagaaaaggtgctggataattccagaccaagtctgcatggtctaaagtgtggatgaatctta

SEQ ID NO: 59676 - DNA, 601 bp, Human
acaggtgatctctggctcccttgtacctccaaatgtgtaacttctgttctgtaccagataaagactgaagcctggagtaaaatgttagtgtcactgacagcctaagaattgtttttaaataaagtgtctttacccaggaggcagccacagataggactcatataggcttagtgaaaaaaggatgcttaagctctcctgtccctcagctggtgcaaaaccctatggtggaaacattcccaaaggtggtacctgctagactgccagatggaatatttcaggagcatataatctttttttttttgagatgaggttttgctatgttgctcaggctggggtacagtggctatgcacaggtgcaatcatagctcactgcagccttgaaactcctggactcaagcaatcctctgcctcagccttccaagtagctgggactacaagcaagtgccactgtgcccggcatggaacctataatctgttgaaggccaaggcttacttatttttttactcacctaagagactttctagcacactgagatgaattctgcctttgaaaacaaagtcttggaactactcgaaatacttcctaatatagtcagtgctt

SEQ ID NO: 59677 - DNA, 601 bp, Human
gtatcaatttggtttctagagccagctgaagagaccacataggagctaaaggggggttacaggtgatctctggctcccttgtacctccaaatgtgtaacttctgttctgtaccagataaagactgaagcctggagtaaaatgttagtgtcactgacagcctaagaattgtttttaaataaagtgtctttacccaggaggcagccacagataggactcatataggcttagtgaaaaaaggatgcttaagctctcctgtccctcagctggtgcaaaaccctatggtggaaacattcccaaagstggtacctgctagactgccagatggaatatttcaggagcatataatctttttttttttgagatgaggttttgctatgttgctcaggctggggtacagtggctatgcacaggtgcaatcatagctcactgcagccttgaaactcctggactcaagcaatcctctgcctcagccttccaagtagctgggactacaagcaagtgccactgtgcccggcatggaacctataatctgttgaaggccaaggcttacttatttttttactcacctaagagactttctagcacactgagatgaattct

SEQ ID NO: 59678 - DNA, 601 bp, Human
gtgaaagcattggagaaattgtagtttcagaaaaggctagctgacctgtctcttcttgcatgtagcaagtcataaagattcctctgggaggggtaccctccccatactagggcaaaaagcccttatcaccagagactggaaacggggctgcaatggaactgaataaatacacttaaggaagtaacccttatcttccactagttttacaccccccacccccatatatctcctagtgacttccctagaaatttactatccctagccagattttgtcttatttcttctcaaatttattgttctytgtctaaaaattacaaaagcatcttactttggccgaatcacttgagcctgggagtttgagatcagcctgggcaacatggtgaaaacctgtctctataaaaaatacaagccaggcatggtggtatgccttcagtcttagctacccaggaggctgattgtgccattgcactccagcctgggtgacagagtaagaccctgtctccataaaaaaaaaaaaaaaaaaaaaaagtacatgcttttctcctgtcaatctgctggtatcaatttggtttctagagccagctgaagagaccacatagga

SEQ ID NO: 59679 - DNA, 601 bp, Human
cccctcacttcctagcatgtgtgtgaaatacccttgaaggagtcatgtgccatctcagaatatgtccgataggtatattgttaattttgaggtgaaagcattggagaaattgtagtttcagaaaaggctagctgacctgtctcttcttgcatgtagcaagtcataaagattcctctgggaggggtaccctccccatactagggcaaaaagcccttatcaccagagactggaaacggggctgcaatggaactgaataaatacacttaaggaagtaacccttatcttccactagttttacacmccccacccccatatatctcctagtgacttccctagaaatttactatccctagccagattttgtcttatttcttctcaaatttattgttctttgtctaaaaattacaaaagcatcttactttggccgaatcacttgagcctgggagtttgagatcagcctgggcaacatggtgaaaacctgtctctataaaaaatacaagccaggcatggtggtatgccttcagtcttagctacccaggaggctgattgtgccattgcactccagcctgggtgacagagtaagaccctgtctccataaaaa

SEQ ID NO: 59680 - DNA, 601 bp, Human
ctaagacaagggaaaggagatcatcagcctggggagagagcctcaccctgccctcctcatcctcctcagccttcttgctctctctgaagccacgtatctgaaaaagcacacagggacacttaacccctcacttcctagcatgtgtgtgaaatacccttgaaggagtcatgtgccatctcagaatatgtccgataggtatattgttaattttgaggtgaaagcattggagaaattgtagtttcagaaaaggctagctgacctgtctcttcttgcatgtagcaagtcataaagattcctctgrgaggggtaccctccccatactagggcaaaaagcccttatcaccagagactggaaacggggctgcaatggaactgaataaatacacttaaggaagtaacccttatcttccactagttttacaccccccacccccatatatctcctagtgacttccctagaaatttactatccctagccagattttgtcttatttcttctcaaatttattgttctttgtctaaaaattacaaaagcatcttactttggccgaatcacttgagcctgggagtttgagatcagcctgggcaacatggtgaaaac

SEQ ID NO: 59681 - DNA, 601 bp, Human
catcctccttcactggggcagttccaggacgatcttgcctatgttcttgttggcctccatgtacttatgggcctcctggatttcggtcactgggtagattctgtccagaaccggcagcagacgttgggggccctccgtggagaagtgaggcagaatttgctccgtgaaagcattcaccagcatttgcttgtactaagacaagggaaaggagatcatcagcctggggagagagcctcaccctgccctcctcatcctcctcagccttcttgctctctctgaagccacgtatctgaaaaagcasacagggacacttaacccctcacttcctagcatgtgtgtgaaatacccttgaaggagtcatgtgccatctcagaatatgtccgataggtatattgttaattttgaggtgaaagcattggagaaattgtagtttcagaaaaggctagctgacctgtctcttcttgcatgtagcaagtcataaagattcctctgggaggggtaccctccccatactagggcaaaaagcccttatcaccagagactggaaacggggctgcaatggaactgaataaatacacttaaggaagtaacccttatcttc

SEQ ID NO: 59682 - DNA, 601 bp, Human
cctcaaccccgccgcggcggccccagtccgcgtgccacccttccagttcactctttatttcctcatatcagctttaaacggctctggaggaagcaccgggtttcttggcctgtctattgtgaatcttctccaggtttgctctggaaaggcctggggtggccgcgtcctgtcctgccccatcctccttcactggggcagttccaggacgatcttgcctatgttcttgttggcctccatgtacttatgggcctcctggatttcggtcactgggtagattctgtccagaaccggcagcagacgytgggggccctccgtggagaagtgaggcagaatttgctccgtgaaagcattcaccagcatttgcttgtactaagacaagggaaaggagatcatcagcctggggagagagcctcaccctgccctcctcatcctcctcagccttcttgctctctctgaagccacgtatctgaaaaagcacacagggacacttaacccctcacttcctagcatgtgtgtgaaatacccttgaaggagtcatgtgccatctcagaatatgtccgataggtatattgttaattttgaggtgaaagcattggagaaa

SEQ ID NO: 59683 - DNA, 601 bp, Human
acacacacacacatacacacacacatacacattcacacacaggcatacttacagacaagtcccaatagcaatgggcatcaaaacaatttaacaatctatgtcaggattactagaggagcaaagttttgtactatacatgaatgctgctctcagtaacatcttaaaccctgaattgaacttaaattagatatgtctaagttatcgtcaatcttctaagtaggaaggtaccacagtctacatatgcaattaattcttcagaagtttaaaaaaaattactatctgtatgcctatatagcacttytaaatgcattttccaacattttagatgattattcacataatcattcttttgttattgaatagtccatttgttctcaatgttatattttatatataatgcaatgaactgcaaagtagatatataaatgtttatggaatggaagaagcagaataaagaaggaccgggactgtactgctttatgttcattttgcttataaaactgattaacatgttggctgaagtttacaattcaactgtttaatgcaaattcctttgtatggggcataaaaatcctcaaacttgagtagagcatgttactac

SEQ ID NO: 59684 - DNA, 601 bp, Human
aataacatggttaagtagatggattccaaaatcagcccaaatggtttcaaagcccagattaacactaaccatctttgtaaccttaggcagttacataacgtctcttagtctcagtttcactatttgtaaatatagacaacaacagtgcctactttacagggttgttgtaaaggttaaataaaataatgcacttagcatagcatctggtatatagtaaaaattcaataaatatcattgttctcatagttactattattgtatgtaaagcactaagctactttggcacagaaaaaagtttaaytaatagaaaaaaatttcaaaggcacacctaaattaatcccattttggctctggtggtctttctgcaaaacaagggctagcatcaacaatcagtgcttggtgtagcctcaaagacagagggctagcattaggaaaacagattccagaaaaaaaaagtctagattttccatgaaatgaatctaagaaataaactgaaaactttctagatataatgttaaaatgtgaaaccagacaattacacagaaattcttgactatcatttaggattcaggaaaaatcttccatatcccaaatttaaaac

SEQ ID NO: 59685 - DNA, 601 bp, Human
ttcctatgaattcaaggacgagttcttaaaaggaacaaagtgatgacttttattcatttattaactgcagaatacttataaatatggtcacacaatgatttagtatttatctttagaattcactaaaatagtgaaataattttgtggagtctgttgtttgtttgagatgggggtctcactatgttgccccgactagaatgaagtggctattcacaggtgcgatcatagcacagtacaacctcaaactcctggactcaagcaatcctacccatagcctcccaagcagccagaactacaggcmcacacccctataaccagctctagaattctatattctaagatctgtagtgaaggaacatgtttcagatacatagacatacctaattgaatgttccattcaaaatgagtgcttctcacatataattataagaaattgcctgatcaaaattaacagaaaacataccaaccggttatcgctgatgaatacgtgaacttattagcccaaagtctgcaacttttggccctaaatttagctggctaattaacctttaaaaaaattcaacttacataaaattttaaattatctcccaaatcgaaccat

SEQ ID NO: 59686 - DNA, 601 bp, Human
gtttaccaaaacacacagatgaattatccttaaaaaactcactactttgacccagcagtgagggaggtaaactgctgctcttaatactaatactctgatctgtatgaactaagaaaacacctagcaaagagttaaatattctcctctctcatcatgaataaaactaagcagccttttccaattgaatatgagtctcctcaaggaaagaatacattaccagatcaaatgaggtttttgtgaaaggataatacagtgctactaagttacttgactaatacacacacacacacacacacacaccttcttcttctctctctctctcacatactccccccaaacaaaaaggttctaagtagtagatactttatgagatccatttatgcatatgcattatttgcaagaaagtgtgtcacatattttacttttcttgtaagtaacattcctatgaattcaaggacgagttcttaaaaggaacaaagtgatgacttttattcatttattaactgcagaatacttataaatatggtcacacaatgatttagtatttatctttagaattcactaaaatagtgaaataattttgtggagtctgttgtttgtt

SEQ ID NO: 59687 - DNA, 601 bp, Human
tataaatgggttaaatggtatggtccttttgggctgctttcattcaataccatacctgtgaaagtcattcatgttgttgcaggtatcagcagttcatttggttttatcgctttaaagtattctgttatgtaaatatactgtcatttatctattctcctgtcgatgaacatttaggttgtgaacatttttgtaaatgtctttttcatcaacttttgttcagttgaaaacaaataacttctttttattagagagatggggtctcactatgttgcccaggctggactcttgggctcaagcaatyctcttgccacatcctcccaagtagttgggactataggcacatgccgctatgcctagcaaagataaactttttttttttttttgagacagagtctcgttctgttgccaggctggagtgcactggcgcaatctcggctcactgcaacctccgcctcctaggttcaagcaattctcctgcctcagcctccagagtagctgggactacaggtgtgcaccaccatgcccagctaatttttgtatttttagtagagacggggtttcaccatgttggccaggatggtctcgatctcttgacctcatg

SEQ ID NO: 59688 - DNA, 601 bp, Human
gcgcggtagctcacgtctgtaatcccagaactttgggagaccaaggcgggcggatcacctgaggttgggagttcgagaccagcctggccaacatggcaaaacctgtctctactaagaaaaattagctgggcgtggtggcgtgtgcctgtaggaggcaggagaatcgctggaacccggggaggcagaggctgcagtgggccaagatcgcaccactgcactccagcctgggcaacagagcaagactctgtctcaaaaaaaaaaaaaaaaaaaaaaaaaggatcaccaactcctacacttattkaacaaaacaaacatataagtccaggttagcctcatcctcatgttcttggggctcatgctcagcttaaggacaccagcagcaactactctttttatagaaaaccttgtctttacctacagatatatagctttacccttgtaggtctcagaataataatgacattccctaaaaaacaccataatacacaaccttcgtacaatgtgacatatactaatgaagtaacattagggatcacttccccacagttggctccccattcactgcccttcatattccaatgcaaaatcacctctgtttata

SEQ ID NO: 59689 - DNA, 601 bp, Human
tatatcctctgcttagaatgccagaccctcaattctttactttgtagtctatcctctgaaatctggctctaatctcttttcttctgtgaaacattctctcttatatccttggagttagtcactttctcatctatattaatcacagcacttttaaacaagtaaccaaacaccttgattacatgagctcttcattatatgggctcttcaaagatatgaaccatgtcttgcccctgtctgtattcctgtgcctaagagagtgcccagaaagtatgtgattcaggaaacagttacatcaatgacytgatctaaataaatttttaaaaactatgtttagggggaggagaagagaagtaaaaaagggaaaaacagaccagtggacaggcgcggtagctcacgtctgtaatcccagaactttgggagaccaaggcgggcggatcacctgaggttgggagttcgagaccagcctggccaacatggcaaaacctgtctctactaagaaaaattagctgggcgtggtggcgtgtgcctgtaggaggcaggagaatcgctggaacccggggaggcagaggctgcagtgggccaagatcgcaccactgcactc

SEQ ID NO: 59690 - DNA, 601 bp, Human
tcacccaggctggagtgcagtggcaccaccttggctcactgcaacctccaccacctgggctcaagcgattctcctgcctcagccccaccaagtagctgggattacaggcacacaccaccacacacctggctaatttttgtactttttgtagagagagggtttcaccatgttgcccaggttggaagaccatccttttgttacagtcatttttctcttaataagttacagaatgacttcataaatataaatgttaacaggaataattttccctctattctggtatctgggggaaaaattctayttatattatttcagtgtgcaataacttcctgtgctccatccctggccctttaaaacacagccagtcctcctaaggacccttctttcccagcaacactatcccaaaggcctgtgcaagcccatcctcttgattcctctctagagagactttcaatgcccagctctcatctttctgtctctccaattccttggactcttaatctggatcttaaacttgctttcgtctaatgacttgctcagttgcctaactaaccttagctcctcactcaacttagctctgcagtcgatcctcctttgattg

SEQ ID NO: 59691 - DNA, 601 bp, Human
aagggccctgcactagcccaacaatcccagcttctttccttcctttcactaactagtgagctcaagttaaagacctaggaatgtacagcctaggctcctcctaagccctcactctctagagacttaactgcccacaggaaacctgcattctactttgttcatgcatccagtgttttataggtgcaactataccacccacagataaaccacactgcctagaatcagcttcatcaataatgaggcagtgatttggtttctcatttgtcttgctcctttgccttatttcttaatttgttcagarcttgcgcaaagaaggggatactatttattgaactttgtaaacagccaaaactataataaagagacctacaatggaataattgacttgatagagactcaatgagtgacattttaggatactttagtcagttgtaacacaacatctgcagatttacttttctttaaataaaccttgtttctgctatgcttttattggtatagtatccaatacagagaatttttttcagttttctcattgggacctgagcaaaaacaaaaacagttactatcccataaattatcctggaatgttttgttccac

SEQ ID NO: 59692 - DNA, 601 bp, Human
tggcctttattatgttgaagaaaattccttctatatctattttttttgagagtttttatcatgaaaagatgttaaaccttgtcaaatactcgttctgttatttatggagatgatcacgtggctcgtagatttttgtctttcattctgttaatgcacactttaaattctgacagaaattgccaaactactattccaaaaaagctgttatcaacttatgccaccaacaatacctgtttctgcaaaccctcatctatattggatattatcaatcttttttcatttttgctaattggcaaaaaakaaacctgattgttattttaatttgtattttcttgataaccagtgatgtcaaagaaacatctatttatgtttctggccagagtcttgaattgttaggtcttatcctttgccgtatttttctattgggctgtcttaatttttgatttgtagaagctctaaattcttgtattacatgtacttcaaattttttagtgtttatgctgtctttcattatgatgttttcatttttaatcatcaaatctgtaagtattttcttcatgactctatgtattgtttaaagagaccttcctcataccaagat

SEQ ID NO: 59693 - DNA, 601 bp, Human
tttttagtttgatgaagtcccacttgtttatttttgtttcctgagcttttggtgtaatatccaaaaaatcactgccaaggccaatgtcaaagagcttttgtcaatgttttcttctaggagttttacggtttcatgtcttatgtttaatccattttgagctgatttttgagtatggtataaggctccaatttcattcttttgcaggtggatatccagttttcccaataccatttatcgaagaggctaccttttcccattgtgtcttcttgatacccttgtcaaaaattagttgaccatatayacttgggtttatttttgggctctctattctatttcataagtctgtatgtcttgtaattgacaaaaaattgtatatatattgtatgcatgttgttttaaaatatgtatacattgtaaattggctaaggagctaattaacatatgcataatttagctaattaacataatgtgtatgttaattagctaggctctctattctgtaaatctatgtcttttgtaatcaacaaataaaaacttgtatttatagtacgcatgttgttttgaaatatgtatacattgtaaaatggctaaattcagctaa

SEQ ID NO: 59694 - DNA, 601 bp, Human
tatttagtaacattattttaggaggtaagaacagaaggtttcattttatattatctttttttacatattcatgcagggatgaagaaaccagatggaaatatataatgcagaatacattacaataaattaaaatagcaatattatctgtttaaatgtctgtttttaactttatcatatttttgaagtacagaagtacaaaatttaaataaaatgaaacatacagagtaaaaaattaaaacacctccatttcaactgcaagttcatcccccttttaggcatttacatttagatgtgtacataytcaacttttatttccatgggttttaacagaatcatattgtctacattgctatgcaacttgttttcaatttagtaagatatcttatcaatcaggacaaacagatctagttcattcttttaaattgctccatagtagtttacattatggctactgcataatttatataactacctttctgactggtatgggtagatgttggtctgaacccactgatcaacatctacccattttcccctccctctaacccctggtaaccactcttctactctcagtttctgtacaggagttcaacttttttag

SEQ ID NO: 59695 - DNA, 601 bp, Human
ccatctattagtcagaacagggaggtttgacaaggaacatgaagtgccttcctgatgctgtacgttctacacactgatctgaggggggcttcacagatacacagatgtgtacacattctttgagctgtatacttatggttgtacactttgctatatataaattatactttaataagaaaaaacaatctttatcagttatttatactctttccattatcattaacctgtttcctctctgcagatcctttctactattatttaaacttgctcaagcttcagccaactttaaaaaaaaaaaaaacttccctcaacccacatttctcattatttactaccttctctccttctccctttcaaagccaagctcattcaaagagttttatatattcactgtctcctcttcctctcttccaatttattccaactcactgaaatctggcttctcgctctactagtccacttaactgatactgctgtcctcaagttaacaacacctgtgctattgctaatctaataatttttttagtccttgttttatttcacttgcagatcactcttctcaaagttccctaacattaaactctcctgttttttttttttc

SEQ ID NO: 59696 - DNA, 601 bp, Human
atgtatcctttttgtctgcctttttccactcaaggcatccatacagtaagaacagtttgttctttttttattgctaagtaatattatatcatatgaatataccacaatttgtttatcctttcaaatgttggtagacattaaagttttttctagtttttggctattacaaataaagctgctatgaacatttgtcttcatacggacatatgttttcaattctcttgtgtaaatacctaagagtggaatggctgagtcacatggtaggtacatgttttaacttttttaacaatggcttatggaratataattcacattccacataatccttccatttacagtacacaattaaatgcattttagaatattcaaagagttacagaatcattaccacaataacttacagaactgttttcctcaaaaagaaacactaggctgggcacggtggctcatgcctgtaatctcagcactttggaaggccgaggggggcagatcacctgaggtcgggagtttgagaccagtctgaccaacatggaaaaaccctgtctctagtaaaaatacaaaattagccaggcatggtggcacatgcctgtggtcccagcta

SEQ ID NO: 59697 - DNA, 601 bp, Human
aaaaatacaaaaaaatttagccgggcatggttgcacatgccagtaatcccagctactcaggaggctgaggcaggagaatcgcttgaacccgggaggtggaggttgtggtgagctgagatcgggccattgcactccagcctgggcaacaaaagcgaaattccatctcaaaaacaaaaaaaaacaaaaattagccgggcatggtggtggatgcctgtaatcccagctacttgggaggctgaggcaggagaattgcttaaacccaggaggtggaggttgcagtgagccatgattgcgccactgygctccagcctggccgaaagagcgagactccatctcaaaatcaatcaatcaatcaatccaaaattccatgtcaggctgaaaagcaaatttttagaaacagcactaccttccagaaacacagaaactcagcagtgaaagggtctttaaagattatttggcttaaccttttcattcagtcaattagaaaactgaagattaagtaggttattccttacagcctggcaaaaatagcagagccaaaactcaagcctcttgattgcaaaagaccagcatcttttcatcaaatcagactgcttttcta

SEQ ID NO: 59698 - DNA, 601 bp, Human
ttcatgtgaaatagataggggcaggttttcctaatctcactttaatactgcagacacagaaatggggagaatatgcaactatgtgaagaacagcaactatgtgaagtcaggtagttagtcaagagctaaattgattaccatctaatttacaaattgccaaaagcttaccttctccaactgaataggctgccgaggtaggtttcttatttacagctgcatacaaagcttctggtctaccaaatatataaacaaacaaacaaacaaacaaacaaatacaagcaaaaataagaaaggtgatttgatgcacagcaggttttagtagtgcattttttagggctttctcaaattaaatatagtcttagtacacagaactgggaagacttatacacaacatcctgcaggattaagaacagcctaattataaacttctacatttttaaatatatttttaaaatttcaatatgatttacaaatagtttttcaaatgtgagatatttcgcctttctaaagaaacttaaaagacacccacaaattgttaagtggtaagcacatatagggcttagtttagtgtaggaaaaaataaaggcaatatatacatttt

SEQ ID NO: 59699 - DNA, 601 bp, Human
gcagcactagaagccaagctccatcctgatgacccagctcctagcacagtgcttgacttggagtagacgctcgataaatagttgttaacaaatgacctcaagggaaatatctaaatttttatatcgcctttgatttttgtttctgtgattgtcactgcttagaagaaacagttggtgacttggttttctaagtctttttctttctttctagttttatttatatttggccaacatggaatttgatcttaatatcataaacttcagacgatgagaaacaccacctacaacctatttactattygcattcccagtattactcaattaatttaacaaaattcaaagtgattgtaatcactttaggtacgctgcaataaaagtcgggtcctttccaacatgctcctcactactttcctaggctcagctcagagcactcattccacagtacacctatgattcagcttcactggtgacatgacgttcccccgttccttggctcatgccattccctctgtctagaagtgcattctcatcctttgtcactctgctagatcctactcattgtttaggatgatgcaacactgccatctctgtggattcatat

SEQ ID NO: 59700 - DNA, 601 bp, Human
caagcctgggactatcccagggaaagatgatgctgtttctttaagaacatgatctgtgaattataaaggaatgcattattggaaaacaattatgtctttggagaaaattattccttaaattgttacttataacatcaactcaactgtgctaaaaatgtacacacaagagactaaaggaaatataatgcagtaaaatattgatattgattacctctaagtggaatgattatgggtgatctaaaaatttttattaattttatcttttttatggagcatgcagtacttttataataaaatttayagatgctatttaaagaatattacctgtaactctccttgccaccacccacttgtatttttctttagaattaatattaactgtcctggtgcaaggctaagttgttcagaaccagaagcaacatatgctgaagttacctgagcaatctctgaaaagacaaagaagaaactatgaattcaagattgcgacagagcaaacacgttagtaattttttaagatcactactatacgtaccaggttttttatttgatgctccagacttgctagcactcccaaaactctacaaggaaaagataccgtgtt

SEQ ID NO: 59701 - DNA, 601 bp, Human
taccttttatatattctcagcaactgaatttaaatgaaaggctaagtattttaaatttcataagagatatatcatgagatattttaaaaataaaactaaaaatcaaaagagtgggaaaaagtgacaatcatttcataaaggtaaaaagttatttccaagtactattcattccctaatttattactaatgctatatttactgtcaaccaaaagaacggctagataaatacagagagataattttatatagtaccaaacttcacacttcgagatctggacccttgttctgaaaataatgaaayagaccttgattgatacatcccttgtggaaaaaggtgactatctaaagaatcacctgacaagaatcttgcaacagtcaaatatttaatttttaattttcttccaacatggatgatatgtaaacagcgagaaataaatgagaaggttagaaatgtaatggcttctgtacactaaaagagtaattttgaataggtgaatagggtaattgctggctacttttttttttttttctcttgagacagggtttcaccttgttgcccatgctggagtgcagtgtgtgtgatcatgacttactgcactct

SEQ ID NO: 59702 - DNA, 601 bp, Human
catagcacttaaggatttacaaagcactgatatgtacaaatatgcagatgcttgtgtgtgtgtacacacacgcgtgtgtgtttgcagggttctcaagtagcttcacgggtgatggaggtgaagctgagtcaggtattattattaccaattgacctatgaagaaataaaggcttagagggagacttgctcaagatcacaaagacagaatatgaaaggcctaggactaaaattcagctctttttgattctaaatctaagtttcaactgcataactgagattcctagggaatgactttaaacaycttaaggaaatagagaagttacctgagacactcttctcatatgtcatctttccaaaatgcccatgacatgctgctattagaatcactcaaagctctccactgtccgtgtgataagacacagactcctcctggaggttccagggcctatgagacctgccccctgccaacctcaccagcctggccctcagctacttcacactccagtcaccctggatggcctgtaggcccctgactccctccatacatgccatcccacttctgtttcctcctcctggagtagcaaacttgtccttgtccaaa

SEQ ID NO: 59703 - DNA, 601 bp, Human
aggattgaggaagcaggccattgttaggtggagcatcgtagagttctagacaacaatttgtgagacattcaacaggagaaccagagtaacaacttatgccacccctaagataactctaagcagatgtgggttttagaagttggctgctgagggagaaatagtaatactctacatctgtattacatagcacttaaggatttacaaagcactgatatgtacaaatatgcagatgcttgtgtgtgtgtacacacacgcgtgtgtgtttgcagggttctcaagtagcttcacgggtgatggaggygaagctgagtcaggtattattattaccaattgacctatgaagaaataaaggcttagagggagacttgctcaagatcacaaagacagaatatgaaaggcctaggactaaaattcagctctttttgattctaaatctaagtttcaactgcataactgagattcctagggaatgactttaaacaccttaaggaaatagagaagttacctgagacactcttctcatatgtcatctttccaaaatgcccatgacatgctgctattagaatcactcaaagctctccactgtccgtgtgataagaca

SEQ ID NO: 59704 - DNA, 601 bp, Human
cctgtatcccagctactcgggaggctgaggcaggagaatggcgtgaacccgggaggcggagctggcagcgagccgagatcgcgccactgtactctagcctgggtgagagagcgagactccatctcaaaaaaaaaaaaaaattagccaggtgtggtggtgggtgcctgttgtcccagctactcgggaggctgaggcaggagaatggtgtgaacccaggaggcggaggttgcagtgagctgagactgtgccactgcactccagcctgggcgacacagtgagactccatctcaaaaaaaaaaaatacacttgggtgtttcaaggcctttagaattgttttggtttcaccttagcttcttggcaaagtttcttttgaaagattctaacttgttcttggttgaaccaagaaggaaattttcagtctgtaagagaaaaaagggagcaggagctgcaggggccaggtgtggaggcagagaggcactatccctgagggaagctgggactgctcatcctcccttggggggcctgtcctcacagccacgaaggatggaaaatcaccccaacagtagaacttcacatggggatagagacttaggaggccacc

SEQ ID NO: 59705 - DNA, 601 bp, Human
ccattaagctggcagctgcagaacctgatgtaagcctgcatgtgggacagctcagcggccaggatgtccccaatcatctgcaccggcatcttctcgcccccggtcttcttccgcacccgcaaagccctgccaagaacacactctcattttgtgtttctaagtgaatgacttaggtaattaaaggatgaatcccatggcagaccaatggtaatgataaccagtgagctacctaagaacctctggcactgggaaggagaactcaagaggaagaggagatagcttgggccaaaagctctgctgstcaagccaaccggggtgtgatgtcagcaaagaaaaaaaaagtaaataaagtccctgcagttgggtgggctgggcacggtggctcatgcctctaatcccagcatttcgggaggccgaggcaagaggattgcttgagcccaggagttcgagaccagcttgggcaacatagtgagaccctgtctctacaaaaatgaaaaattagctgggcatggtggtgcacgcctgtagttccagctactccggaggctgaggtaggaggattgcttgaatccaggagttcaagttgggtgcagtgagctac

SEQ ID NO: 59706 - DNA, 601 bp, Human
ggccgggcacggtggcttacacctgtaatccaagcactttgggaggccaaggtgggccgatcacctgaggtcaggagttcgaaatcaacctggccaacatggtgaaaccccgtctctactaaaaatacaaaaattagccaggcgtggtggcacatgcctgtaatcccagctactttggaggctgaggtaggagaatctcttgaacttgggaggcagaggttgcagtgagccaagatcataccactgcattccagcctgggcaacagagcaagattctgtttaaaaaaaaaaaaaaaaaaaagagtaagctattttatactctttctggaataaggcaggtattaaatgaaggcaatttacaaaattaagaaagtgacattctggttgtttcttgggagtataaagtagctgataagtaagtatgcttaaaaaaaaacactctgctatcagatggggaaaaaatgatggtcccagtgccaggaaaaaatcaggtctacataaaggcaacacaaaacaatcggaaaattctctgccgttttggtgtttcctttggaaactgatggggatgcccttctccattgctgggattccctgttgggct

SEQ ID NO: 59707 - DNA, 601 bp, Human; identical to SEQ ID NO: 34626

SEQ ID NO: 59708 - DNA, 601 bp, Human; identical to SEQ ID NO: 34625

SEQ ID NO: 59709 - DNA, 601 bp, Human; identical to SEQ ID NO: 34624

SEQ ID NO: 59710 - DNA, 601 bp, Human; identical to SEQ ID NO: 34626

SEQ ID NO: 59711 - DNA, 601 bp, Human; identical to SEQ ID NO: 34625

SEQ ID NO: 59712 - DNA, 601 bp, Human; identical to SEQ ID NO: 34624

SEQ ID NO: 59713 - DNA, 601 bp, Human
tccagtcccttatcacttccagggtcccagttccagggacttgcttccacagaaagccaggtctactcagatgatgttcagacagtttggccgcaggagctggacttctgcttttcctcagcaatgcaaaatggacaaactgctttctttactaagtgctttcaaaatatctttaataaagtgtatgtcagggatcagtcaactgtatcagtttacaatgtctacgttagtctacttccccatgttttgaaaactaggcagaccgtaccaaggcctctgtgtcttttattaaccagcaccrtcttcccaagagtgaccctgccactggctggcccctgtggctctgtggtgctggtagtgttctcacagcttctgctccttagctgtccttcgggcccggctccttcacagatggtctgctggccagggtgctatggagttggaatgtccagagcctcccctcgctgatgcattcactgctttggaacctgctggctttcctctggagtactgaaatagctttacctgtgttgtcggttcaggcctgaccctgcccagcattacctccagggtgtcacagttcccttctgtccaggtacct

SEQ ID NO: 59714 - DNA, 601 bp, Human
tacgttagtctacttccccatgttttgaaaactaggcagaccgtaccaaggcctctgtgtcttttattaaccagcaccatcttcccaagagtgaccctgccactggctggcccctgtggctctgtggtgctggtagtgttctcacagcttctgctccttagctgtccttcgggcccggctccttcacagatggtctgctggccagggtgctatggagttggaatgtccagagcctcccctcgctgatgcattcactgctttggaacctgctggctttcctctggagtactgaaatagcttyacctgtgttgtcggttcaggcctgaccctgcccagcattacctccagggtgtcacagttcccttctgtccaggtacctttcaagccacattgccacatcaatgaaaagcctcaaaaacacttccatgagatacaagattatctgcaaggcaaacgaggaagtttttaataccctatttgttgacagaatgaggcttccagcagatggtgcttggaaagttacttccccctcactgtcatcccttgcccctgggccagcttagggacctaacttaggaaaggatcctccccagcttccttc

SEQ ID NO: 59715 - DNA, 601 bp, Human
gccttgcactgaggtttagatttataccacattttaatctaattaatgtggttccttttttaaagacagatctcagtctgtcacccaggctagatctagtgcagtggcgagatcttggcttactgtagccttgacctcccgggctcaagcagtcctcccacctcagcctcccaggtagctgtgaccataggcgtgtgccaccatacccagctcattgttctgtgtttttggtaaagacagggtttcaccatgttgcccaagctaatcttgaattcctgagctcagacaatctgcccaactyggcctcccaaagtgctgggatgacaggcatgaaccaccatgcccgactggttgcaatttttaaagccccctcagatttgatttcttgtgataatagtccctttacaaaggctttgctctgtttccctctatttttatagccttgattaaattcagatgcctgaaaaaaagagagaaagatccacacagtgagccctctgaaaatccatccagctcttttgcctgcagctttgaccttgctctcataggctgtagcagggtttatccattgcaaagttgcaattaatcatctgaatggctt

SEQ ID NO: 59716 - DNA, 601 bp, Human
ctcttcaggtcagaacatctgtgtgaagaggaagctgatacctgcaggcactgtttatcccccttgtagttgccctgtgctgactgcatggcagtttctgaaagacatctcttgttcagagggttttcccagaccctgtaaagatttagtatggcccagactgatctgattctcttttccattcaagcctgcactacctcctgtgttttctgtcttgactaatgctgtggcttcatgtgcaggctcctgagagagaccaacattgaccccttctttcactgtgtctccaccagatcctgtycattcacctcagacatgcatttccaaaagtctactttttaccacctctgccatcaccctggttcaggccctcgtgcctacttagagacctgtgatagacttctcagggtttctctgatccctctcacccccagttcatcttccatagttatcctatttatccccagatagattgagcctggtaacatcagcctgcttaaaaacctcctgctttagactcaagcccaaatgcttttgacaggcaatcaaatgtgagaccttccaccttctggccccagcccacctcctcagtttcagtccc

SEQ ID NO: 59717 - DNA, 601 bp, Human
catcaccctggttcaggccctcgtgcctacttagagacctgtgatagacttctcagggtttctctgatccctctcacccccagttcatcttccatagttatcctatttatccccagatagattgagcctggtaacatcagcctgcttaaaaacctcctgctttagactcaagcccaaatgcttttgacaggcaatcaaatgtgagaccttccaccttctggccccagcccacctcctcagtttcagtccccatccctgcctgcagaggcctgtgctccaggcacactgacctcactggccyctccccaaccagaccctgctgctcctcaggcactgctgggttcttccctccctccttctcttggcaaactcgtgttcatccctcaaggctctgatctcttctccctgtatagccttccctcactactcttcttgagggcaggagtcatagcctgtctcctcttgtatctccagtgcctggcacatgagaagggctcattacatgttacatgaaagaatgaggttgaataggtgagtagcctctgttgatttggatgttcttagaaatgagataagttctatattgcccttgggctttgtg

SEQ ID NO: 59718 - DNA, 601 bp, Human
actggcccctccccaaccagaccctgctgctcctcaggcactgctgggttcttccctccctccttctcttggcaaactcgtgttcatccctcaaggctctgatctcttctccctgtatagccttccctcactactcttcttgagggcaggagtcatagcctgtctcctcttgtatctccagtgcctggcacatgagaagggctcattacatgttacatgaaagaatgaggttgaataggtgagtagcctctgttgatttggatgttcttagaaatgagataagttctatattgcccttggrctttgtgattgagataaagcatgacattttggacagtgccttctcatttgctggtggtcatgttagagctgattccagttagatgtataacatgcagttagtaattccctagagcctcaattttacagactatggaaaatcgtgacagcttcacaaatgaattgaaaggctctgagttagaccctcagaaacaacctatttcctgagtgttgaccactgcagtttccttggcttactaaagagcgatgtcgttggagctcaagtacctttaatattttgtattggatgtcctgtttaata

SEQ ID NO: 59719 - DNA, 601 bp, Human
tgatctcttctccctgtatagccttccctcactactcttcttgagggcaggagtcatagcctgtctcctcttgtatctccagtgcctggcacatgagaagggctcattacatgttacatgaaagaatgaggttgaataggtgagtagcctctgttgatttggatgttcttagaaatgagataagttctatattgcccttgggctttgtgattgagataaagcatgacattttggacagtgccttctcatttgctggtggtcatgttagagctgattccagttagatgtataacatgcagtyagtaattccctagagcctcaattttacagactatggaaaatcgtgacagcttcacaaatgaattgaaaggctctgagttagaccctcagaaacaacctatttcctgagtgttgaccactgcagtttccttggcttactaaagagcgatgtcgttggagctcaagtacctttaatattttgtattggatgtcctgtttaatactttggtctgagaaaacaacaatgtccatgttttctttacattttcagttttacagacgagagaaaaaattacaactaattgctataaatttaaaatca

SEQ ID NO: 59720 - DNA, 601 bp, Human
attccacaggccctgcaccctaggcatccacttgtgctgctgtggaggaaggggttggcaatctatgaaaggctcattcaggcactagctcacactggccttggctgaggatggggaggtctccatacctgtcaggcagggggcccaagcactggcagctggaatgccatctcaaaaggctgctacctgctagatgagcagagggaggtgaaggagcctctctttggccaggcctgctccccacttttccttccccatagtgtccaaaaccccacctatggtaagagctgtgtgaggggcyggggctaggtgcactgcaggctggcaggaggaggtgctgtaatgatggcagtaggttactgcagccaccacctctgctgaactgtgtcccacacatattaggaaggcctaggcaggcagtggggccaaaggccaggatgctatccattatattatcaaacagtgagacctgtttacccactcagacagacacttcattttctggcctgtccaggtccagagtggacaccggacaccttggccaagttgaaaggtgcacagttctgagcaggcctgactcacgtttccttattgctgggat

SEQ ID NO: 59721 - DNA, 601 bp, Human
ttgcattggaatagggagagatgaaggtgggcatgtttgacaactcaggaatgaggccttatcctacagagatgacactgccaaaagagaaatcaatcatctaaggtctagcgtttgaagatgaaatcaggaatgatgaaacagcaattccaagatgagaaacctgggaaaatagtggtttcatagacataagtagagaaaggtgggggacactcagcaatttttccgtaagcaattagcagccgtttgtgcatgctgagaatacatgatatgtagttgtaaactgccgttaagaagcttmtaatccagaaagaaaacttgttcactcataaatctagagaactaggcagtacaagaaccaaaagacttctgggtggtggaggagtggtctctgggtcacccaaaagctacattcatccatgtaggagctgagagtcctgtggttacacaactgccatcacactctccctaaactgtagctgcaatgccaagtgatggattctttcctgaggtccttcagcctgacaagtatttaggtggatttacagttctaagtcttcccttctataaatcttctgagagatatgctagataagaaagg

SEQ ID NO: 59722 - DNA, 601 bp, Human
gcccattgaacatcacgagtacgcctccccctgatgcctcttctccaggaggcaagaaggtaagactgatgattcttagcctaagctagagaacctcttgcccaagatctgaaatgttgggggtgggagtatggaattgcaactgcgattgctgaaacaatttggactacttcctccttgaagtaaatgcatctgtgtgaggctggatacaaagcatactggtagggctagggaggcttgctgacatcctcagaggctttcttccatgtgagtggaagaagggagaaagaataaggaatgrggaactgtcagttcatttaattgagggagcaattcaagagttcccatgagggaaagattattgagtacctcacatagaaaagtttctcattttctgccaggaattttcaagggagaaaatattagtgtctagggcaggcaatggaaacagcaatgccaccagcagtgctttggaaatcaagccatgctttatagctgcagaatacttggggatctgctgcctgggggttccattggtgtgacagcattggatccaagcagtggatcaatcaccagccctcatgaagagcttgctataaga

SEQ ID NO: 59723 - DNA, 601 bp, Human
acctcttgcccaagatctgaaatgttgggggtgggagtatggaattgcaactgcgattgctgaaacaatttggactacttcctccttgaagtaaatgcatctgtgtgaggctggatacaaagcatactggtagggctagggaggcttgctgacatcctcagaggctttcttccatgtgagtggaagaagggagaaagaataaggaatggggaactgtcagttcatttaattgagggagcaattcaagagttcccatgagggaaagattattgagtacctcacatagaaaagtttctcattytctgccaggaattttcaagggagaaaatattagtgtctagggcaggcaatggaaacagcaatgccaccagcagtgctttggaaatcaagccatgctttatagctgcagaatacttggggatctgctgcctgggggttccattggtgtgacagcattggatccaagcagtggatcaatcaccagccctcatgaagagcttgctataagactacactataaataggtttaggaaccagtcatttgttttcatctttgctggagaacttataagcctaggcccatcttaatcgtaaattataa

SEQ ID NO: 59724 - DNA, 601 bp, Human
gagaacttataagcctaggcccatcttaatcgtaaattataaatctgtttatattgcctgatgccagtagagcttaggacagtttaaaggccatcattttggacacaatggcttcctttccccatctcctaaaacagagagagagaatatcaggaatttccataggcaggactcctagggcacaaaccatcaaaagcagggcaaggattttcaaaactgagctcctcggaggtttgttcaggttaccaagagctgtggtgttaccaggtgggatgggcgtggggatagttgctaaggagasagggtaagagtagaaatcctgcttctacaagggcagcaatacttcttttttatacaggaatcttctgcaaacatttctatttgaaaaagcgttttgctccccccaaaaaaggttgaaagttaacaaattaatgggtaagactacaaagtaagaaagacctgggttcgaagcttggccttgccatgtgctagttatgtgaacttgtacaactttcaagccctagttttctttataatggagctaataatggttagggtagccagcatctttgcacgaggtcctactgtgagataatatatg

SEQ ID NO: 59725 - DNA, 601 bp, Human
atacagtaaatattgataaatacagcctacataagcaaaagttctttggagtcctcaatgatttttttaagagtgtaaaagggtccctagaccaaaacgttgctgtggaaataaagtaagttataatgccacctgctggcaaagcctgaaatcattgctgctcctgaaagcagcagctaccaaactgtttcctcacgtatatccagataggtctcaaagaatgctcttctttgagactcagccaggggaaggcagctggggtgagtgggggagattttgagacagagttctcttactgagkagtagtaataatcctccccagtagcctgtcttaacttaaaccacaggttactgaagttggcacctgtagtataagagatttacttctgttttcttcatttgactccttgagctgtgtctcttcacagcttgttaactccactttttcttcttcagaaatatctgtcactataagatgttttattcccttataggggaaatgtctagctgggctcattgaagtttaggcattggtcctaaagaaatatgtgggcatcatgattccaggcagttgaatgctcttgggattttattcagcctt

SEQ ID NO: 59726 - DNA, 601 bp, Human
ggggttctcagggcagatgcaggggcaacacatgcctctgcctgagcagtgctggggccaggccaggggctggtctctgctcaggctcaaggtacacagggatgtggatctggggaagggtgctctccctggcctcctgacaacatgcacatctccacagatgccacacatttaaaggctcaaacctacctcagacactgctctacccatccccatcccctgcaagggcctcaccttcaccttgcaaatgtgaaatgaaagctccttgcaggtgtgaaagaatgtcgtatgcagattaacaaggtggatccaaatttctaaaacttcctgagatgtactatgtgtatccctgacttcacccttactagtcttaactcatccagtgctgggaggtctcccagtactgcaagaacaattcccacagtgagcgattccacacctccccatttcatttcctaagaactttcagaaacggagccttttgttatgtctaaccacggtacctccagctgcagtgggacctctgtctcccttggaggctgagaacagctgggccccaggtcccggtgaacaacacagcctgttggattcctggccagtg

SEQ ID NO: 59727 - DNA, 601 bp, Human; identical to SEQ ID NO: 25038

SEQ ID NO: 59728 - DNA, 601 bp, Human; identical to SEQ ID NO: 25039

SEQ ID NO: 59729 - DNA, 601 bp, Human; identical to SEQ ID NO: 25040

SEQ ID NO: 59730 - DNA, 601 bp, Human; identical to SEQ ID NO: 25041

SEQ ID NO: 59731 - DNA, 601 bp, Human; identical to SEQ ID NO: 25042

SEQ ID NO: 59732 - DNA, 601 bp, Human; identical to SEQ ID NO: 25043

SEQ ID NO: 59733 - DNA, 601 bp, Human; identical to SEQ ID NO: 25044

SEQ ID NO: 59734 - DNA, 601 bp, Human; identical to SEQ ID NO: 25045

SEQ ID NO: 59735 - DNA, 601 bp, Human; identical to SEQ ID NO: 37013

SEQ ID NO: 59736 - DNA, 601 bp, Human; identical to SEQ ID NO: 33244

SEQ ID NO: 59737 - DNA, 601 bp, Human; identical to SEQ ID NO: 33245

SEQ ID NO: 59738 - DNA, 601 bp, Human; identical to SEQ ID NO: 33246

SEQ ID NO: 59739 - DNA, 601 bp, Human; identical to SEQ ID NO: 33247

SEQ ID NO: 59740 - DNA, 601 bp, Human; identical to SEQ ID NO: 33248

SEQ ID NO: 59741 - DNA, 601 bp, Human; identical to SEQ ID NO: 33249

SEQ ID NO: 59742 - DNA, 601 bp, Human; identical to SEQ ID NO: 33250

SEQ ID NO: 59743 - DNA, 601 bp, Human; identical to SEQ ID NO: 33251

SEQ ID NO: 59744 - DNA, 601 bp, Human; identical to SEQ ID NO: 33252

SEQ ID NO: 59745 - DNA, 601 bp, Human; identical to SEQ ID NO: 33253

SEQ ID NO: 59746 - DNA, 601 bp, Human; identical to SEQ ID NO: 33254

SEQ ID NO: 59747 - DNA, 601 bp, Human; identical to SEQ ID NO: 33255

SEQ ID NO: 59748 - DNA, 601 bp, Human; identical to SEQ ID NO: 33256

SEQ ID NO: 59749 - DNA, 601 bp, Human; identical to SEQ ID NO: 33257

SEQ ID NO: 59750 - DNA, 601 bp, Human; identical to SEQ ID NO: 33258

SEQ ID NO: 59751 - DNA, 601 bp, Human; identical to SEQ ID NO: 33259

SEQ ID NO: 59752 - DNA, 601 bp, Human; identical to SEQ ID NO: 37013

SEQ ID NO: 59753 - DNA, 601 bp, Human; identical to SEQ ID NO: 33244

SEQ ID NO: 59754 - DNA, 601 bp, Human; identical to SEQ ID NO: 33245

SEQ ID NO: 59755 - DNA, 601 bp, Human; identical to SEQ ID NO: 33246

SEQ ID NO: 59756 - DNA, 601 bp, Human; identical to SEQ ID NO: 33247

SEQ ID NO: 59757 - DNA, 601 bp, Human; identical to SEQ ID NO: 33248

SEQ ID NO: 59758 - DNA, 601 bp, Human; identical to SEQ ID NO: 33249

SEQ ID NO: 59759 - DNA, 601 bp, Human; identical to SEQ ID NO: 33250

SEQ ID NO: 59760 - DNA, 601 bp, Human; identical to SEQ ID NO: 33251

SEQ ID NO: 59761 - DNA, 601 bp, Human; identical to SEQ ID NO: 33252

SEQ ID NO: 59762 - DNA, 601 bp, Human; identical to SEQ ID NO: 33253

SEQ ID NO: 59763 - DNA, 601 bp, Human; identical to SEQ ID NO: 33254

SEQ ID NO: 59764 - DNA, 601 bp, Human; identical to SEQ ID NO: 33255

SEQ ID NO: 59765 - DNA, 601 bp, Human; identical to SEQ ID NO: 33256

SEQ ID NO: 59766 - DNA, 601 bp, Human; identical to SEQ ID NO: 33257

SEQ ID NO: 59767 - DNA, 601 bp, Human; identical to SEQ ID NO: 33258

SEQ ID NO: 59768 - DNA, 601 bp, Human; identical to SEQ ID NO: 33259

SEQ ID NO: 59769 - DNA, 601 bp, Human
atgggtgggcagcaggtttgcctgcgagtaccctccccgcagtttctccctctcctggacaccctcggtccgaagcagggagggcaggagtggagatgacggggtgcgccgtgtgcacgccttggcgtggtggggccggtcagttttccagaaattaggactgcagagtgaagaacttgttgctcaggacaggccgcccccaccgagtgtcctctggttgggtttcaaatggttctcttggtttggggctctggttcccgtatcctgctcctcacctggaagaagggagcttggagcttgsgtatttgcacctcctgccttctgtctggatctagggcgcagccacggggcgctgtggacggcaggcccctgctcccccaagtcctgccgcacaggcggttggaggtgagcctcgggaagagtcccaaggagtgtgtcctgtggctcagtgaggacgggcgcctgggccctgccagggcttctgggtgtctgggaatggagggacagcagcccagctgcccgccgaaggccggcaccgttcccgggaagcctcgcttttgtccaccgccggctgggtcctgcccgcctcccccgcctccct

SEQ ID NO: 59770 - DNA, 601 bp, Human
gcgactccgactcgggcgcggagctgggaccccaccctggcggcggtgccgtgtacaaggctgaagcagggcttggagatgggcaccaccatggcgaccacacaggtgggctccaggccccccgcatatctgagggtccctgtatgggaggcagctgtggggtttctggctgagaagggtgcatgatggtggaggggggcaggcgccctcgagagaaccgggccttccccgggttccctgaaaaagctcccaaggccccggccgcccctgtttttggtgcacgagggacctgcttagccaycttgagtgctgaggggctgacagctttgcttggcagggaccccgagaggtggtgttttcagcaagactcagtccaatgcgggctcctcttcccacaccgagctgctgcccacacggcactcagcagccccagcttcagggccagactgacagggtggagtcctgccggggcctcggtcaggctggctgacgcccgccagcctcagagtgcttggctggcccggggaggaacagggtctgtgtggtcccccagcgccctgtaaacgccagctctggccaggctgggcctgtcggcttcttc

SEQ ID NO: 59771 - DNA, 601 bp, Human
aggtggtgttttcagcaagactcagtccaatgcgggctcctcttcccacaccgagctgctgcccacacggcactcagcagccccagcttcagggccagactgacagggtggagtcctgccggggcctcggtcaggctggctgacgcccgccagcctcagagtgcttggctggcccggggaggaacagggtctgtgtggtcccccagcgccctgtaaacgccagctctggccaggctgggcctgtcggcttcttccccccaccttggtctctgggaggggcctcgggtcttcccatagcacmgcgcttcatggaattttctcggccgaggagtgaggtctaggtctgactttgctggaatttctgggaaatgtaaagaaacaaaaagccgttgatccccctggcagttagcgcgggcgtccctccccttccagcctggccggccccacccgccccacagaaggggcattcatccctgaagcctgctctcctgtccccagggcagacccacgggccgcccaccccgcccaccacccccaagacggagctgcagcaggcgggcgccaagccggagctgaagctggagggacgccggccggtgga

SEQ ID NO: 59772 - DNA, 601 bp, Human
cccggggaggaacagggtctgtgtggtcccccagcgccctgtaaacgccagctctggccaggctgggcctgtcggcttcttccccccaccttggtctctgggaggggcctcgggtcttcccatagcacagcgcttcatggaattttctcggccgaggagtgaggtctaggtctgactttgctggaatttctgggaaatgtaaagaaacaaaaagccgttgatccccctggcagttagcgcgggcgtccctccccttccagcctggccggccccacccgccccacagaaggggcattcatcmctgaagcctgctctcctgtccccagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgcc

SEQ ID NO: 59773 - DNA, 601 bp, Human
ccggggaggaacagggtctgtgtggtcccccagcgccctgtaaacgccagctctggccaggctgggcctgtcggcttcttccccccaccttggtctctgggaggggcctcgggtcttcccatagcacagcgcttcatggaattttctcggccgaggagtgaggtctaggtctgactttgctggaatttctgggaaatgtaaagaaacaaaaagccgttgatccccctggcagttagcgcgggcgtccctccccttccagcctggccggccccacccgccccacagaaggggcattcatccytgaagcctgctctcctgtccccagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccg

SEQ ID NO: 59774 - DNA, 601 bp, Human
cccacagaaggggcattcatccctgaagcctgctctcctgtccccagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctaygggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctac

SEQ ID NO: 59775 - DNA, 601 bp, Human
tctagaccctgccctccactccttcttgtaagactccaactcctgctttcttcttctttgccagttcccctaaaccttgcttttttttctccttgaatcttcttcattcctatggatgggtattccttgcgttgaatatgactagggaagaaagggtctccatatgactagggaagaaagggtctccataccttcttcaggtggaggtcccctggagacctctctggccacatcagtctctgcttcagagctgggtctgaggctgggacagcgatgggctttagagtaggtggggactggrgtttggaggagaagctgagtggacttgtctcagacacagctcagcaacaaccccttgaagaggaggaaaaaacgaatgtggaagttttaaggatggataaaatcagagagttatcagagaaacataaaacatgaaaaaaaaaatcagagccctaaaacaactggatttggagtcaggcatcttggattctggcctcagttctatgcccaattcatggctcgttaccttattgataagacacatgtgtctggcagcagaaggggcagtttaggaaaggataataatgaatgcgataacttg

SEQ ID NO: 59776 - DNA, 601 bp, Human
ttcattcctatggatgggtattccttgcgttgaatatgactagggaagaaagggtctccatatgactagggaagaaagggtctccataccttcttcaggtggaggtcccctggagacctctctggccacatcagtctctgcttcagagctgggtctgaggctgggacagcgatgggctttagagtaggtggggactggggtttggaggagaagctgagtggacttgtctcagacacagctcagcaacaaccccttgaagaggaggaaaaaacgaatgtggaagttttaaggatggataaartcagagagttatcagagaaacataaaacatgaaaaaaaaaatcagagccctaaaacaactggatttggagtcaggcatcttggattctggcctcagttctatgcccaattcatggctcgttaccttattgataagacacatgtgtctggcagcagaaggggcagtttaggaaaggataataatgaatgcgataacttggaggcagaaaataatcatgaagttaggtaaaggcaaactttcatttacataatgggttaccacttttgactttggacaaattaacctctgttatctcattgt

SEQ ID NO: 59777 - DNA, 601 bp, Human
taattatgtaccaaaataaatactcataatcaagtgacttcatcctccatatcagaagtcagcaagcttgggtggacaggccaaatttggtcagcctggctttgttaacaaagttttattggaatgcagccgtccccgttcatttacacatcacctatggctgctttcatgctgtaaaatagaggttagtagttgtaggagtagtgatgatggaaaccatgtggcccacaaagtctgaaatatttcctatctggccctttacagaaaaaatgtgctaaccccctccccatgccctgcctckgctttttcctgagatttccaggggaatcaatatatacttgagaactaggagcctctcagaagattccagaagtcttcttgataaatacaggacagaagacccatgtttttgagacttttgcaaggttttacaggtaacttacaatgacaagaaaaaggagttttatacctggaactgcatttgattagagtgagggctggcggatgaggctgtaatagaagcaaatactccctctccaacctcaacccctttttaggatgtagtttttcctccctttttgtacattattcagggaagaat

SEQ ID NO: 59778 - DNA, 601 bp, Human
ttcagatttctctgtttgtctttgcctttgtcagttttacttccactccactcagggtgagccaggctgcacagaggagagaagctcagtcctggctaacatggcgaaaccccgtctctactaaaaatacagaaatattagctgggcatggtagcaagtgcctgtagtcccagctactcgggagtctaaggcaggagaatcacttggatctgggagacggaggttgcagtgagccgagatcgcgccactgcactccagcctgggcgacagagtgagaatctgtctcaaaaaaaaaaaaaaraaaaaaaagaaaagaaaagaaaagaaaagaaaagaaaagaaaagtcacctgttgaacttttgaataataaagaagactaagccccatttcagaggaacagaaaactctctgaaatgggacctgggcatccctatttttaggaaagggccttcagctgattctgatgtgctgcaggtatggaaaacactgcaccatgacaaagggcttttgagcgcacgtctgaagatccggcctctaacttcagctatgctactaacagcccttctgatgcagagctgtttccctccctgggcctctgtt

SEQ ID NO: 59779 - DNA, 601 bp, Human; identical to SEQ ID NO: 59775

SEQ ID NO: 59780 - DNA, 601 bp, Human; identical to SEQ ID NO: 59776

SEQ ID NO: 59781 - DNA, 601 bp, Human; identical to SEQ ID NO: 59777

SEQ ID NO: 59782 - DNA, 601 bp, Human; identical to SEQ ID NO: 59778

SEQ ID NO: 59783 - DNA, 601 bp, Human
gataccaccctgttccttataccaagtaaattccagccaggccaaataatgcagtgaaagaagtagccccaaaaaccaacgacataaataaaatttcagcataagagacaaattaaaaaaaataaagatgagaaaaaaacttaggaaaaaagttttattaatataataagaaaaagatcaataaccactagagaaactgtcaaatgatgtgaacagatctggcagttacagaaaaggagctgaagatgctcaccttcaccaatgtgctgaggaaatcaccaattaaaaatacacagatgtyggctgggcgcagtggctcatgcctgtaatcccagcactttgggaggccgaggtgggcagatcacctgaggtcaggagttcgagaccagcctggccatggtgaaacactgtctctactaaaaatacaaaaattagccaggcgtggtggtgggtgcctgtaataccagctactcgggaggctgaggcaggagaatggctggaacctgggaggcggaagttgcagtgagccaagattatgccactgcactccagcctgggtgacagagcgagactccgtctccaaaataaataaataaataaa

SEQ ID NO: 59784 - DNA, 601 bp, Human
cgacaggtgagcaggaagagccgggatggtgtctctgtcaccttcctctctggagacaccactaggcaggacctttgagcaccaaagacactctccactcctggcctcctctcagagaaatgaagccaaaagctccatccacagccaggccagggaaaaaacccaagaaacagaagctggataccaccctgttccttataccaagtaaattccagccaggccaaataatgcagtgaaagaagtagccccaaaaaccaacgacataaataaaatttcagcataagagacaaattaaaaaaaataaagatgagaaaaaaacttaggaaaaaagttttattaatataataagaaaaagatcaataaccactagagaaactgtcaaatgatgtgaacagatctggcagttacagaaaaggagctgaagatgctcaccttcaccaatgtgctgaggaaatcaccaattaaaaatacacagatgtcggctgggcgcagtggctcatgcctgtaatcccagcactttgggaggccgaggtgggcagatcacctgaggtcaggagttcgagaccagcctggccatggtgaaacactgtctctactaaaa

SEQ ID NO: 59785 - DNA, 601 bp, Human
actggtgaggaggtaatctgggggatgtaaatgaccagtaggccaggaaccttctaatagaaggaactgcccgacaggtgagcaggaagagccgggatggtgtctctgtcaccttcctctctggagacaccactaggcaggacctttgagcaccaaagacactctccactcctggcctcctctcagagaaatgaagccaaaagctccatccacagccaggccagggaaaaaacccaagaaacagaagctggataccaccctgttccttataccaagtaaattccagccaggccaaataatrcagtgaaagaagtagccccaaaaaccaacgacataaataaaatttcagcataagagacaaattaaaaaaaataaagatgagaaaaaaacttaggaaaaaagttttattaatataataagaaaaagatcaataaccactagagaaactgtcaaatgatgtgaacagatctggcagttacagaaaaggagctgaagatgctcaccttcaccaatgtgctgaggaaatcaccaattaaaaatacacagatgtcggctgggcgcagtggctcatgcctgtaatcccagcactttgggaggccga

SEQ ID NO: 59786 - DNA, 601 bp, Human
catggctcactgcagcctggacctcctgggctcaggtaatcctcccgcctcagcctcctaaagacatgtgccaccacacacagctaatttttttttttgagagtcttactatgttgccgaggctggtatatgctgttctttttaagtttttttattatttatttttatttttttgagacagggtctcactctgtaacccaggctggagtgcaatggtgtgatctcggctcactgcaacctctgcctcctgggttcaagtgattctcctgcctcagcctcccaagtagctaggattacaggygcccgccatcatgtctggctaatttttgtatttttagcagagacagggtttcaccatgttggccaggctggtctcgaactcctgacctcaggtgatctgcctgcctcggcttcccaaagtgttaagattacaggcatgagccaccacgcctggcctacttttattttttaaacagcgtctcactctatcacccaggctggagtgcagtggtgcgagctcagctcactgtaacctccgcctcctgggatcaagggattcttgtgcctcagcctccaacaggagggcgcaaccatccctggc

SEQ ID NO: 59787 - DNA, 601 bp, Human
ctcttgctaatagcagctgctgctgcagtctgcagagacacccaatggcaggcggacatgtgaggaaacctgcagggtccctcaacaatcacacctgctcgtctcgagtatgtggcttctttttacacactgggtttcacgctgcaatgcatatcagaatcacctgatgggattgttaaaacacattgctgggctccaccaccaagagtttctgagacagtggaaccagtttttgcatttggaacaagtttccagatgatgttactggtccagggaactcactttgaagaccactgttctrgccacgctatccaactataagagtctagctgcccttcatatctatcttgaagaactgggcatattgggttttgtttgtttgagacagggtctcgctctgtcacccagactggagtgcactggcacaatcatggctcactgcagcctggacctcctgggctcaggtaatcctcccgcctcagcctcctaaagacatgtgccaccacacacagctaatttttttttttgagagtcttactatgttgccgaggctggtatatgctgttctttttaagtttttttattatttatttttattttt

SEQ ID NO: 59788 - DNA, 601 bp, Human
tgaagaaccagggcaaatgaggcagcatcaccctgtttctgcagtagaggctgctgattaagagaagtaagtgatttgcagatctgtcagtaagggaggaagagcggcctggacaggtgccaggtgagacacctgctctcacgaagtccctctgaacacggatcccttggcaatgtcccctgccagttaaattgtgaggagggacacagatctgctgtgacaccagccacattgtgcaacctgcctgctcttgctaatagcagctgctgctgcagtctgcagagacacccaatggcaggcrgacatgtgaggaaacctgcagggtccctcaacaatcacacctgctcgtctcgagtatgtggcttctttttacacactgggtttcacgctgcaatgcatatcagaatcacctgatgggattgttaaaacacattgctgggctccaccaccaagagtttctgagacagtggaaccagtttttgcatttggaacaagtttccagatgatgttactggtccagggaactcactttgaagaccactgttctagccacgctatccaactataagagtctagctgcccttcatatctatcttgaaga

SEQ ID NO: 59789 - DNA, 601 bp, Human
ttctcaggactccaggtctgtctatttatcttcctgtgtccttattgccatccctccagcaacaggggaagtcagaggcccctgtctctcttcattctccaacctctggttcatcaggcaaggggacctggtaaggtatggaatcatcgttcctagaagcaaaaagggccctcaggaggttcatctgatgcagggtgaagaaccagggcaaatgaggcagcatcaccctgtttctgcagtagaggctgctgattaagagaagtaagtgatttgcagatctgtcagtaagggaggaagagcrgcctggacaggtgccaggtgagacacctgctctcacgaagtccctctgaacacggatcccttggcaatgtcccctgccagttaaattgtgaggagggacacagatctgctgtgacaccagccacattgtgcaacctgcctgctcttgctaatagcagctgctgctgcagtctgcagagacacccaatggcaggcggacatgtgaggaaacctgcagggtccctcaacaatcacacctgctcgtctcgagtatgtggcttctttttacacactgggtttcacgctgcaatgcatatcagaa

SEQ ID NO: 59790 - DNA, 601 bp, Human
gaaagggcagccaccaccacaactgggaccctgcagaagaaactgctgcatctgccctgcttgtcgcagaccagttcactgtctcctgctggcgcctccagctagaaacagtacccaccagcatgctgcctgacttctgggccagggccacacccccggccccacccacagtgacaggattcactccccatgagccagtttccttgaaaggccctctcactgaagctttgctcctgcctctgctggcaagggtgcagtgcgcctctgggcctgttctcccacctcagaggtagagacgcaytgcctcattctcaggactccaggtctgtctatttatcttcctgtgtccttattgccatccctccagcaacaggggaagtcagaggcccctgtctctcttcattctccaacctctggttcatcaggcaaggggacctggtaaggtatggaatcatcgttcctagaagcaaaaagggccctcaggaggttcatctgatgcagggtgaagaaccagggcaaatgaggcagcatcaccctgtttctgcagtagaggctgctgattaagagaagtaagtgatttgcagatctgtcagtaagggag

SEQ ID NO: 59791 - DNA, 601 bp, Human
aaaaggggccagggccagagaagacgacttctccatgtgactacccacagctcctgcagaaaacagggagtgacctttgacccttagcatctgcctccacttcctctcttggcaagggggatcttgttgctgcaaacccacacaccttgagcagagggtaggagaggtggtaaggggcaaccatcacctagcaatgctttggaggacaccgtgtcgctctgcctgcctatctcatcagtatccaggaccacctaatgagggagaaatccttgaagcaattttgcggagaagaaaactgagyctcaaagtgacagcatttgcccactgttactagagagtaaggcaagagacccagccctgggcctggtccagggctttctggaggcagtttcaaacctaggcctccgatggccttagtgtcatgctcttctccagcccctgcctcggctggctgtcccactactcctgttgtcctctcctcccctgctgggccgtgctgtgaggggaggaggggagtgaggaaactactgttctcccctctccactcccagccactgtacagaggcagcattcactctcctccccaccccagaccctctta

SEQ ID NO: 59792 - DNA, 601 bp, Human
gctccagaccctccaggaagaaccttccctaaatttcctgcctcctcctctcttgctgctcagaggctgctcagctgtgctagcaaaggtggcagtggcaggatctggatggcaggatttctactatagagagagaacccaggccagtgccagccaacctggggtgggctcattcagagggcagtggcccagctcagcccctaacatgccctgggacagcagctgagccacctctaggtctgagtctgttcttcacctgctgaatgggagggaaggtaaatggcctgcaggtctggggtgytcaaaccacaggacctcagctccaaagaaatcaatgatgcctaggagtcccctggggagaggggcagcggctcaggcaccctcaggatgaccagccttggaatgacccttttctccccttggtctcatgagccctcatatttcctttcccacagtggggaccaaatctcatttgaggaccaaaaggggccagggccagagaagacgacttctccatgtgactacccacagctcctgcagaaaacagggagtgacctttgacccttagcatctgcctccacttcctctcttggcaaggggg

SEQ ID NO: 59793 - DNA, 601 bp, Human
agcaggataagaggctggagggacatggggctgggtcatggtaaacacagataccagtccacaagaggacaggaagaaacagaggtgaaaagcccgctctgaaaccagcaggaccggtatgtgccctggggcaaggctttcaccctccttaggcttgtttcctcagcttacaaatgggctaatggtgagtgtatgcctagactgctgtgacgaagactgagttaacacctgcagggctcagctgggtgcccgatgggcattcgacatcatcatggggcctctggcctgttagatgctttcytctacatggcagcttcggatcggctcttcatctccagggctccagaccctccaggaagaaccttccctaaatttcctgcctcctcctctcttgctgctcagaggctgctcagctgtgctagcaaaggtggcagtggcaggatctggatggcaggatttctactatagagagagaacccaggccagtgccagccaacctggggtgggctcattcagagggcagtggcccagctcagcccctaacatgccctgggacagcagctgagccacctctaggtctgagtctgttcttcacctgctg

SEQ ID NO: 59794 - DNA, 601 bp, Human
tttcagtaatgcgaaggcactggcgggagggggtttggctgtttgctattacaagtctgtaaaaggcagggagaagcaggataagaggctggagggacatggggctgggtcatggtaaacacagataccagtccacaagaggacaggaagaaacagaggtgaaaagcccgctctgaaaccagcaggaccggtatgtgccctggggcaaggctttcaccctccttaggcttgtttcctcagcttacaaatgggctaatggtgagtgtatgcctagactgctgtgacgaagactgagttaacrcctgcagggctcagctgggtgcccgatgggcattcgacatcatcatggggcctctggcctgttagatgctttcttctacatggcagcttcggatcggctcttcatctccagggctccagaccctccaggaagaaccttccctaaatttcctgcctcctcctctcttgctgctcagaggctgctcagctgtgctagcaaaggtggcagtggcaggatctggatggcaggatttctactatagagagagaacccaggccagtgccagccaacctggggtgggctcattcagagggcagtggc

SEQ ID NO: 59795 - DNA, 601 bp, Human
ccagagatcctcatccccttctgcaggggagatgccttccctctccacatggttgctcctcccatcccagaccacctgggtgaaggttaagagctcactgcccaagaaggtgcgtgggtcccatatgcagggttgggggcatccccatcacatcagcctgctacccacagacacctctggcaggcatgttcaggtgaatctgcactcaccaggaataaaaacctaaatccttaggatggatagcctcctacaccctgcaagagctagacccccagacttcatttcccatctcaccccctcrcctttccactttagccacactggcctctcctccctgtccctgagcacctcacaccccttggcacctcagggcaccggcattccctagacatccatacagcacttccttcccctgatgcaggtctttgctcacacatcctcttttcagccagacccaccttactgctaacttaaaatcattatccttacatcaccccacccccactcctgacccctttaccctggtcaacttgttcctatggcacctacactttcaataacatcacatcgttgacttaaggtactgcctgtcttttcccca

SEQ ID NO: 59796 - DNA, 601 bp, Human
gagggcagctcagggaaaagataagggagggaggctggaggatggcacagggtgggggaacgtgtgggtatggaagggaaggaggaaaggagaccctctgtctaaaaatagtcattgagcacataccactacccctgtgctggctggttgggccacagaaccatgacaacgaattctaggctctgcaaacacgaactgttctccaaaatgagccaagatcaaccctggaggaactgccaacattctccctacccaaagggaattttaataatcctccaaaacctgtctgtgccggggggggcgggggtggtgcatatcaagggaccgaagacagctgttgagcacaaagccttgagacaggtggcctgggcagttcttacaaaacacacagcccaggcagtaaatgacacagaggaataaggagtactcgccaggggtgttctgacccaactcggatgtggagcgtctcatcacaccaggagaaacaggacagctcccttgggccttaagcaacacaacccagaggtggggagtctgcaagaaggtgacgctctttgtttgtctttttttgtttttgtttttgttttaaaaactgggtctt

SEQ ID NO: 59797 - DNA, 601 bp, Human
tgtaagatgggagtgatactaggacctacctcacaggaaagtcatgaggattaagtgagttaatgtacgtagagcacttagggcctgtcaggcaggacgtgcgacattgtgtcagctgtttcctgctacagctactattgggttactacacgttagcccctcacccagtattcccagcatgtcctgagacagcatccactgtccccatttcacaggtgctcaaggacacacagctggtgagtgacagctgccccaaacctgtgtggtttctaacactccacaaccaccagctcatgactcyggctgaagacgggggccagggagatgtctgggtccactccctggggccccgggccatcgccctgcctgatggcctcctgaccccctccctagaataacacatgtagatgtgtttcagcggagacccctctcctttccaggccaccacactgaagtctctgcttctcctgaaggagggaacattcactgtgcttatcaggcctctgagtgacaggctccttctgggctccagcctgactcatgggattccctttccaagggagctgcctgcccctgcctgcagggtgcacacagagctgtg

SEQ ID NO: 59798 - DNA, 601 bp, Human
tgatgagtagggctcacacaaaggggcatccccatggatcagaaaactgagcatcagagaggggtactggctggtccgaggccacacagtaaatggttgggttaaaatgtggaccgaggcctgctttattcagagttcagccggaagcgagatgacaacaactgaaaaaaatgggtaaaaagcaagagagatccaagtggacatacgaaaccctggtcctagaggggatggtggaatgtctgaaaacaactaggaaaaggtaggaacaacaaggatgaatcggacaaccacgccagggacrgtaagaccatagaggacaggctgggcagcctggcttgtatgttggtttgaatcctggctctgcagcttaccagctgtgtgacctcgggcacattacttaacctctctgtgcttccagttccttgtctgtaagatgggagtgatactaggacctacctcacaggaaagtcatgaggattaagtgagttaatgtacgtagagcacttagggcctgtcaggcaggacgtgcgacattgtgtcagctgtttcctgctacagctactattgggttactacacgttagcccctcacccagtattcc

SEQ ID NO: 59799 - DNA, 601 bp, Human
acagtggcagtggtgatgagtagggctcacacaaaggggcatccccatggatcagaaaactgagcatcagagaggggtactggctggtccgaggccacacagtaaatggttgggttaaaatgtggaccgaggcctgctttattcagagttcagccggaagcgagatgacaacaactgaaaaaaatgggtaaaaagcaagagagatccaagtggacatacgaaaccctggtcctagaggggatggtggaatgtctgaaaacaactaggaaaaggtaggaacaacaaggatgaatcggacaamcacgccagggacagtaagaccatagaggacaggctgggcagcctggcttgtatgttggtttgaatcctggctctgcagcttaccagctgtgtgacctcgggcacattacttaacctctctgtgcttccagttccttgtctgtaagatgggagtgatactaggacctacctcacaggaaagtcatgaggattaagtgagttaatgtacgtagagcacttagggcctgtcaggcaggacgtgcgacattgtgtcagctgtttcctgctacagctactattgggttactacacgttagcccct

SEQ ID NO: 59800 - DNA, 601 bp, Human
cccgggcaagcacaatgacagtggcagtggtgatgagtagggctcacacaaaggggcatccccatggatcagaaaactgagcatcagagaggggtactggctggtccgaggccacacagtaaatggttgggttaaaatgtggaccgaggcctgctttattcagagttcagccggaagcgagatgacaacaactgaaaaaaatgggtaaaaagcaagagagatccaagtggacatacgaaaccctggtcctagaggggatggtggaatgtctgaaaacaactaggaaaaggtaggaacaacraggatgaatcggacaaccacgccagggacagtaagaccatagaggacaggctgggcagcctggcttgtatgttggtttgaatcctggctctgcagcttaccagctgtgtgacctcgggcacattacttaacctctctgtgcttccagttccttgtctgtaagatgggagtgatactaggacctacctcacaggaaagtcatgaggattaagtgagttaatgtacgtagagcacttagggcctgtcaggcaggacgtgcgacattgtgtcagctgtttcctgctacagctactattgggtt

SEQ ID NO: 59801 - DNA, 601 bp, Human
tgccttaatcccagcaacagaggcccctgacacagagacacaccctccagccactcccaggctcgagggcatcagctcttctccacagcccgggcaagcacaatgacagtggcagtggtgatgagtagggctcacacaaaggggcatccccatggatcagaaaactgagcatcagagaggggtactggctggtccgaggccacacagtaaatggttgggttaaaatgtggaccgaggcctgctttattcagagttcagccggaagcgagatgacaacaactgaaaaaaatgggtaaaaagmaagagagatccaagtggacatacgaaaccctggtcctagaggggatggtggaatgtctgaaaacaactaggaaaaggtaggaacaacaaggatgaatcggacaaccacgccagggacagtaagaccatagaggacaggctgggcagcctggcttgtatgttggtttgaatcctggctctgcagcttaccagctgtgtgacctcgggcacattacttaacctctctgtgcttccagttccttgtctgtaagatgggagtgatactaggacctacctcacaggaaagtcatgaggattaagt

SEQ ID NO: 59802 - DNA, 601 bp, Human
cctcaccagcactcgggaagaagggtgggggctacgctgctgccttaatcccagcaacagaggcccctgacacagagacacaccctccagccactcccaggctcgagggcatcagctcttctccacagcccgggcaagcacaatgacagtggcagtggtgatgagtagggctcacacaaaggggcatccccatggatcagaaaactgagcatcagagaggggtactggctggtccgaggccacacagtaaatggttgggttaaaatgtggaccgaggcctgctttattcagagttcagccrgaagcgagatgacaacaactgaaaaaaatgggtaaaaagcaagagagatccaagtggacatacgaaaccctggtcctagaggggatggtggaatgtctgaaaacaactaggaaaaggtaggaacaacaaggatgaatcggacaaccacgccagggacagtaagaccatagaggacaggctgggcagcctggcttgtatgttggtttgaatcctggctctgcagcttaccagctgtgtgacctcgggcacattacttaacctctctgtgcttccagttccttgtctgtaagatgggagtga

SEQ ID NO: 59803 - DNA, 601 bp, Human
gagcacagggatctgcagagggcagagggcagagggcagagggagcggcctcacctgctttgtaggctctgtttaattctcggatgtgctcattgctgcgggaagcgaggatctcaatcaggcaggcttcatcagtgccaaccccctgcaggggcagagaatacaaccaaccatgtgcttgttccagcagcctcaccagcactcgggaagaagggtgggggctacgctgctgccttaatcccagcaacagaggcccctgacacagagacacaccctccagccactcccaggctcgagggcrtcagctcttctccacagcccgggcaagcacaatgacagtggcagtggtgatgagtagggctcacacaaaggggcatccccatggatcagaaaactgagcatcagagaggggtactggctggtccgaggccacacagtaaatggttgggttaaaatgtggaccgaggcctgctttattcagagttcagccggaagcgagatgacaacaactgaaaaaaatgggtaaaaagcaagagagatccaagtggacatacgaaaccctggtcctagaggggatggtggaatgtctgaaaacaactag

SEQ ID NO: 59804 - DNA, 601 bp, Human
tcaaagcccaaagtattgggggtggcagaagatgggttgataagaaggccaggaaggagtaaaaggccctaggagagaatgaggccacagccccaagagcacagggatctgcagagggcagagggcagagggcagagggagcggcctcacctgctttgtaggctctgtttaattctcggatgtgctcattgctgcgggaagcgaggatctcaatcaggcaggcttcatcagtgccaaccccctgcaggggcagagaatacaaccaaccatgtgcttgttccagcagcctcaccagcactcsggaagaagggtgggggctacgctgctgccttaatcccagcaacagaggcccctgacacagagacacaccctccagccactcccaggctcgagggcatcagctcttctccacagcccgggcaagcacaatgacagtggcagtggtgatgagtagggctcacacaaaggggcatccccatggatcagaaaactgagcatcagagaggggtactggctggtccgaggccacacagtaaatggttgggttaaaatgtggaccgaggcctgctttattcagagttcagccggaagcgagatgaca

SEQ ID NO: 59805 - DNA, 601 bp, Human
gagagatgaggagccgctggaagtgccctgatgtgtcgcttcgaatggcctcttccagggtctttttgaattctgaaagggagaagcaaggaaggtccatcctgtagctctctttatggagctgcccattgcaaaacactatcaaaagtgggtactggggagaaaaaggctggaggtcttggctcgggctcaagagaacaaatagcccatatggccctccagggatatacaagcctgtgacctccaggctgacctggcctctagtcagccttggcccaaaccacatccaggttttccctgsctctcccttacattagtcatttgcaccatgtataaacagaaggaagggctgggtcttgggtcaaagcccaaagtattgggggtggcagaagatgggttgataagaaggccaggaaggagtaaaaggccctaggagagaatgaggccacagccccaagagcacagggatctgcagagggcagagggcagagggcagagggagcggcctcacctgctttgtaggctctgtttaattctcggatgtgctcattgctgcgggaagcgaggatctcaatcaggcaggcttcatcagtgccaaccc

SEQ ID NO: 59806 - DNA, 601 bp, Human
tggggaagctgaagccctggaggtcagattacctgttctaggtcatacagttgaacagttcagcgcgtctgaaactcacagcatctgcaacccactgcttatctattgttctttccaccctagggtacctctctcaggaagcaagaaagcggggtgcatccctgctttaggaagtccaggggcttggccatcacactcacctgggcatctctctgggcgagtgacatgtccacgtttgtgctttcatcacggtttccctgaaaggaagcaggtgtatggtcatgcccactccttccccatktattttccctttcctcattgcggggatcccatctctttgacttccatggcttgggggccccgagccctgtcgtgggaaaagtacctgagagagagagatgaggagccgctggaagtgccctgatgtgtcgcttcgaatggcctcttccagggtctttttgaattctgaaagggagaagcaaggaaggtccatcctgtagctctctttatggagctgcccattgcaaaacactatcaaaagtgggtactggggagaaaaaggctggaggtcttggctcgggctcaagagaacaaatagccc

SEQ ID NO: 59807 - DNA, 601 bp, Human
tcacaagagggacaacgacagaattctaagggtgctcaactaatgtggcagctggtttctaggctcaaatcctcaaaaacttaataagcaagtgcaaattttgcccctttgcaaacataatgctatgtgcaactaaacatggggaaagtacgctgtcacacaaaatcccacgtccaaaaccatgatctatcaactatcgaaatactaattatctcacatgttccctcctataggtggggaagctgaagccctggaggtcagattacctgttctaggtcatacagttgaacagttcagcgcrtctgaaactcacagcatctgcaacccactgcttatctattgttctttccaccctagggtacctctctcaggaagcaagaaagcggggtgcatccctgctttaggaagtccaggggcttggccatcacactcacctgggcatctctctgggcgagtgacatgtccacgtttgtgctttcatcacggtttccctgaaaggaagcaggtgtatggtcatgcccactccttccccatttattttccctttcctcattgcggggatcccatctctttgacttccatggcttgggggccccgagcc

SEQ ID NO: 59808 - DNA, 601 bp, Human
acacccagaccccaggcccaggtcacccaggagagcctggtaaacttctgaaggtttgagcctaaagtatttgccaatttgcaacctctgaactagatggcctctaaagtgcctgctaggcctcaggtagcagccctgaaaaagagcagaaagcagcaatcaggggctgagatcccacaggtcaagatgaggccaaagcagctctggactgagaaggcagagcatgagacaatttttgccccgctaaaagtggcatgcaaaactctcgctggagcaaaagccagagccctgagccccaggsgtgtccagccctgactcccagaatgggaatggatgttaccagccagagagacactgaataaggcagaccctgcaggagcagcaggtctgagaccagggcagaggcaagtgctgactgggcacagaagaccgagccaggagtataggcccttgtccgggctctgcttctagctttcagttgggaacagtgctcaacctttttgagcctcagtttcctcctccggaaaaggaggaccagcaaaaggaccagaccagaggagtagctctcctccagccctaacaagggggcattccttgaggt

SEQ ID NO: 59809 - DNA, 601 bp, Human
gtttgccagaactcaggaaaccctctgacagtgtcttttaaatccccaccagggggctcttttgaggaggcgaaagccccacgcagggaggaacgaccaagtgttcccatagctttgtttccccacaatcccctgactgccctcatctaactggcctctgagggaccccagcctgccttacctgctaccaggtgggcccggctccgggagcacagaaccgcattgaacttggactcgtctgttcccaggcggttctccccggccgcatacagctcctggagagagaggaagacgcacatgyggcacaggccacacccagaccccaggcccaggtcacccaggagagcctggtaaacttctgaaggtttgagcctaaagtatttgccaatttgcaacctctgaactagatggcctctaaagtgcctgctaggcctcaggtagcagccctgaaaaagagcagaaagcagcaatcaggggctgagatcccacaggtcaagatgaggccaaagcagctctggactgagaaggcagagcatgagacaatttttgccccgctaaaagtggcatgcaaaactctcgctggagcaaaagccagagccct

SEQ ID NO: 59810 - DNA, 601 bp, Human
cccgacaggcttcgctgcttggccttgcacccttcactccattctcggcaccacagccagggattctgcacagcctcctctgctcagggccctccactggcttcctcttttgctcaggataaatacccagctccgggaagtcatcagcagggccctctcccctctctgccctcacctcccactcctcttgctcactccacctgctccacatggtcccccttcactgttctcagtcgtgctgggagccccaggcaggcctctgcccctgcatctccctttaggtttttaaatcaaatgtcaygacctcagtggggactggcccaagcacctcccggtggaccctaccatcactccctacctgtttccagcttgattttcctctacaggatttcccatctgatacagattttatttcattgttgtttactgtctgtctccccaaatgagaaagtgcagcccatggaacacactctgcagtgccctgccccccaccgtggccccacacctgctccaccacctgacagactgacccatgcgggagcgcgatttacatctgttgaatgaatgagtaaatgaatggcacccagttttattgttatga

SEQ ID NO: 59811 - DNA, 601 bp, Human
gtcctcctccctccctagctgctccttcttagtctcctcacaccggtgggctccccacagtctccctcctgaggggacctcctgcagtcccagagcctcagataacttcaactacccatagctcccttaccttccacaaccaggccagacctctcctgacctccacactcagcaacccagcagcctccctgcagctccaccctacaggcacctaaagccagctccacctacagtccccctgtctcagttgagggccattctcccactgcttggcctaaagaaaccctgtataatcctcgamccctctctctcccacacgtcacgtgtccaattcatcagcaaacatggccggaacctgacacctcctcaccacaagcccctattaccaccattcctccccgggtccctgcagcagcctcccgacaggcttcgctgcttggccttgcacccttcactccattctcggcaccacagccagggattctgcacagcctcctctgctcagggccctccactggcttcctcttttgctcaggataaatacccagctccgggaagtcatcagcagggccctctcccctctctgccctcacctcccact

SEQ ID NO: 59812 - DNA, 601 bp, Human
tcttgctgctcacctcgacctaggacacgctaagcacccacaggagtggatggctggctcctagagagacaggtggcatgatggagaccttggtcctgactccagttctgacccaggacataaaactctccttccccagcctgagtctcagctaccatttgcattttaaagttgtgatttctgctctgtgtgtatctgtctcaattaatatcttcttccaatcagctactcttttctcctaagtaataatgtttgtgaagccatgggcttgatgcactacttacatgttctgtactcattwaaagaaataatgattaagatgaaaatgctttcactcaggctccattacaggatagtgcagaggttaaaaagtgtgctctggggtcgggtggtctgggttcaaatcccagctcagctgttactagctgtgcacccctacttcctctaccaccctgtgcctgctttcacagctgcgaatggggagagccacagcgcctgtctctgtgtgcagcacagagcggtcgctgggttttcaccctcactgcccactggagcagccctggccacagcccaccagttgctccgtgtggtcaccatcctc

SEQ ID NO: 59813 - DNA, 601 bp, Human
gtccctttctcaggactgccaatctgcttaaccaaatcgcaccttaatacccctccagggcccactcccatgtactccaagacagtgtcccctcttctcaaatcctccacacctccagtctctgccattccttggctttattcatgcatccatctgtcttcctcagcctgcctgtgagctgaggcccagcctgccccagccagcctggcttcttgctgctcacctcgacctaggacacgctaagcacccacaggagtggatggctggctcctagagagacaggtggcatgatggagacctyggtcctgactccagttctgacccaggacataaaactctccttccccagcctgagtctcagctaccatttgcattttaaagttgtgatttctgctctgtgtgtatctgtctcaattaatatcttcttccaatcagctactcttttctcctaagtaataatgtttgtgaagccatgggcttgatgcactacttacatgttctgtactcattaaaagaaataatgattaagatgaaaatgctttcactcaggctccattacaggatagtgcagaggttaaaaagtgtgctctggggtcgggtg

SEQ ID NO: 59814 - DNA, 601 bp, Human
taatgaaaaaaggggcagactgattttcccaagtgagtagaaagaggggttgtgagggcctcagggcagggacccaactctgcacagtgggagggccctgctagaggacatgggcaatgtaagaggcacaccaccatcctggagccaagccagctttcctcagcatgggcctgtttcgctgctgcaagtaaaaatctttccacgtgtttccatcacaaacatctgacaactgcctgcagggatgtatttttagaggaaacgtggcaggatatgagtcatactcctccgggagcgcagttgratgccctcccactaatacccacactgcagttccctactccagagctgcaccgcaaacacacacaagacacctccaggacagctaggggttcaactgcacagggaaccgggaagcagcatgacttcccagcatctggacactctgggctgagcgatcttggatcctgtggtcccttcacggtgtcacccatcagctggaggacaggcgagcagcctgaacactcacgatacacgttagcccctggcaggtgggcggcaaacctgagacacttacccacggccagcatgccctcctccaggt

SEQ ID NO: 59815 - DNA, 601 bp, Human
cccaagcagggcatggagtctacaagtgtcctcttagaggcccagatgtcaaacccatcactgcatccatcttttctcctcctccttctgttccaggctcaactatcccatgatcttggctccagctatttggaacagaaacacgcaaagcctggaaaccaacccaccctctttcctggcaaccactgcggtgaaaggaccaagagtcagaggggcgggggtcttagtggggctaggagctacacagggaagcaatgtggatggtgatgaggaactgtgctgctgctcaggcaggaggggyagactggagaggccatgaccgtcatggagaaaccgtggctgagtggaatgtgcatctccctaggcttcccaggccatgagacctactatgggggacaggcagggaaatgaggattttccatctctcccatccagaaagctccaaaaaaagcataatgaaaaaaggggcagactgattttcccaagtgagtagaaagaggggttgtgagggcctcagggcagggacccaactctgcacagtgggagggccctgctagaggacatgggcaatgtaagaggcacaccaccatcctggagccaa

SEQ ID NO: 59816 - DNA, 601 bp, Human
gcccaagcagggcatggagtctacaagtgtcctcttagaggcccagatgtcaaacccatcactgcatccatcttttctcctcctccttctgttccaggctcaactatcccatgatcttggctccagctatttggaacagaaacacgcaaagcctggaaaccaacccaccctctttcctggcaaccactgcggtgaaaggaccaagagtcagaggggcgggggtcttagtggggctaggagctacacagggaagcaatgtggatggtgatgaggaactgtgctgctgctcaggcaggagggkcagactggagaggccatgaccgtcatggagaaaccgtggctgagtggaatgtgcatctccctaggcttcccaggccatgagacctactatgggggacaggcagggaaatgaggattttccatctctcccatccagaaagctccaaaaaaagcataatgaaaaaaggggcagactgattttcccaagtgagtagaaagaggggttgtgagggcctcagggcagggacccaactctgcacagtgggagggccctgctagaggacatgggcaatgtaagaggcacaccaccatcctggagcca

SEQ ID NO: 59817 - DNA, 601 bp, Human
cctctccgcaaagaaggctggggtattcttgagacatttcactagaagagagaaactcggcataaccagatctgcagaaaattctcagcccaagcagggcatggagtctacaagtgtcctcttagaggcccagatgtcaaacccatcactgcatccatcttttctcctcctccttctgttccaggctcaactatcccatgatcttggctccagctatttggaacagaaacacgcaaagcctggaaaccaacccaccctctttcctggcaaccactgcggtgaaaggaccaagagtcagagrggcgggggtcttagtggggctaggagctacacagggaagcaatgtggatggtgatgaggaactgtgctgctgctcaggcaggaggggcagactggagaggccatgaccgtcatggagaaaccgtggctgagtggaatgtgcatctccctaggcttcccaggccatgagacctactatgggggacaggcagggaaatgaggattttccatctctcccatccagaaagctccaaaaaaagcataatgaaaaaaggggcagactgattttcccaagtgagtagaaagaggggttgtgagggcc

SEQ ID NO: 59818 - DNA, 601 bp, Human
agcccttggtcccaggcacaggcgaggctaaggttccatcgcaacctgcacatggaagttacataccctcatggccttgttgagcctctccgcaaagaaggctggggtattcttgagacatttcactagaagagagaaactcggcataaccagatctgcagaaaattctcagcccaagcagggcatggagtctacaagtgtcctcttagaggcccagatgtcaaacccatcactgcatccatcttttctcctcctccttctgttccaggctcaactatcccatgatcttggctccagctayttggaacagaaacacgcaaagcctggaaaccaacccaccctctttcctggcaaccactgcggtgaaaggaccaagagtcagaggggcgggggtcttagtggggctaggagctacacagggaagcaatgtggatggtgatgaggaactgtgctgctgctcaggcaggaggggcagactggagaggccatgaccgtcatggagaaaccgtggctgagtggaatgtgcatctccctaggcttcccaggccatgagacctactatgggggacaggcagggaaatgaggattttccatctctccc

SEQ ID NO: 59819 - DNA, 601 bp, Human
aggagggaggttccacaggtgactgagatgccaaaagggagcccagttggcctgcagcaggcccgtaccgagatgtcgtggtacagcgacttgccgtacatccgcttatactctgatctgatgtccaggaggtcggtctcgctgcgagacaccatgatgcgaatcagggtccggtcctttgttcctgccccctaaagagagtccacccaagagcatgagcaccaggcctcctcaccttcccacctgccctgggccctccagtcccctccctacccaggtcctcggaactctcagctgagayttagctctccccaggccttctgccctcagcccttggtcccaggcacaggcgaggctaaggttccatcgcaacctgcacatggaagttacataccctcatggccttgttgagcctctccgcaaagaaggctggggtattcttgagacatttcactagaagagagaaactcggcataaccagatctgcagaaaattctcagcccaagcagggcatggagtctacaagtgtcctcttagaggcccagatgtcaaacccatcactgcatccatcttttctcctcctccttctgttccaggctca

SEQ ID NO: 59820 - DNA, 601 bp, Human
gctgagtgcaggaagtgctttgtcagggagtgacagcagagctccacagagcctttgggacatgagttctcactgacagatcaaggaatcacacggtgatcggaacgctgaaggtcacggtcaaggttggggaggtcccgagtgttctctgatgctgctgggggatgcaaggtgggggcgacagcaaggtcatgatccacctgccctcagaaatttataatctgtttaagggcaaggggatgaacaagtccgaggtccataatcaagatgcccacacacagcacagaggccaagcatatgrccactccaaggagggaggttccacaggtgactgagatgccaaaagggagcccagttggcctgcagcaggcccgtaccgagatgtcgtggtacagcgacttgccgtacatccgcttatactctgatctgatgtccaggaggtcggtctcgctgcgagacaccatgatgcgaatcagggtccggtcctttgttcctgccccctaaagagagtccacccaagagcatgagcaccaggcctcctcaccttcccacctgccctgggccctccagtcccctccctacccaggtcctcggaactctc

SEQ ID NO: 59821 - DNA, 601 bp, Human
acctgcactgcctcactcaatactcacaacattcccaggaaggaacgattattttctcatcttaaagacaatggagctggggttcagggagatttaagggagccattcaaggtcacacagttagcaagtagaaaagctggactccaagtggcgtgacccccagggccctcgctctgaacggccttactatgtggcctacgccataaagctgagtgcaggaagtgctttgtcagggagtgacagcagagctccacagagcctttgggacatgagttctcactgacagatcaaggaatcacasggtgatcggaacgctgaaggtcacggtcaaggttggggaggtcccgagtgttctctgatgctgctgggggatgcaaggtgggggcgacagcaaggtcatgatccacctgccctcagaaatttataatctgtttaagggcaaggggatgaacaagtccgaggtccataatcaagatgcccacacacagcacagaggccaagcatatggccactccaaggagggaggttccacaggtgactgagatgccaaaagggagcccagttggcctgcagcaggcccgtaccgagatgtcgtggtaca

SEQ ID NO: 59822 - DNA, 601 bp, Human
attaactctctttttttttttgagacgaagtctcactctgtcaccaagactgaagtggaatggcgtgatcccagctcactgcaacctctgtctcccgggttcaagcaattctcctgccgcagcctacctaattagctgggattacaggcaagcccagctaattttgtatttttagtagagacagggttttaccttgttggccaggctggtctcgaactcctgacctcaaatgatccacctgcctcagcctcccaaagtgctgggattacaggcgtgagccactgtgcccagcctagaatcrctaattctctaacaacagcttcattcatacagccaaggaaacacagtgagtttcctgtgatgacatgcccaccatcatcaaatgctactgagtctaaggtgggaggacgtggtccccatggtgcaattgcaaggctcatgtgagttcagaatttgagcgttagaccacacagctgagaatgtattttgtcagactggctctgccacacagcgatacaactgtggctagtgtttaatagacacttgacctgcactgcctcactcaatactcacaacattcccaggaaggaacgattatttt

SEQ ID NO: 59823 - DNA, 601 bp, Human
tattaactctctttttttttttgagacgaagtctcactctgtcaccaagactgaagtggaatggcgtgatcccagctcactgcaacctctgtctcccgggttcaagcaattctcctgccgcagcctacctaattagctgggattacaggcaagcccagctaattttgtatttttagtagagacagggttttaccttgttggccaggctggtctcgaactcctgacctcaaatgatccacctgcctcagcctcccaaagtgctgggattacaggcgtgagccactgtgcccagcctagaatyactaattctctaacaacagcttcattcatacagccaaggaaacacagtgagtttcctgtgatgacatgcccaccatcatcaaatgctactgagtctaaggtgggaggacgtggtccccatggtgcaattgcaaggctcatgtgagttcagaatttgagcgttagaccacacagctgagaatgtattttgtcagactggctctgccacacagcgatacaactgtggctagtgtttaatagacacttgacctgcactgcctcactcaatactcacaacattcccaggaaggaacgattattt

SEQ ID NO: 59824 - DNA, 601 bp, Human
cacacatgactgtccagtggaaggctcagactgcccaggtcccagggatctctcctctgtctgaggccactacacttactctaagagtgcaggctcggcttggctcatttctaatcatttccttccaccctaagcaacttgagggcaaggcatgtggcttcttccagatgtccatagcttgctggcatgcaggagatactctgtaatgaattattaactctctttttttttttgagacgaagtctcactctgtcaccaagactgaagtggaatggcgtgatcccagctcactgcaacctcygtctcccgggttcaagcaattctcctgccgcagcctacctaattagctgggattacaggcaagcccagctaattttgtatttttagtagagacagggttttaccttgttggccaggctggtctcgaactcctgacctcaaatgatccacctgcctcagcctcccaaagtgctgggattacaggcgtgagccactgtgcccagcctagaatcactaattctctaacaacagcttcattcatacagccaaggaaacacagtgagtttcctgtgatgacatgcccaccatcatcaaatgctac

SEQ ID NO: 59825 - DNA, 601 bp, Human
cttatagggagaaagccccaccctggggaattttcccccactgcaggtcctgcagcaggcgtcacagaccttaaaaaatgcagttcagccttctccaggcccccatcagaagacggaaagcagcactcaccccagctatccacatcaaatgaatacccacaaaaaaaaattataatcatcctaaaaaccacttcccagggctaaccaatatcgctgttttcccagtgcatttatgctgccttaaattggggttaccaatgtaacgcaacacagtgtcctgctcaggaaatgcaatctcctyacacatgactgtccagtggaaggctcagactgcccaggtcccagggatctctcctctgtctgaggccactacacttactctaagagtgcaggctcggcttggctcatttctaatcatttccttccaccctaagcaacttgagggcaaggcatgtggcttcttccagatgtccatagcttgctggcatgcaggagatactctgtaatgaattattaactctctttttttttttgagacgaagtctcactctgtcaccaagactgaagtggaatggcgtgatcccagctcactgcaacctct

SEQ ID NO: 59826 - DNA, 601 bp, Human
cctggtttggataataagggagtggtaggaagaaggcaggcaaatgtaggagactgacggtgtgtacattttatacaattttgaagctagaaaggaaatcagaggtcaaagtggttcaaacattggttttggctgaggcaaccagagctaggggataattaagctccaaagttaagtcctagaagtgggcggggtcaatgcaaatttagtaaatctttaaaaacaacctttgtcccccctgctgggaacaccagcaccgctcaagttttttccggtacagagaggatttctaaaaatcctyataagtcagcgggcataactgaaagaccacagaaccaggtttactgagacatgggtctagcccaacatcctctgtgcttctcagccaatccacctccaacaagactcctcgcctccctgggctctttattccatataatttttcttttttacagtagacaaaagtggtttgtcctttccattttatgttactaaagaggtatgatgcaatgtattggggggaaaaaagctcttatttgctcgaagaaagcaatctgactacagaggccaaatctacagacattaaatgatttaaaccaca

SEQ ID NO: 59827 - DNA, 601 bp, Human
aggtaagaagaacgtgttaaaatatgtttaagagggaaagacagaatttcatagggattatccaaagcatttaaaaaaatctcaatcacctaatatattctgtgtttctaagactagagtgggactacaaaggttaacaatttcttagacgttaaaaaagctttaagaaagaagacctgtctctcttacaatgcacattctctgcaaacaagggtgataaatgggtagatagatctggggatgtcttgaacacaaagcatggaaggctatagtacccaaattttgctgatcatctgtttagtatactgtttattaagcaaactaaaatatttaagggctttcatagctatgtaatcttccccaatccagaaagcctttcaaattcctgaagataataaatttgtcactttgtagaggccaattttctttgatgttctatcaatgcttgcaacagtttactagtaacaattcagtttctccctgtttatatgctgggggttaatagcatgtttttttgtaaatgggataaacggaacagaaaattgtatcttacactctagtacaagcaagtgctacagtaacagtgctttggtatggctga

SEQ ID NO: 59828 - DNA, 601 bp, Human
aaaaacagtgtgtattattaaatatttacttggaaaaagtacacatcagccaccaagtcttataaccatctgtttcccttagagattattgctagattgttgctttgcttcaacctcaagaattttaatttagaaaactcagggataaggttgttcttgagggaaaatgagatacagaaagctgaaggttggtaaaagggtggagagaggcagatgaggtttttttttttggcaaagaaccaatgggagagaagacaggttagtggggagaggtaagaagaacgtgttaaaatatgtttamgagggaaagacagaatttcatagggattatccaaagcatttaaaaaaatctcaatcacctaatatattctgtgtttctaagactagagtgggactacaaaggttaacaatttcttagacgttaaaaaagctttaagaaagaagacctgtctctcttacaatgcacattctctgcaaacaagggtgataaatgggtagatagatctggggatgtcttgaacacaaagcatggaaggctatagtacccaaattttgctgatcatctgtttagtatactgtttattaagcaaactaaaatatt

SEQ ID NO: 59829 - DNA, 601 bp, Human
acaacctcggggctaagtgcttttaaaagacacacaaattacctatcctctgactgaactttcagaaaagtcctaaattaaattcacctacaaaggttatattttatctgtggcagcagatgcagacacacagccacttaaaaatattagaaactgtgagtttattaaaagttacctaagttttgatggttgtcaattgagcacagcaaaataagtcagaaacattttttcccccagtgaaggcagagaaatatctcattttaaatcagtatcagtgctttctatagtcttcccttaagcrctaaacaatgacatcccagaggctgagggcgtctttaacactgcattgactccggtcttcccttgcattatgtcatcaagattccactgtttccttctggcattttgacttttaaaaactagttactggattaatatagggtacacttttttgggtactaatatttgtaattaaaagacttagggtcaatgtatgagagaactccatctacggtccatcaactatatgtaaattatgataattttagaaaattttatgatagtagcatcagtgatagggaattttaatagttttaatatc

SEQ ID NO: 59830 - DNA, 601 bp, Human
gtcacgtggcagagactagtgtctaggattttttcaacatctacaggttagtattttagtttttaatggttacagaacccttagtatttttaacataagtaaataaaaaccgattttcctaagcactctgaattattaacagcggtaaacctaatttcttcccactatatgccaaaagttcaggctcaatttttatttcttgtacttaaacactacaagttgtactgaactttaatatatattggtgcttaggatccaatttttgatgccctaattcttacaaagtatactttggataatragtgagcagctgtttgtcttcctgcacgtggggctttactgccaaaagcaaacttgctaaatggattcatacacgcaagtgacagaaagactgaaatctgatgtacagatcactaccattaccaagggtcttcattttctagtatactttgggagaaaagacgcatttggcttccatgaaataaaaaggcataagggcaacacatttccgtatttaaataagatgtattaaaaacaacaacctcggggctaagtgcttttaaaagacacacaaattacctatcctctgactgaactttca

SEQ ID NO: 59831 - DNA, 601 bp, Human
gcctttaacagtagtatttcacatattaacaattccgacttgatagtgaacacttgaatctgtattaatttctgcctctggaaaggggaaaatattgattcatttgaataactagtcagttttagacagcggcattagatttaagactgttcatggttatattgggggaaggacttggggtagagctgcttcacttttcattttgtaactttcgttactatttgattatgtgaatcatgcatgtgtattttatgggttgctgagtacaaaatttatgggctatttatgaatcaatgtgctytaaagtgatactagagatttttctctttattacttacattgtaaaagcctaattattgggtaaaataaatagaaaagaagaacagtcacgtggcagagactagtgtctaggattttttcaacatctacaggttagtattttagtttttaatggttacagaacccttagtatttttaacataagtaaataaaaaccgattttcctaagcactctgaattattaacagcggtaaacctaatttcttcccactatatgccaaaagttcaggctcaatttttatttcttgtacttaaacactac

SEQ ID NO: 59832 - DNA, 601 bp, Human
ttttcctctagcctagaagcaaatcagaagaattacgtctgatagactttctccaagaataataatcaagagaaatagcaattcataataaacaaagcattttcttagtttttaatgaagaaaactaagaaagtaatttcaaaattattcaatagaaaatctttaaagataaatggactacacactggtagagaaatgagttgttctggctaacacattaatctcttaaacaccaaagtcttcaaacctcttttgatggaaaactgtttaaaatgttatttcaggtcttcggagttgggtrtaggggaaaaaggttatttcatttccttagcaattagaataaatggacctctagagatatcatctatgctgagttttatatgcaaagctgtttgaatatgtatttttctaggaagaaggtaggtcttctaatagcttttaacagaaatttcaaaggtatctatgatccaaagtattaggaagcattgtgtcaatggcatgaagtggttctcaatcagcgcttacaattaaaagcctaagatacaatttgtaactttttgcataaataaatcccagacaacaatgattaaggtgggtgctg

SEQ ID NO: 59833 - DNA, 601 bp, Human
tagttagaacaaaagatgctcctatcactcaggaatttgcgacattcaggagctctgtgttgggaaccaggcaaagagaccaaatatatttactgtcacaagcccttatttctcattatttacaaatgtagtttgtcctcatgacccccttacacacagttccacttcctgccttgggtgaagccaccccctctttatctgaaatggccttatccaactcctatccagccttctctgttcccacatcaagactgtctgtctgccaggcacggtggctcacgcctgtaatcccagcactttrggaggccgaggtgggctgatcacatgaggtcgggagttcgagaccagcctgaccaacatggcaaaaccctgtctctactaaatatacaaaaatcagctaggtgaggtggtgcatgcctgtaatcccagctacttggtaggctgaggcaggaaaattgcttgaacctggtaagcagaggttgtagtgagccaagatcgcgccactgtatgccagcctgggcaacaagagcaaaactctgtttcaaaaaaaaaacaaacaaaaaaacaaataaacaaacaagattgtccttggtttccttga

SEQ ID NO: 59834 - DNA, 601 bp, Human
cagctactcaggaggctgaggcaggagaatggcatcaacccaggaggcggagcttgcagtaagccaagatcgcgccactgcactccagcctgggagacagcgagactccgtctcaaagaaaaaaaaaaaaaaaaaaaggaaaaaattgttttttctcacacatttctgacaccaaatgtgtgggttttccacactaagcagttctccagttctctgcagatacaaactgggtgtcctgcaattcagttatgacactgactaccagggttagcacagaccccacagctcaagggctcagtckcacaagactgttccctacttcagatgccagttccaagtcttgggtgcccagggcacccacacttctgtccaacttggctaccaaccagggggttcccatggccccctcctcaggttcaataatgttataaaggctcacaggactcagggaaacgttacttatgtaaaggatacaaatcaacagcaacatgaagaggtacacagggccatgtctggaatgtccccactgcaggagcttctgttcccctggaatttggagggtaccaccctacccatacatggatgcattcaccaacctgga

SEQ ID NO: 59835 - DNA, 601 bp, Human
tggaatcggaaatgatgctagttaaaatggtgaatataaagttggatttagtaaaaggtaacaataacttgttattaaaaagtttcaaagggataaaggcttgaaacctcagctatccagtttcatataaattatttacaagtctacgtgataatttgagatgggtcttaagagaggcagaggaatcctagggagggggaagtgaggcatggacaggcagagggactgcactattcaagggcatgatggagagaagtacgtgcctggatttccaatttccctaaggataattttacaccasatcttctttattttaaaaatccaatccttttccttaataaccccatctgtccctgataccaccatttttttctaccagtctctcaggctagaaattttgtggttatctttgcctcttctctccttcatcctgtaaatcctacctgttgggaatacattactgtcctttcttcaaaatgttttatctgtcttttctttttcattctctgctattaactataacttcattctcagttccactgctgcctagctttctgtgccctgctagattcatcattattcatccaacaaacataaaagg

SEQ ID NO: 59836 - DNA, 601 bp, Human
aagtacacactttaggctgggcgtggtggctcacgcgtgtaatcccagcactttgggaggctgaggtgggcagatcatttgaggtaggagttcgagaccagcctggccaacatgatgaaaccctgtctctactaaacacacaacaaaattagctgggcgtggtggtgcacacctgtaatcccagctactggggaggctgaggcaggagaatcgcttaaacctgggagaccgaggttgcaatgagtggagattgcaccattgcacttcagcctgggcgacagagagtgagactccgtctccaaaaaaaaaaaaaaaaaccagaaaaattatactttaattgctttagcagcatcaatgtactgttttgtataaagtaggcaaatatcatcttagatttttaatccagtctaaatcttttattttaacctgaataaattttgaagaggtaactaagctttctgggaagcaaatgtttagctgatattagaaaaatataacctattgacacatcaaagaaaaaacggaagaatacttttttcattaaaaatttaaaattataacacatatgtatgtatttctatcaaaatttaaatacaaaaag

SEQ ID NO: 59837 - DNA, 601 bp, Human
attcagtaaccaagagttctaccagaagcacagaaccaccagaaaagcaaaaatgcctcagaacaactcttaatatttataagttaacactcttgccacttactcatcagattatattttttcacttaatattaatgtaccttctaacccacaataatgtagcgtaacttaatttaaaatgaagagaggaaggttagaagcagggaggaactctcaatgaccacccacaagtaatgaccacctgaaatactacgtctcagataaaaattcagacattcagcatgggaaggagcactgcatrtaggagctaagaaaaagtacacactttaggctgggcgtggtggctcacgcgtgtaatcccagcactttgggaggctgaggtgggcagatcatttgaggtaggagttcgagaccagcctggccaacatgatgaaaccctgtctctactaaacacacaacaaaattagctgggcgtggtggtgcacacctgtaatcccagctactggggaggctgaggcaggagaatcgcttaaacctgggagaccgaggttgcaatgagtggagattgcaccattgcacttcagcctgggcgacagagagt

SEQ ID NO: 59838 - DNA, 601 bp, Human
acagagagctgagattgtaccactgcattccagcctgggcaacagtttgagactgtctcaaaaaaattaaaaaaaaaaaaaaaagtaagaatatgactgcaaaaaggaaggtactctacttaactcaatggattgggaaaaattagcacaactggagaatgtgaaggacaaaatgatgtgacatatacctcaaagttctgaaaggcagggaaagcctagcacttttgaatgcctactctcgttcaaatatactcaatttgaagttgttcaaaaaagtcaaataataggaaaatacatacayatacaagaaaatcagaaaatcttaaaatatttaagccaaaatgaagcaagaaggatcttatgtgatctgaatattgtcactttttataaaaccaagcctttcctccttcagcagagaaggctgaaggtgaacaggaccaacagagatcaaacaggggcacagaacagaaactagaaggaggaaggaagagatgttttattccagaaatggaggaaagtaaattatatttttgtatcccaaagtcttagacagttaggcatggtggctcatgcctgtagtcctagcacattgggaggctga

SEQ ID NO: 59839 - DNA, 601 bp, Human
ttaactacattctaagggacacgaagagatttatgtaggggccagatgtggtggctcacgcctataatcccagcactttgggaggccgagctgggcagatcacttgaggtcaggagtttgagaccagcttggccaacatggtgaaaccccatctttactgaaaatacaaaaattagctgggcatggtggcacattcccgtagtcccatactcacaaggctaaggcggaggttacagagagctgagattgtaccactgcattccagcctgggcaacagtttgagactgtctcaaaaaaattaaaaaaaaaaaaaaaagtaagaatatgactgcaaaaaggaaggtactctacttaactcaatggattgggaaaaattagcacaactggagaatgtgaaggacaaaatgatgtgacatatacctcaaagttctgaaaggcagggaaagcctagcacttttgaatgcctactctcgttcaaatatactcaatttgaagttgttcaaaaaagtcaaataataggaaaatacatacatatacaagaaaatcagaaaatcttaaaatatttaagccaaaatgaagcaagaaggatcttatgtgatct

SEQ ID NO: 59840 - DNA, 601 bp, Human
attgagtactgggctacctaaactggtagtctgaaaaacaaaaaattttaaagtgcacccattaataaaatactctgcagcaatacttgagacaaaacaatctccaataagacacaatgtacccacacacagaagaagccagttactcttccttctctgggtttggaaaccaaagataactatcaaaaatatactgtcacctgaaaataagtcttaactacattctaagggacacgaagagatttatgtaggggccagatgtggtggctcacgcctataatcccagcactttgggaggccragctgggcagatcacttgaggtcaggagtttgagaccagcttggccaacatggtgaaaccccatctttactgaaaatacaaaaattagctgggcatggtggcacattcccgtagtcccatactcacaaggctaaggcggaggttacagagagctgagattgtaccactgcattccagcctgggcaacagtttgagactgtctcaaaaaaattaaaaaaaaaaaaaaaagtaagaatatgactgcaaaaaggaaggtactctacttaactcaatggattgggaaaaattagcacaactgga

SEQ ID NO: 59841 - DNA, 601 bp, Human
atataggtttaaactgcttgaaaattaaagggtacatgacaaatacttacatatcataaaaagaatattcagattgtgcacaaagaaaatataaacacagataatagtaagatacaaaaacatcaagcaaacaaagattaatatcttcagaaatgttgtatgtttggcaaaagctcctataacaaatagtaggaggccgggcacagtggctcctatctgtaataccagcagtttgggagtccgagatgggtggatcacctgatgtcaggagttcaagcccagcctgaccaacatggcaaarccccatctccagtaaaaatacaaaaatcagctgggtgtggtggcacatgcctgtaatctcagctacttgggaggctgagacaagagaattgcttgaacccaggaggcggacgagatcgcaccactgcactctagtctgggcaacagagtgagactccgtctcaaaaaaaaaaaaaaatttttagatgttcccactttataccaaaaactatgtggctacacataccaataaagcccttttttgctagctccatggtgaacctccttgtgatcttttccaattcattatcctgtaaaataa

SEQ ID NO: 59842 - DNA, 601 bp, Human
ttaggtacttgtcaagtctgataaaattaagctggagatattgcagatatgggtgataaatatgactgaataaagtctgaaaccattcaagactataaaatgtgtttgagatttaggggaagaggaaagaccttttaaaaattatgaaggctattaacaggctgaagatgacttcaattcaccatatctcagaatcagtaggcactcctataaaagtgtgagcgagatagttaactcatattaacttacgttaacagactccatgtaaggatgcacaagttcacagtagtgctgggtatgyggcacatcaaaggcccaaatgccttttattatcaaagacaggccaaatctagtcaagttttagagttacctatacttactgtatttctatattaggttatttcatgacatttatttcatgacttttttttcctaaaaatgaatccgaatagctttatttcatttctctttcttcttgagatgtggtctcgttttgttgctcaggccagagtgtggcaggccagagtgcagtggcacaatcatagctcactgcagcctcaaccccccaggcttaagggatcctcccatcttagtagttggg

SEQ ID NO: 59843 - DNA, 601 bp, Human
atcccagcctctttttttcttttgttttgcagaaatttacaagctgatgctaaacacacatgtgacaggatcagggttcaggctcaggtctgagcctcaatctgacactctctgtggaatgggcagtcaggaaataacagataaataacatcaaatttgaaggtttgccgaggagtgagagaaaaaactccctttgcctacctcctaggcttcaaagctttctgggccaagacgtcaatttaactgcatcctgggtcaatgaggcttttgcacattaagcaaataaatcaaattactagartttaagctgtgttttctttcagtattccaatgaatcactttttgacctttggaattattaggtacttgtcaagtctgataaaattaagctggagatattgcagatatgggtgataaatatgactgaataaagtctgaaaccattcaagactataaaatgtgtttgagatttaggggaagaggaaagaccttttaaaaattatgaaggctattaacaggctgaagatgacttcaattcaccatatctcagaatcagtaggcactcctataaaagtgtgagcgagatagttaactcatatta

SEQ ID NO: 59844 - DNA, 601 bp, Human
tgaggtgagaggattgcttgagcccaggaggtcaaggttgcagtgactgctgtctggtactccagcctgggtgaaaggacaaaacctttttggggagggtggggaagatggcaatactccacaaattagtgtacagattcaatgaaattcctataaaaatcccagcctctttttttcttttgttttgcagaaatttacaagctgatgctaaacacacatgtgacaggatcagggttcaggctcaggtctgagcctcaatctgacactctctgtggaatgggcagtcaggaaataacagatwaataacatcaaatttgaaggtttgccgaggagtgagagaaaaaactccctttgcctacctcctaggcttcaaagctttctgggccaagacgtcaatttaactgcatcctgggtcaatgaggcttttgcacattaagcaaataaatcaaattactagagtttaagctgtgttttctttcagtattccaatgaatcactttttgacctttggaattattaggtacttgtcaagtctgataaaattaagctggagatattgcagatatgggtgataaatatgactgaataaagtctgaaacca

SEQ ID NO: 59845 - DNA, 601 bp, Human
ttggaaggcttaatatggttaagatggcaatactggtcaggtgcagtggctcatgcctataatcccagaattttgggaagctgaggtgggaagactgcttgagctcaggagtttgagaccagtctgggatacgtgatgagaccgtgtctccacaaaaaattaaaaaattagctaggcacagttgcacacccctgtggttctagctacttgggagggtgaggtgagaggattgcttgagcccaggaggtcaaggttgcagtgactgctgtctggtactccagcctgggtgaaaggacaaaayctttttggggagggtggggaagatggcaatactccacaaattagtgtacagattcaatgaaattcctataaaaatcccagcctctttttttcttttgttttgcagaaatttacaagctgatgctaaacacacatgtgacaggatcagggttcaggctcaggtctgagcctcaatctgacactctctgtggaatgggcagtcaggaaataacagataaataacatcaaatttgaaggtttgccgaggagtgagagaaaaaactccctttgcctacctcctaggcttcaaagctttctgggc

SEQ ID NO: 59846 - DNA, 601 bp, Human
agcacccttcccttagtcaccttaaaaatctcatgaagtcaatgacaacaacaacaacaacaacaacaaaatcttgtgaagtctaatccccactgcacttggaaagattaatgccatattctagcctcatccactgacaaaagggctctctggcgctctccagctcctatttgctcactttccattcctttagtgacatacctctgctggaggtcagcacaactttgtttaaccactccttttctcccaatgtacaaatgacaaattggtcctgaatctttctagaggtaactacaaaagkattatgcttgctttaggattaaataagcttgttacctcaaacaacaattccaactaggccggggcagtggcttatgcctgtaatcccagcactttgggaggccgaggcaggaggatggcttgagtccaggaatttgagacaagcctgggcaacatagtgagatcctgtcttgattaaacaatacatttaaaaaacaaaaaaccggctgggcgcggtggctcacgcctgtaatcccagcactttgggaggccgaggtgggctgatcacgaggtcaagagagagagaccatcctggccaacg

SEQ ID NO: 59847 - DNA, 601 bp, Human
agtttataactttctatattatttcaactgtaaaatacaaactcgtttttacaaaacgaaaaacgcaacttaaaaaatggttaaactattaggctgagcacagtggcgcatgcctgtaatcccagcaccttgggaggctgaggagggcggatcacgaggtcaggagtttgagaccagcctgaccaacatggtgaaaccctgcctttactaaaaatacaaaaattagccgggcgtggtggcacatgtctgtaatcccagctactccggaggctgaggcaggagaatcgcttgaatggaggtsgggggtgttgcagtgagccaagatcgcgccagtgcactctagcctgggcgacagagtaagactctgtttcaaaaaaaaaaaaaaaaaaagttaaactattaaactattatgtctccccataaaataattaaagttctttctaagggctgtacccaattattcctataaattttactttttagtcaacagaatcagtatattgtaatgtttttctataactcaggggcccaaggcctaaataataaacttttttgaacaagctgtgatgtaatggatacagggctagtataagataacttt

SEQ ID NO: 59848 - DNA, 601 bp, Human
aaaaggcaggtttcatacagcatgtataacatgttcccacttataatttttttctcttccctgccatatatatagtttataactttctatattatttcaactgtaaaatacaaactcgtttttacaaaacgaaaaacgcaacttaaaaaatggttaaactattaggctgagcacagtggcgcatgcctgtaatcccagcaccttgggaggctgaggagggcggatcacgaggtcaggagtttgagaccagcctgaccaacatggtgaaaccctgcctttactaaaaatacaaaaattagcygggcgtggtggcacatgtctgtaatcccagctactccggaggctgaggcaggagaatcgcttgaatggaggtggggggtgttgcagtgagccaagatcgcgccagtgcactctagcctgggcgacagagtaagactctgtttcaaaaaaaaaaaaaaaaaaagttaaactattaaactattatgtctccccataaaataattaaagttctttctaagggctgtacccaattattcctataaattttactttttagtcaacagaatcagtatattgtaatgtttttctataactcaggggc

SEQ ID NO: 59849 - DNA, 601 bp, Human
tataaggttttaggccttagctttcagttcctcagatcataggaaattaaaggtttaggctaataaattagcttacaggcaataacaggaatcactgactatactactactgacggctacagtaagatctctgataaaaacatgttaagtgatgctcactcaaatctgtaaaggtgcagaaatactcctctcaaacacagtaaaaataaaaacaacctaattatcttgtatgccaattaaatgaaatatggtatacctatgcaaagtactaaacagccattaaaaagggtaacttatatcyatgtaaattacttggaattatcatgaacatacatatggaaaaaggcaggtttcatacagcatgtataacatgttcccacttataatttttttctcttccctgccatatatatagtttataactttctatattatttcaactgtaaaatacaaactcgtttttacaaaacgaaaaacgcaacttaaaaaatggttaaactattaggctgagcacagtggcgcatgcctgtaatcccagcaccttgggaggctgaggagggcggatcacgaggtcaggagtttgagaccagcctgaccaaca

SEQ ID NO: 59850 - DNA, 601 bp, Human
ccgctcacctgtgctcatgtctggagcaggcacatcaatgccaggacctgcgggggcacagggaaagaggagtgcaccagtttttaagaaaaattcttctcgaacacaaagatccttgtaagtctctgtaataaccaagttaccatggctagaaaactttagatctcatttaggtagctaatcaaagtcatagaaatattcattaaatgtttcactataaaatgcagacacatacaacattacataataatttctccctctggcatttacttgctgtatgtttggaagttagctatgcacracagatataagccactccataggatttctgagtgtgcgaccagaggttaatcagtttagcctctcttgacctcatttcactaacatgcaattagagataacagtaccattgtgttctatataagcaggattattatggttagggagttgacatgtatgagatagcagagtaacatgctgcttagtgggggtataagccctccttatcaagtagagaaaaaggggagaaggtcatattgctaaagcaattgtgttaagccccatattatttttacttgtggaagaatgtggctgtgaccta

SEQ ID NO: 59851 - DNA, 601 bp, Human
taatcagtcaaactgttaattcttgtagacagcaaatgcagaagcctcggggcttccagtgggtactcacatagtgccctatggtgctggcataggtatcagcgatccaggacatctcccgctcacctgtgctcatgtctggagcaggcacatcaatgccaggacctgcgggggcacagggaaagaggagtgcaccagtttttaagaaaaattcttctcgaacacaaagatccttgtaagtctctgtaataaccaagttaccatggctagaaaactttagatctcatttaggtagctaatyaaagtcatagaaatattcattaaatgtttcactataaaatgcagacacatacaacattacataataatttctccctctggcatttacttgctgtatgtttggaagttagctatgcacaacagatataagccactccataggatttctgagtgtgcgaccagaggttaatcagtttagcctctcttgacctcatttcactaacatgcaattagagataacagtaccattgtgttctatataagcaggattattatggttagggagttgacatgtatgagatagcagagtaacatgctgctt

SEQ ID NO: 59852 - DNA, 601 bp, Human
agcgtgcctcccaggtagctgggattataggtgtataccaccacgcttggctaatttttgtattttttggaaagacagggtttccccatgttgtccaggctggtctcgaactcctgggctcaagtgatccacctgccttggccacccaaagtgctgggattatgggaatgagccactgcatccagccctcactcttactttctattacctttataaatatgccttaccttcagacaaactgaacgctattgtttctcttcctcttatcctccaaatctctaaatgttcatattctacccaytttcaaggtctagcccaaatatctcctctagaaagtcttatttcagaattcataatctccactgttgtattacattatttccataccttatctgcttatgcaccttagttcctctttaaatggaagccctctgagggaaaaatcagaattggatgcttcttgatgtacgttctagtgtcttagcacagtgggctgccctggtcctgttccagtgacaagtatagggcagcatataagtaaagctcaatctgtgttcattacgatttaagaatagacaagtagacataaaataatatgcac

SEQ ID NO: 59853 - DNA, 601 bp, Human
tggggcttggtgtttttgtcctggttcatttacctcttcattcttactttttttttgttttgagacagggtctcactctactgcccaggctggagtgctgtggtgcaaccacagctcactgcagcctcaacctcctgggctcaagcgtgcctcccaggtagctgggattataggtgtataccaccacgcttggctaatttttgtattttttggaaagacagggtttccccatgttgtccaggctggtctcgaactcctgggctcaagtgatccacctgccttggccacccaaagtgctggrattatgggaatgagccactgcatccagccctcactcttactttctattacctttataaatatgccttaccttcagacaaactgaacgctattgtttctcttcctcttatcctccaaatctctaaatgttcatattctacccattttcaaggtctagcccaaatatctcctctagaaagtcttatttcagaattcataatctccactgttgtattacattatttccataccttatctgcttatgcaccttagttcctctttaaatggaagccctctgagggaaaaatcagaattggatgct

SEQ ID NO: 59854 - DNA, 601 bp, Human
ctggtcctctggctcctggacttggtggaaaggcactgacaccataggaggttctctcctggcgccagcacagctggacactgctgccagcctattcttccccaggaaggatcagcaaaatttctccactgactaccatgtaaaacacaaacactggggcttggtgtttttgtcctggttcatttacctcttcattcttactttttttttgttttgagacagggtctcactctactgcccaggctggagtgctgtggtgcaaccacagctcactgcagcctcaacctcctgggctcaagcrtgcctcccaggtagctgggattataggtgtataccaccacgcttggctaatttttgtattttttggaaagacagggtttccccatgttgtccaggctggtctcgaactcctgggctcaagtgatccacctgccttggccacccaaagtgctgggattatgggaatgagccactgcatccagccctcactcttactttctattacctttataaatatgccttaccttcagacaaactgaacgctattgtttctcttcctcttatcctccaaatctctaaatgttcatattctacccatttt

SEQ ID NO: 59855 - DNA, 601 bp, Human
acatatatccaatccagttttgctgagtctctctgtcatgtgcctcacatgtgcaatgctcctctcctggtcctctggctcctggacttggtggaaaggcactgacaccataggaggttctctcctggcgccagcacagctggacactgctgccagcctattcttccccaggaaggatcagcaaaatttctccactgactaccatgtaaaacacaaacactggggcttggtgtttttgtcctggttcatttacctcttcattcttactttttttttgttttgagacagggtctcactctaytgcccaggctggagtgctgtggtgcaaccacagctcactgcagcctcaacctcctgggctcaagcgtgcctcccaggtagctgggattataggtgtataccaccacgcttggctaatttttgtattttttggaaagacagggtttccccatgttgtccaggctggtctcgaactcctgggctcaagtgatccacctgccttggccacccaaagtgctgggattatgggaatgagccactgcatccagccctcactcttactttctattacctttataaatatgccttaccttcagacaaa

SEQ ID NO: 59856 - DNA, 601 bp, Human
atgcgtccatggattcccccttggctgatgggtttaccagtaacacaggcgtgtgcattaatatcctgtaagagggggtaattgaaagaatgaaatgtcaagtccaatttctctgttgaaggaacataatgaattaaagtcaaagcacattctcatttaatcaaaaatatgctaattaggagtgtgtgtatgaatgtatttaaggtatacttttaccaatagagacaagactcactttttcagctttctgttcctagaaaatacaataaaatatactatattttctgtttttttttttttgtttgtttgtttgtttttgagacggagtttcactcttgttgctcaggctggagtgcaatggtgagatcttggctcatcgcaacctccacctcccaggttcaagcgattctcctgcctcagcctcctgagtagctggtattccaggcacgtgccaccacgcccggctaattttgtgtttttagtagagatggggtttctccatgttggtcaggctggtctcaaactcctgacctcaagtgatctccctgccttggcctcccaaagtgctagaattacaagcgtgagccaccacgcccggcaa

SEQ ID NO: 59857 - DNA, 601 bp, Human
agagatgcgtccatggattcccccttggctgatgggtttaccagtaacacaggcgtgtgcattaatatcctgtaagagggggtaattgaaagaatgaaatgtcaagtccaatttctctgttgaaggaacataatgaattaaagtcaaagcacattctcatttaatcaaaaatatgctaattaggagtgtgtgtatgaatgtatttaaggtatacttttaccaatagagacaagactcactttttcagctttctgttcctagaaaatacaataaaatatactatattttctgtttttttttgtttgtttgtttgtttgtttttgagacggagtttcactcttgttgctcaggctggagtgcaatggtgagatcttggctcatcgcaacctccacctcccaggttcaagcgattctcctgcctcagcctcctgagtagctggtattccaggcacgtgccaccacgcccggctaattttgtgtttttagtagagatggggtttctccatgttggtcaggctggtctcaaactcctgacctcaagtgatctccctgccttggcctcccaaagtgctagaattacaagcgtgagccaccacgcccg

SEQ ID NO: 59858 - DNA, 601 bp, Human
ctcattctctcacacaggctggagtgcaatggcacaattttggctcactgcagcctctgcctcccgggttcaagtgagtctcctgccttagtctcctgagtagttgggattacaggtgccgccatcatgcccagctaatttttctttctttttttttgagacagagtctggctctgtcacccaggctggagtgcagtggcgcaatctcggctcactgcaagctccacctcccgggttcaagtgattctcctgcgtcagcctccagagtagctgggactacaggcgtgtaccaccacacccygctaattttcctatttttagcggagaccgggtttcaccatgttggccaggatggtcttgatctcttgacctcgtgatctgcccaccttggcctcccaaagtgatgggattacaggcgtgagccaccacgcccggcttaatttttctacttttagtagagacagggtttcaccatgttggccaggctggtctcgaactcctggcctcaagtgatccacccgtcttggcctcccaaagtgctgggaatacaggcatgagccactgtgtccagccaccacttctattttcaagtaatttcaac

SEQ ID NO: 59859 - DNA, 601 bp, Human
caggcggatcatgaggtcaggagatcaaggctatcctggccaacatggtgaaaccccgtctctattaaaaatacaaaaattagccgggcgtggcggtgagtgcctgtagccccagctacttgggagggtgaggcaggagaattgcttgaacctgggaggcggaggctacagtaagccgagttcgtgccactgcactccagcctcggcgacggagcgagactccctctcaaaaaaagaaaaaaaaaatgtagattatattctgtgaatattacatcacagaataaaactctggatataatayatgggagagttaatatccagaaagacattgtgcatttttggtctaagtttcatgagacaaaatattattttcttttctgagactcaattctttcccaaagggatcagttctcttaagtggacctttttacagcctttcagctggctcaaaagatgagttttggcgaacaagattatcgatactcactgagcaagtggtagttagaatccctttcatatttgaaggtcaaacggccatagctgacatgatttagattcttcagccactcaaagtaagatactgtcactcctccagcattca

SEQ ID NO: 59860 - DNA, 601 bp, Human
tcacccagattctcacagtgggctgagtacagaagctcagtaggaggtcttggtcttatttcaactagatgagaaattctactcttaactgtggagcttactctagtcaaagaaaaacaagtattctcatcaggagtctcaaaaacaattcttgacactagataggcctttactaagagcaaccagagacagaaattagtatcgacagtggagttttaaaatcacacttaaaaaaatattattggctgggcacagtggctcacgcctgtaatcccagcactttgggaggctgaggcaggcrgatcatgaggtcaggagatcaaggctatcctggccaacatggtgaaaccccgtctctattaaaaatacaaaaattagccgggcgtggcggtgagtgcctgtagccccagctacttgggagggtgaggcaggagaattgcttgaacctgggaggcggaggctacagtaagccgagttcgtgccactgcactccagcctcggcgacggagcgagactccctctcaaaaaaagaaaaaaaaaatgtagattatattctgtgaatattacatcacagaataaaactctggatataatacatggg

SEQ ID NO: 59861 - DNA, 601 bp, Human
atgaaaaggaaaggtacaaaacacacatgtcacgcacttactgtcaagctaattacaaagactatgccgcagatgaaatccatctaaccagctctgtctgaaggaaagagcagggagcatgtgtgaagtacaactgtggggtcaccacactcaccgatatcctgtcttggaactctgccgtgggtacaatgggaatagttccaccatgctttccaaattttctttctaaactctcttgaacagacactacaaaaaaataacaagagatcaagatattgctaacagaaaaaaaaaaaaaaaagtagaatcaaaagtagtcccaaactataactgtaacccaaaaacttatacagacagagtcgtggtctgtcacccaggctggagtgtagaggcgtgatctcagctcactgcaaactctgcctcccgggttcacgccattctcctgcctcagccttgcgagtagctgggactacaggtgcgcgccaccacgcccagctaattttttgtatttttagtagagacggggtttcaccgtgttagccaggatggtctcgacctcctgacctcgtgattcatctgccttggcctcccaaagtgctgg

SEQ ID NO: 59862 - DNA, 601 bp, Human
tcgatgacttgacttcgtgatccacccgccttgacctcccaaagtgctgggattacaggcgtgtgccaccatgcctggcctcttgtttctttctttatttttgtagagatggggactcactatgttccccaggttggtctcaaactcttggactcccatatagttcaatctaatgcttgcttttcaattcttcctatttctctgaagcttaaaataattaaaatacataataatccttcactgttaaaacacgtgcgtgaaaaataccaaatttatttattttatatttgttagtagtcastaggattcttactccagttttagaatgtaatgaaaaggaaaggtacaaaacacacatgtcacgcacttactgtcaagctaattacaaagactatgccgcagatgaaatccatctaaccagctctgtctgaaggaaagagcagggagcatgtgtgaagtacaactgtggggtcaccacactcaccgatatcctgtcttggaactctgccgtgggtacaatgggaatagttccaccatgctttccaaattttctttctaaactctcttgaacagacactacaaaaaaataacaagagatcaa

SEQ ID NO: 59863 - DNA, 601 bp, Human
gctgatctattcgaagagagatgacacaggactgggtacaggtaccaggagctgggtagatgcggaagctcccaggctgcatcagttttatctgtgaacagatagcaggtcatgagctggaatgcagggcagtgagaagaggagaaaatgtgatgtaatcactcaggagacggggagaatgaatgaaacacggaaaagcagtatgactgctgggcagctctgagcgcctacttgaggttagtggtcagggtgtgaactgccagcagggcctcctacagggtagaggcacgggatttaatcagggatttaatcagggctgctgggatttaatcagggcttaggtgttaacaaaggagtatgacaaaggaaacaagactggggagtgactgtaatgatggagcacggaatttaagttagataaggagggaagtgagggcactggggggatgagggacagtggaaacatggcagggtcatgatgtgggtcctgatagtgccaaacaggggcagggggaaactagagggagagagcttgagaaaacttttatttttttaactgacaaggcatatgctgggcagtggggtgaccaaagggaggggt

SEQ ID NO: 59864 - DNA, 601 bp, Human
actggatttggcaatgctggtgtcactggctgtcttgacaagaatagtcttggtggagtaggttcaagtaaagaagaattggaggctgagtatatacaactcttccaaggaggtttgctctacaggaaacaaatggcaatactggaaggggaagtgggattaagatttatacattttttaaaacagcatttggtaagctgaggggaatgactcagagggaaactgctgatgtaggagagaggagcagacttgctagagcagtgtatctgaggaaaaaccatccaatgcccacaacaagaamtggacctaagaaatgaaagcacaaagagctgatctattcgaagagagatgacacaggactgggtacaggtaccaggagctgggtagatgcggaagctcccaggctgcatcagttttatctgtgaacagatagcaggtcatgagctggaatgcagggcagtgagaagaggagaaaatgtgatgtaatcactcaggagacggggagaatgaatgaaacacggaaaagcagtatgactgctgggcagctctgagcgcctacttgaggttagtggtcagggtgtgaactgccagcagggcctcc

SEQ ID NO: 59865 - DNA, 601 bp, Human
aacttttaaagctgtgtagatctcagcagcgttttaattttactgatgaggaaactaaggaccagagaagatggccaaggttacagatagctattttcagagctgggatatgactcagggcctccaccatcaagtcagtttctctctttcctaatttgtttcttggaatgctttctaaaaaattaaggacaattaactcactaccactcttaaggtgacatacagagctacaaaacacatatgcccgataaaaacttaaaatgggtcactgatatagtttggacacttactgagtacatamtcttccaggtactaggggacatagtagagaataaaatcaaaattctgttctcacagactttatattgtagtgggaagagagtgtatatacatggacttcaaaccacaaggctaagtggatcattgaagttttcaatctagatagagaagtggtttagggacgcaggccttccaatgttaggagagtgaagagttgaagagataccagcaagaggcaattgagaagaaatgtttagtgaggtagggagaaaaccaggagaatgtggtatcctggaagctaagagaagaaaatgtttcaagg

SEQ ID NO: 59866 - DNA, 601 bp, Human
gacgcagatgcactgagcaatgtgttacactgttcatgccacggtgcgttcgcctcagctccccagagaacagggacaccacacagaacacagaaaggaatctgattaaaccccatagcggctttggggtagaattctgtgtatctattcagtagtgccagcaacttttaaagctgtgtagatctcagcagcgttttaattttactgatgaggaaactaaggaccagagaagatggccaaggttacagatagctattttcagagctgggatatgactcagggcctccaccatcaagtcagtttctctctttcctaatttgtttcttggaatgctttctaaaaaattaaggacaattaactcactaccactcttaaggtgacatacagagctacaaaacacatatgcccgataaaaacttaaaatgggtcactgatatagtttggacacttactgagtacatactcttccaggtactaggggacatagtagagaataaaatcaaaattctgttctcacagactttatattgtagtgggaagagagtgtatatacatggacttcaaaccacaaggctaagtggatcattgaagttttcaatct

SEQ ID NO: 59867 - DNA, 601 bp, Human; identical to SEQ ID NO: 59826

SEQ ID NO: 59868 - DNA, 601 bp, Human; identical to SEQ ID NO: 59827

SEQ ID NO: 59869 - DNA, 601 bp, Human; identical to SEQ ID NO: 59828

SEQ ID NO: 59870 - DNA, 601 bp, Human; identical to SEQ ID NO: 59829

SEQ ID NO: 59871 - DNA, 601 bp, Human; identical to SEQ ID NO: 59830

SEQ ID NO: 59872 - DNA, 601 bp, Human; identical to SEQ ID NO: 59831

SEQ ID NO: 59873 - DNA, 601 bp, Human; identical to SEQ ID NO: 59832

SEQ ID NO: 59874 - DNA, 601 bp, Human; identical to SEQ ID NO: 59833

SEQ ID NO: 59875 - DNA, 601 bp, Human; identical to SEQ ID NO: 59834

SEQ ID NO: 59876 - DNA, 601 bp, Human; identical to SEQ ID NO: 59835

SEQ ID NO: 59877 - DNA, 601 bp, Human; identical to SEQ ID NO: 59836

SEQ ID NO: 59878 - DNA, 601 bp, Human; identical to SEQ ID NO: 59837

SEQ ID NO: 59879 - DNA, 601 bp, Human; identical to SEQ ID NO: 59838

SEQ ID NO: 59880 - DNA, 601 bp, Human; identical to SEQ ID NO: 59839

SEQ ID NO: 59881 - DNA, 601 bp, Human; identical to SEQ ID NO: 59840

SEQ ID NO: 59882 - DNA, 601 bp, Human; identical to SEQ ID NO: 59841

SEQ ID NO: 59883 - DNA, 601 bp, Human; identical to SEQ ID NO: 59842

SEQ ID NO: 59884 - DNA, 601 bp, Human; identical to SEQ ID NO: 59843

SEQ ID NO: 59885 - DNA, 601 bp, Human; identical to SEQ ID NO: 59844

SEQ ID NO: 59886 - DNA, 601 bp, Human; identical to SEQ ID NO: 59845

SEQ ID NO: 59887 - DNA, 601 bp, Human; identical to SEQ ID NO: 59846

SEQ ID NO: 59888 - DNA, 601 bp, Human; identical to SEQ ID NO: 59847

SEQ ID NO: 59889 - DNA, 601 bp, Human; identical to SEQ ID NO: 59848

SEQ ID NO: 59890 - DNA, 601 bp, Human; identical to SEQ ID NO: 59849

SEQ ID NO: 59891 - DNA, 601 bp, Human; identical to SEQ ID NO: 59850

SEQ ID NO: 59892 - DNA, 601 bp, Human; identical to SEQ ID NO: 59851

SEQ ID NO: 59893 - DNA, 601 bp, Human; identical to SEQ ID NO: 59852

SEQ ID NO: 59894 - DNA, 601 bp, Human; identical to SEQ ID NO: 59853

SEQ ID NO: 59895 - DNA, 601 bp, Human; identical to SEQ ID NO: 59854

SEQ ID NO: 59896 - DNA, 601 bp, Human; identical to SEQ ID NO: 59855

SEQ ID NO: 59897 - DNA, 601 bp, Human; identical to SEQ ID NO: 59856

SEQ ID NO: 59898 - DNA, 601 bp, Human; identical to SEQ ID NO: 59857

SEQ ID NO: 59899 - DNA, 601 bp, Human; identical to SEQ ID NO: 59858

SEQ ID NO: 59900 - DNA, 601 bp, Human; identical to SEQ ID NO: 59859

SEQ ID NO: 59901 - DNA, 601 bp, Human; identical to SEQ ID NO: 59860

SEQ ID NO: 59902 - DNA, 601 bp, Human; identical to SEQ ID NO: 59861

SEQ ID NO: 59903 - DNA, 601 bp, Human; identical to SEQ ID NO: 59862

SEQ ID NO: 59904 - DNA, 601 bp, Human; identical to SEQ ID NO: 59863

SEQ ID NO: 59905 - DNA, 601 bp, Human; identical to SEQ ID NO: 59864

SEQ ID NO: 59906 - DNA, 601 bp, Human; identical to SEQ ID NO: 59865

SEQ ID NO: 59907 - DNA, 601 bp, Human; identical to SEQ ID NO: 59866

SEQ ID NO: 59908 - DNA, 601 bp, Human
caatcctcccacctcagcctcccaaagtgctgggattataggtatgaactatcacaccaggctgagaacttataaatgtaaaagtgaatttcaaaacatgagcttctctgacagattagttctaaactaaagttcaacgttacttgtcatgagccctataaactgtcacatttaagaccttagctttgaactggatctcttccctctaatttcgtcagagaaacccttattcaacaaacactgagcggcacttactctgtgccagaccctgggttagccactggcacacataataaagctwatacttcttcggcctggacatgtagtagaatatttcaggaaagaaaaaaccatgagggacacatgtaatagttcttacagttgaacaattttactctgccactattctaccagaatatttggtgagtaaactcttgtgtttagaatgtgatcttcctagagtgggttatggaactcatatctctgaggcagggtctatgatagaattcaggaagtctgtgaatttggatgaaaaagactgtatctttattttcacttcagtgatgaacataagctacagcagtaatagcagacttattag

SEQ ID NO: 59909 - DNA, 601 bp, Human
actcacaaagacctggtttggtttctgctgactcacctaccagtacacactgcttgccttgttcctccacgttccaacacatgcctgctgaggcacatcagctttgctagacaagtggaagatgtgtttgtggagggaggggtggcactgaggagacactaaggatacagctagtcatatttttccaatgtgaatgtcctgaaggagacagaatctaggtgctggcatgtctatgcttgagtctgaaagatgataggctcctacaagtagttttagggactcctatccagtcctttctttytttttttttttttttttttttgagacagagtttcactcctgttgcccaggctggagtacaatggcacgatctcagctcaccacaacctccacctcccgggttcaagcaattctcctgcctcagcctcccgagtagctgggattacaggcatgcaccaccacgcctggctaattttgtatttttagtagagatggggtttctccatgttgaggctggtcttgaactcctgacctcaggtgatctgcccgcctcagtctcccaaagtgctgggattacaggcgtgagccaccgcacccggcc

SEQ ID NO: 59910 - DNA, 601 bp, Human
cccaggatgcagaggttgcagtgagccaagatcgttccactgtactcccgcctgggtgacagagcaagacctcatctcaaaaaaaaaaaaaaaaaaaaagctaggccaggtgtggtggctcacacttgtaatcccaacactttgagaggccaaggcgggaggatcacctgaggtcaggagttcgagaccagcctggccaacatggtgaagcccggtctctactaaaactacaaaaataagctgggcgtggtggcaggtgcctgtaatcccagctacccaggagactgaggcaggagaatcrtttgaacccaagagacggaggctgcagtgagccatgatcataccactgcactccaacctgggtgacaagagtgaaactctatcaaaaaaaaaaaaaaaaagggctgacagccagaatacagcaattgttaagacctgatctttccaactgctgcctattcactccctagataagtcaccttatcttaatcactgaaatttgagcacagactctaaatatggacataaaaacccatcccccaacaccctgcctgctaagtacattagtgtctccaaagtgccctcgaaatacagaatgcag

SEQ ID NO: 59911 - DNA, 601 bp, Human
acaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacagraagaaaagtatttggagatagaatagagaacctccctcaagagccctactaggatgggccaacacttcctgtttgtttagtggttcatcctccagaacactttctttgtcaaaaaggctataacagcccagtacagtggctcatgcctataatcccagcactttgggagaccaaggcggatggattgcttgagcccaggagttcaagaccagcctggccaacatggcgaaaccccatctctactaaaaagacaaataattagccaggagtggtggcacatgcttgtagtcccagctactt

SEQ ID NO: 59912 - DNA, 601 bp, Human
atgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagygatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctccctcaagagccctactaggatgggccaacacttcctgtttgtttagtggtt

SEQ ID NO: 59913 - DNA, 601 bp, Human
atgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgygcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctccctcaagagcc

SEQ ID NO: 59914 - DNA, 601 bp, Human
ttttgctcaggcccgccgggctcgttccgtccactcagcctggtaggctatgctcagcttgtgttaccagcacagattccatgcatgccaaggacaagccaggcacggagcggcaagaggtgcacaggcgagccagcacagggtccggccactgcgcacagccaggcacgccagctgccagggggtgagcagctcgaggcgccagctccctgagaggctgcagctgaaccaggcgtactacaagcagcttccactgcaggcactggggaacatggtgctgcccagaagcttggagaggccrggaaccacagagctccaaagagggtgtcacagccctggctcaaggagctcctaggtctgggcttcccaaagggctacagctcttctctttctctctcctctcttctctctttctgttgcccacagcgtggcaagcagtgggggaggggaggacgtgtttcggctctgtttgtgtttcagctctttcagtcccaccatttggcagatcccgagttcttgtcccacgtccaggaagaatgaggtatatggacaactggaggacgagcaaggtgaagaggtgctttattgagcaacacaacag

SEQ ID NO: 59915 - DNA, 601 bp, Human
cagcaaagttctgaatattctgtatttcatgtttaagtcacagaatacttggggtgtcacttcgctagccagaaacctctgtggccagtggcacctttgcctgagttttgctcaggcccgccgggctcgttccgtccactcagcctggtaggctatgctcagcttgtgttaccagcacagattccatgcatgccaaggacaagccaggcacggagcggcaagaggtgcacaggcgagccagcacagggtccggccactgcgcacagccaggcacgccagctgccagggggtgagcagctcraggcgccagctccctgagaggctgcagctgaaccaggcgtactacaagcagcttccactgcaggcactggggaacatggtgctgcccagaagcttggagaggccaggaaccacagagctccaaagagggtgtcacagccctggctcaaggagctcctaggtctgggcttcccaaagggctacagctcttctctttctctctcctctcttctctctttctgttgcccacagcgtggcaagcagtgggggaggggaggacgtgtttcggctctgtttgtgtttcagctctttcagtcccacc

SEQ ID NO: 59916 - DNA, 601 bp, Human
aatcctcccatctgagcctccagaatagctaggaccagcataatgtattttttaaatgtccttctccttctttcctttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactcygtcaccctggctagagtgcagtggcaccatctcggctcactacaacctccgcctcccaggttcaagcgattctcctgcctcagcctcctgagtaggtgggattacaggcacccaccaccacgcctggctaattttttgtatttttagtagagacagggtttccctatgttggccaggctggtctcgaacacctgacctcgtgatccacctgcctcgtcctccaaaagtgctgaaattacaggcgtgagccatggcgcctagccaatttttgtatttttagtagagacagggttttgtcat

SEQ ID NO: 59917 - DNA, 601 bp, Human
aaagttctatagatttcagtgaccacttcaccagagttacttgcatgaaaattgtggagtagcataatggtttttatttacttttttattgtttttatttttttaggggtcttgctaggttgtccaggctggagcgcagtggctactcacagccataatcatagcacactgtagcctcaaactcctgagcttaagcaatcctcccatctgagcctccagaatagctaggaccagcataatgtattttttaaatgtccttctccttctttcctttttttttttttgagaaagagtctcactstgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactccgtcaccctggctagagtgcagtggcaccatctcggctcactacaacctccgcctcccaggttcaagcgattctcctgcctcagcctcctgagtaggtgggatta

SEQ ID NO: 59918 - DNA, 601 bp, Human
tctcccactatcctccgcatcatcgatatgacaggtataaggcaatgtgaaggtatgactggtgcaggtagagaaaagagccttttgtaaacggatggctctcaccaagtcctggattaacaaaacacggatttcttaactctaattttttttaagacggggtctcactctgttgcccaggctggggtgcagtggtatgatcttgcctcactgcagcttcaacctcgttagctcaagcgatcctcttgccccagcctcccaagtagttgggactacaggcacatgccaccacacctagttwtttttttttttaagagacaggcctcgctatgttgcccaggctggtcttgaattcctggcctcaagtgatcctcccaactcaaactcccaaagacttgggatgacaggcatgaaccacatcactgagtgaatttcttaactctaaaagttctatagatttcagtgaccacttcaccagagttacttgcatgaaaattgtggagtagcataatggtttttatttacttttttattgtttttatttttttaggggtcttgctaggttgtccaggctggagcgcagtggctactcacagccata

SEQ ID NO: 59919 - DNA, 601 bp, Human
cattccctggagcctgtgactgttttaccatacatggcaaaagagactctgcaggccaggcacagtggctcacgcctggtaatcctagcactctgggaggccgagataggaagactacttgagctcaggagttcaagaccagcctgggcaacatagcaagacccttactctaaaaataaaaataaaaataaaaatagtaagccaggcatggtggtgggcacctgcaatcccagccacttgggaggctgaggcagggaaatcacttgaacccaagaggcagacgttgcagtgaaccgggacygcaccactgcactccagcctgggtgacaaagcgagactctgtctcaaaaatacaaataaaaataaataaaaataaaaatagtaaagaggctttgcagatatgattaaataaaggaagattattctggtttatctgggtataccgaacgtaatcacaagagtccttgtaagtgaaaaggggaagtaggaggttcagaatcagagcaggagacatggcagaagcaatcgtcagagtgatgtgagcactggctggtgccaagcactaagcaatgtgggaaccctctagaagctggaaaaggca

SEQ ID NO: 59920 - DNA, 601 bp, Human
aactcaataaagctgttaaaaaaagaaaaaagtcttgcttgcttttgttatagagttcaaaggagattcagagctagaaagtacaggtgtacagtgagatggcagaaagtttactagcagacattcctcctcactaaggtgggccaggctgttgggtggatctctgaccattcacctatgccaaatagtctgtgtgtttcagggaggaatgtggaataggtagcagcaagtcactgaactgatttcacatgaatatatgaagcaaagtaatttaaagcattaagactccccagaagaattwaaaaaaaaaaaagattcccagagtctaaagaccaagaaatttaagttttctcagagctcattccactgaaaagactggcttcctttgctttattcctagctacagtgattggctgattagctgacagtatcacctatttggttataacttgttcctactccaagtgatgttgctgaattggtacacaccaccatttctttaatctgaattatctaagaaatattcagaaactaacaatgccctgttttgttgattgctgagtcactttctgagcttatttgctgtagtatgcagaataat

SEQ ID NO: 59921 - DNA, 601 bp, Human
tgagacagagtcttgctctgtcgccaggctggagtacagtggcgcgatctcggctcactgcaagctccacctccagggttcaagcaattctcctgcctcagcctccggagtagctgggactacaggcacccaccaccacgcccggctaatttttgtgacttttagtagagacggggtttcaccatgttggccaggatggtctcgatcacttgacctcgtgatccaccctcctcggcctcccaaagtgttgggattacgggcatgagccactgcgcccagccaggatctggttttaaaaatraaagaaaagcaatcattctccctgactcctattgccatttcagtgaatgtaaacaatgagctcatctgtccaattactatttggatgtcttataggccctctaaattgaacctgtactaagttaaactctttgtcttcctcctaaacctgcttttcctcctggtatttcttatctcaatgggaagtaccccatctacacaacgtacctaagactgaaacctaggagtcactcttaacaccttttgtccttcatatctcagtaatctccaagaactgtccattttacatcttttttaaaaa

SEQ ID NO: 59922 - DNA, 601 bp, Human
cttaggtcgggagttcgagaccagcctggccagcatggtaaaatcccatctctactaaaaatacaaaacttagccaggtggggtggtgcatgcctgcaatcccagctactcgggaggctgaggcaggagaattgcttgaactcgggatgcggaggttgcagtgagccgagatcacgccactgcactccagcctgggcagtggagcaaaactccatctcaaaaaaaaaaaaaaagagatattttaagtatcttatctttcacaactgtttcttcagtctttctcacatactgtgtatatttscaggtagaagacaaatacagctgtccttcctggctggggtttaggctgaatccgtttctcctaagtatagggagtgaaacctaacgttgtgcagctataacaaagcagcaaaatctttttttctagagttgtttccagctagaaaaggtagtatttttttaaaacactgtgttattctcaaagaacagtgtctctagaagctgaggtttataaaagtaggactaaatatttctgtgttctcctaaaacacatctccttcattttaacctcaagggaatgccacagtatcgctttcaagtc

SEQ ID NO: 59923 - DNA, 601 bp, Human
aattagccaggcgcagtggtgggcgcctgtaataccagcactttgggaggccgaggcgggtagaccaccttaggtcgggagttcgagaccagcctggccagcatggtaaaatcccatctctactaaaaatacaaaacttagccaggtggggtggtgcatgcctgcaatcccagctactcgggaggctgaggcaggagaattgcttgaactcgggatgcggaggttgcagtgagccgagatcacgccactgcactccagcctgggcagtggagcaaaactccatctcaaaaaaaaaaaaaaagagatattttaagtatcttatctttcacaactgtttcttcagtctttctcacatactgtgtatatttccaggtagaagacaaatacagctgtccttcctggctggggtttaggctgaatccgtttctcctaagtatagggagtgaaacctaacgttgtgcagctataacaaagcagcaaaatctttttttctagagttgtttccagctagaaaaggtagtatttttttaaaacactgtgttattctcaaagaacagtgtctctagaagctgaggtttataaaagtaggactaaatatttc

SEQ ID NO: 59924 - DNA, 601 bp, Human
gagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaattagccaggcatggtggcgggcgcttgtagtcccagctacttgggaggctgaggcaggagaattgcttgaacccaggaggcagaggctacagtgagccaaaatcgcaccactgcactccagcctgggtgacaaagcaagactctgtctcaaaaaaaaaaaaagtatgagaaagaggttacttctttcttaactagtttctctcagtccgtgagaaaagagggaatataaaaatagcaaccacgagccctctgactggaatagatacatctattggcctgagaaatacaaaccgaaggccataagagaagttttctccctctcccctctcccttctcccctctcccctctccctctccccacggtctccctctccctctctttctatggtctccctctgatgccgagcggaagctggactgtactgccgccatctctgctcactgcaacctccctgcctgatt

SEQ ID NO: 59925 - DNA, 601 bp, Human
cacagacagatccttcctgatatctaacctaggactcacttgctcaatcttttatttggttgaaaagactgctactcctcaaagacagaattcccaccttacctggggttcctgctgcagctacttgtagtggaggctgctttctttttattgttctttattctttcctttccttctatctaaaatcataccacagataaaagctgggcaaggcgacttgcttatcttgtcaccagactttaaggttgagagagagctggcaaaattatctaggagaatgtgtaacgtctttctgtaaagrtttcaaaaaccttgctggggacagttgaaagatagttctgcccagataaggggatagactagataacttctcagtgtcgatgccccttcctgctcaatgattctgtcattctttccacaacatggaactccctacattgtccagtgggaaagaacataccagtgctccttccggaccaaacatttccagaaaacttccaatgaattctcgggacttctcctcccacttctgaatgaggtcaatgcttttttcctccaccttctgaacaaattcttttgacttttcctccacatctttcac

SEQ ID NO: 59926 - DNA, 601 bp, Human
aaactctccttttctgttgttttactctcagagcacatttacttagccttatatggtagttacttgtgaacatgtccacaacactcactgctgtgaactcctttttagggacagacctaggacatgtaccttcaaatccattccccttagatgctgaatcaagccttgtttaaaagccgattgggcacaggatgggtaggttttaatggaagggaagtgattggaaaacacactttgagaacattgaaggctgcctaacaaggtaaggaaggtcctggggagaaatgagagtgatgccacyggcctgtcagcagagacaggacttgaaatcaaaaggaggcaaatgaaactactcaacaaataccatttttggcttttgtttttgcttttgttttgagacacagtttcactctgtcgcccaggctggagtgcagtggcgcgatctcagctcactgcaacctccgcctccctgttcaagcgattcttgtgcctcagcctcccaagtagctgggactacaggtgcaccaccacacctggctaatttttgtatttttagtagagacaccctgggtttcaccatgtctggccaggctggtctcaa

SEQ ID NO: 59927 - DNA, 601 bp, Human
gataatttctggaatatactaaagctctaatccttatatccaactgtcctgtggatatcttacttggacatcttacaagcaactcaaactctttagcccaaaactatcttcacccatcaacaaacctattcctccctgtttgtaccttacttagctcaatgagggatactctattccactcagctacctaaggtagcaatcattttttacccccaaactcctttatcttcctgtcagtatctctctctttctctctctcagtatctctctctctccctccatccttcacacacacacacayacacacacacacacacacacacagagccaatgataaagcgtggcagagttcaggcagcaggttcatcataggcttcatttttattctggaaatatgtattgagcaaaacttttaaatgaatgagatatttaagaatcaaaatggctatatattaatagagctatcaaaaatggctatataatgagctatcaaaatatagaaggcaaaacatacaaaaattgtgtgaaaatgttcagagtgcaaaagctaaaaccaaaagttagataagactggttcgttgatttgttggttgattggttg

SEQ ID NO: 59928 - DNA, 601 bp, Human
tcattttttacccccaaactcctttatcttcctgtcagtatctctctctttctctctctcagtatctctctctctccctccatccttcacacacacacacatacacacacacacacacacacacagagccaatgataaagcgtggcagagttcaggcagcaggttcatcataggcttcatttttattctggaaatatgtattgagcaaaacttttaaatgaatgagatatttaagaatcaaaatggctatatattaatagagctatcaaaaatggctatataatgagctatcaaaatataraaggcaaaacatacaaaaattgtgtgaaaatgttcagagtgcaaaagctaaaaccaaaagttagataagactggttcgttgatttgttggttgattggttggttgaatgaacaaatgaatgggtagggaaaaggtggaaggaaagaagggagtgagagagggagagagagggaagtagggacagagggagaagagaagaaagagaatcttttcaaaaagggctaaagaaaggaaaaactgctgttgataacagtgtaaacaatctgtgtctttgctgtcctatttattacttccttccaa

SEQ ID NO: 59929 - DNA, 601 bp, Human
acacacacacacacacacacacagagccaatgataaagcgtggcagagttcaggcagcaggttcatcataggcttcatttttattctggaaatatgtattgagcaaaacttttaaatgaatgagatatttaagaatcaaaatggctatatattaatagagctatcaaaaatggctatataatgagctatcaaaatatagaaggcaaaacatacaaaaattgtgtgaaaatgttcagagtgcaaaagctaaaaccaaaagttagataagactggttcgttgatttgttggttgattggttgkttgaatgaacaaatgaatgggtagggaaaaggtggaaggaaagaagggagtgagagagggagagagagggaagtagggacagagggagaagagaagaaagagaatcttttcaaaaagggctaaagaaaggaaaaactgctgttgataacagtgtaaacaatctgtgtctttgctgtcctatttattacttccttccaactatgacatgggtacaagaggcttgaggagacggtgcaagagcactaagttgccttaaataaatttgttttagtttttttattatgaaaagtttcaaatata

SEQ ID NO: 59930 - DNA, 601 bp, Human
tacttccttccaactatgacatgggtacaagaggcttgaggagacggtgcaagagcactaagttgccttaaataaatttgttttagtttttttattatgaaaagtttcaaatatatgtagaagtagagaaaatagtatttatctcaactcttaattatgtatgccatcccccactgtattagtatgaagcaaaactaataaatcacttagatcagttgaatcaccagatttaacgaattatattccagtgatataattcagaaaacaaccactatccattattttgaaaaataatgaagartacattgaaaaaaaatgtaacgagaaaattctgtacttttttattaaaaagaaaaagtatagattctttggagtttagggtatgaactggttataagtttcataacaaaatggatgttttttagatcttggccaaaatatagtggtaattctagacatatcaacatactaaaagcaaagattgccctgctgattttatttctttactcatttatttaaattccatctttttaatagataaattaagtcagctaatacgctttttaataagactaccagactgctagatcagaaaaatacc

SEQ ID NO: 59931 - DNA, 601 bp, Human
atctgaagatatcggtttgagttgaagaaatgctaaatcccctagtgggggacacttgctaattcatgctgagtttcactgggaaagcacttaattggccgtctaatatcatcgcttccaggatagttcatttactttctattctgttttactctaaaggattcacatagcacattttattagtatatgactggtaaagataaaagttcaatacatgcctttatatctgttatggaccataaacatgggcttagaaaaagaaaatatgtagaaatggagaaaagcagacatttattgatastctaatgtgttctagacaaagtctagagattaactcattcaaaggagggtgggaggaatactaggagctcaggtcttgatgtaacaagcagcccatctgcagggtattgagatgagactgaccaaggctacgagagattctgtggtagaaagtggtgggcaatgtcgttaggcaagtaagctggaaagaaactgcagacgagcttggattctgagcagagcttttagacctgatgttctgggcatcaggagccatgctggactcctaagtgggagagtgaaataaggaaagtagtttaag

SEQ ID NO: 59932 - DNA, 601 bp, Human
taaaggattcacatagcacattttattagtatatgactggtaaagataaaagttcaatacatgcctttatatctgttatggaccataaacatgggcttagaaaaagaaaatatgtagaaatggagaaaagcagacatttattgatagtctaatgtgttctagacaaagtctagagattaactcattcaaaggagggtgggaggaatactaggagctcaggtcttgatgtaacaagcagcccatctgcagggtattgagatgagactgaccaaggctacgagagattctgtggtagaaagtrgtgggcaatgtcgttaggcaagtaagctggaaagaaactgcagacgagcttggattctgagcagagcttttagacctgatgttctgggcatcaggagccatgctggactcctaagtgggagagtgaaataaggaaagtagtttaagaatatagggaatgtgttccctctaagttaggaaggaactggaagccacagtaaaagaaaggttgttttagaaaggcatctcttcctctgagattgacaggaaggatcacaagaaagttgttagtaataaaaatgaatacttatgcagcatttac

SEQ ID NO: 59933 - DNA, 601 bp, Human
agtgtaataataataaaataaaataaaaatggtttccaagaactttataaaatatcaaacattaaatcccccttatatttgtattttcttttacaagcacaggaaaatattttaaagcttttggaaaacatttaagtttttttctgaaagaacaaaattagctctttgtgtcagagttttaaccacatttgtttacatgagacaaaaataagaaaagagacaatacttaaagaaacaaaggaacttgctccagtttttttttcaaatttaaaagtgtaagcaataagctagatcactagtmacaatgagcagtcttattctctgctgggtcaacacttccattgtattaccatatccattttctcttggaaaaaaatattgattcatagttcatgtgtaagaacgttttcttttctttttaaaaagtttacttattaaaaaagtctcattttttaattaatattggatgaatttttaaaaatgaaaaccgtaatgttctcctgatacatacacatagttctatgataactggcatggtaattagactcatggtaagggtagaaaccggcatctccacatgtctaccctctcagagtctcta

SEQ ID NO: 59934 - DNA, 601 bp, Human
aaggaacttgctccagtttttttttcaaatttaaaagtgtaagcaataagctagatcactagtcacaatgagcagtcttattctctgctgggtcaacacttccattgtattaccatatccattttctcttggaaaaaaatattgattcatagttcatgtgtaagaacgttttcttttctttttaaaaagtttacttattaaaaaagtctcattttttaattaatattggatgaatttttaaaaatgaaaaccgtaatgttctcctgatacatacacatagttctatgataactggcatggkaattagactcatggtaagggtagaaaccggcatctccacatgtctaccctctcagagtctctagaagatgtttcctagggccctgggcaggtcaccttagccccaggcttctaggcttacagctaatcatgactgtgaggatgcaaagtacgcatctattcctcaagtttctcctctacatcttattccccagccccagtggataaaaatggggctgaagtttggggaaggaggggatggaagaaaaatataagtaggttgtcttattttcattttctgtggcttataacagaatacttg

SEQ ID NO: 59935 - DNA, 601 bp, Human
tggtaagggtagaaaccggcatctccacatgtctaccctctcagagtctctagaagatgtttcctagggccctgggcaggtcaccttagccccaggcttctaggcttacagctaatcatgactgtgaggatgcaaagtacgcatctattcctcaagtttctcctctacatcttattccccagccccagtggataaaaatggggctgaagtttggggaaggaggggatggaagaaaaatataagtaggttgtcttattttcattttctgtggcttataacagaatacttgaaactttgcaayttataaagaaaaggaatttatttcttacagttatggtggttcagaagtccaagtcaaggggctgcctctggtgagagtctgcttactagtgggactctctgcagagtctcaagatggtgcagggcacacatagtaaggaggctgagcatgctaactcaggtctgtcttccccttcttataaggccaccagcctcactcctgtgattactcatggattaatccattcatgagggcagagcctgcatgaccaatcacctcttaaaagccccacctctcaacactgcctcacagggggttaag

SEQ ID NO: 59936 - DNA, 601 bp, Human
gggccaaggaaaatgttcccacagaagaagtttcctcttccccttcaaacacatcacccagattacaaataaaaggaagaatctccgtgttttcagcaattaaaagggatatgattgtcccacgttcttatcatgtgttaccactacaatggcctcagaattggaggggaaggcagagggtaagtggtagacactctgtcctccttagagctttgccaagcggagccttccttaggctcctttcaggagagctagagatttccaataaaagactacaaaatggtaagaaggaacgcccccmaaaaaaaagcaaaaaaaggaaaacaaagaaaagaaagaaaggaaaaggaaaaggaaaggaaggaagggctcagggaatcagggacttggcaacactgcactcaacattaaggtggacacactgtgttgtccccactcaacattaaagtggacacactgtgttgtctgcagctgtggtccacaggccttatcccatgcctcctgctctctgagaaaggcactttctcattcttgggcatttccttttcctctttctgttcttttctggtccacatccttatcctgcatccagaattgtctt

SEQ ID NO: 59937 - DNA, 601 bp, Human
ggccaaggaaaatgttcccacagaagaagtttcctcttccccttcaaacacatcacccagattacaaataaaaggaagaatctccgtgttttcagcaattaaaagggatatgattgtcccacgttcttatcatgtgttaccactacaatggcctcagaattggaggggaaggcagagggtaagtggtagacactctgtcctccttagagctttgccaagcggagccttccttaggctcctttcaggagagctagagatttccaataaaagactacaaaatggtaagaaggaacgcccccamaaaaaaagcaaaaaaaggaaaacaaagaaaagaaagaaaggaaaaggaaaaggaaaggaaggaagggctcagggaatcagggacttggcaacactgcactcaacattaaggtggacacactgtgttgtccccactcaacattaaagtggacacactgtgttgtctgcagctgtggtccacaggccttatcccatgcctcctgctctctgagaaaggcactttctcattcttgggcatttccttttcctctttctgttcttttctggtccacatccttatcctgcatccagaattgtcttg

SEQ ID NO: 59938 - DNA, 601 bp, Human
gctgctctaacaaaaataccataaactgggtggcttataaacaacatttatttctcatagttctggaggctagaaaatccaaaatcaaggcactgccagatttggtatctagggagggcagccttctggttcataggtggccccttttcactgtgtcctctcatggtggaagaagcaaggcagccctctggggctttttttttttttttttttttttttttttttttttttttttgacagagtttcactcttttttcccaggctggagtgcaatggtgcaatctcggctcactgcaacctytgcctcccaggttcaagcaattctcctgccttagcctcccaagtagctggaattacaggcatgcaccaccacgcccagctaattttgtatttttagtacagacagggtttcaccatgttggtcaggctggtctcaaactcctgacctcatgtgatctgcccgccttggcctcccaaagtgccaggattacaggtgtgagccacaacgcctggcctggggcctcttttataagggcactaatccccaccatgaaagttctgccctcaagtcctgatcacctgctaaaagtccccacctggt

SEQ ID NO: 59939 - DNA, 601 bp, Human
tccaggcgtggtggctcacacctgtattcccagcactttgggaggccgaggcgggcggatcacaaggtcaggagatcgagaccatcctggctaacatggtgataccccatctctactaaaaatacaaataattagcggggcgtggtggcgggcgcctgcagtcccagctacttgggaggctaaggcaggagaatggcatgaacccggggaggtggagattgcagtgagctgagatcgtgccactgcactccagcctgagtgatagagtgagactccttctcaaaaacaaaaacacacttgyaaaaaacccatcttctttttgagtcaaagggttctcctttccaaatcgcttcttccccttaccattcatctttgtaccctgccataccttccccatgatgtaactagcacattctctaacagaataaaagaatgagtgtttctaaaaaattaggggacaccaagttgattatttgatattctaggaggaatggagcagaacaaagaatacaaataatattttaaataatcctttctaatcagtagtcttctcttcagcttccagattttttgttaactttccacaaaaattaatacccca

SEQ ID NO: 59940 - DNA, 601 bp, Human
ccactcagatgatatccatattttaaggtcagctaatttgggatcataatatcatctgcaaaatcccttcactgcagcccctggattcatgtttgaataactaggagaaagtatgtgacaccatgcaccaggaatcaaccacactgctcaagaacatagactcttgtatttctcagataacgatgtataaaatcttggatgtaaaaataaagtttaaagtcggaaacacaggcaagagaaatcgaaccagagaaagatatgtatttaaaagagagggatcagaggattctccctagtcaargagccagcaggaaaagcaggaatattcacagttggggaaataaactgcagatgactaacccttggagcacaattatctatgttagtgttgttgcaaatgtttttactacatattttcattcctgatgttgaatcattctagacacttgtttagaataaaggaaggtgcattgtgctagaatgcaatgttcccaaaaattccctgtgggaaagttggtggtggcagtggaatataaacaaacctattaaagatgcctatgtaataggacaatggaaaaactgctcctctctggcaccctgg

SEQ ID NO: 59941 - DNA, 601 bp, Human
tccaaaacatctttacctgaattacaatctaaaatggctcctaaaacttcctatcccctgagcaatcccatgcataatccccaggactgggaatttcgtggaattcactcctgtgattagattatgttacattgcacagttgcaacaaaccttaaaataggggaatcacctgggtgggcctgaactaatcacctgagccctttaaaagcagagagttagccaggtgcagtggcttatgcttgtaatcccagcactttgggaggccgaggcgggcggatcacaaggtcaggagatcgagacratcctggtgaacactgggaaaccccgtctctactaaaaatacaaaaaattaaccaggcttggtggtgggcgccagtagtcccagctactcaggaggctgaggcaggagaatggcgtgaacctgggatgcggagcttgcagtgagccaagattgcaccacggcactcctgggcgacagagcgagactccgtctcaaaaaaaaataaaaataaataaataaataaaaataaaagcagagagttttatctggcagccgtagaagagaaaatcagacgtttgaagggacagatgaatttgtcat

SEQ ID NO: 59942 - DNA, 601 bp, Human
atttttcctaaagtatttattacattctaatatacgctatgctatgtaatttacttagttgttatgtttattacaccttcccaacttgagtgtaggcttctttgggcaaagatcagtgtatgtcttgtgtactgacatatcccccatacctggaacattataagtgttcaaaaaatacttactgaattagtaaatcaacattttgagactactggggaggagctcttgaacaagaaaatgatgtcaaagatagtgtatggttcagtacctattaattttaaatgaataaaataccactggwggtctacctagtgtgttgacattaagttgtatttcagaaatgaaaaatatttatagatatcttctgggtttaccccaatgctcagtatccatccattttcacactgtattagttcgttttcacactgctataaagaacttccctgagactgggtagtttataaaggaaagaggtttaactgactcgccattccatgtggctggggaggcctcaggaaacttacaatcatggcagaaggtgaaggagaagcaagtaccttcttcacaaggcagcaggagagagaagagagcaagagaagaa

SEQ ID NO: 59943 - DNA, 601 bp, Human
atatcaaaaataaaccaagccaatttactatccaaacagctaatgtatttaggcaaaagacttttaaaaagacaattgcattttttattacattaagtgcaatgtagagtggcaccgattgtctccacttcactctttttatagcatattttatctttttctagttaaatgtattcaatgctttttaaaaaggttgttaaaatgtacataacattttaaccatttaactgtatggttcagtggcattgaatacattcacaatgttgttcaagcatcatcactgtcaatttccaaaattttytcatcatcgcaaacaaaaattctgcactcattaatttttttaatatcctggaaatattgtctcagccattcttttcagtgatggccaccaaatagactaacctctggggtatagactaaaatggctaaaagtcaagcacatggttaagtgaccttcatggtacccctaaaaaatgttcgtgaaaataaagttactttacaaaacaaccctatttgtcaatgacttgtaaaataaaagctatatatatagggaaagtttgttgttgttgttgttgttgttgttttgagacagagtcttgct

SEQ ID NO: 59944 - DNA, 601 bp, Human
ataaaccaagccaatttactatccaaacagctaatgtatttaggcaaaagacttttaaaaagacaattgcattttttattacattaagtgcaatgtagagtggcaccgattgtctccacttcactctttttatagcatattttatctttttctagttaaatgtattcaatgctttttaaaaaggttgttaaaatgtacataacattttaaccatttaactgtatggttcagtggcattgaatacattcacaatgttgttcaagcatcatcactgtcaatttccaaaattttctcatcatcscaaacaaaaattctgcactcattaatttttttaatatcctggaaatattgtctcagccattcttttcagtgatggccaccaaatagactaacctctggggtatagactaaaatggctaaaagtcaagcacatggttaagtgaccttcatggtacccctaaaaaatgttcgtgaaaataaagttactttacaaaacaaccctatttgtcaatgacttgtaaaataaaagctatatatatagggaaagtttgttgttgttgttgttgttgttgttttgagacagagtcttgctctgtagccc

SEQ ID NO: 59945 - DNA, 601 bp, Human
ttaagtgaccttcatggtacccctaaaaaatgttcgtgaaaataaagttactttacaaaacaaccctatttgtcaatgacttgtaaaataaaagctatatatatagggaaagtttgttgttgttgttgttgttgttgttttgagacagagtcttgctctgtagcccaggcaggagtgcagtggcgtgatctcggctcactgcaagctccacctcccaggttcacaccattctcctgcctcagcctcccaagtagctgggactacaggcgcccgccaccatgcccagctaatttttttttttgtatttttaatagagacgggatttcaccatgttagcgggaaagtatttttaaaaatcattctgcaaatatgtatggatcaccctccatgtgccaggtgctctgtagacagaacagtaaacaaaacagaaaaaaacattcatgtagcttgcattctagcaaacaacacaacaatttcagataggagcaagtaatctaaggaaaacaagacagaatgataagaattgttttgtgtcttatcactgtttacatcctccacagtgtctagcacacagaatgcatttgacccatattcatgtgca

SEQ ID NO: 59946 - DNA, 601 bp, Human
tagtaatagaataacctcaagtttacaatccaacgaatgtgttctatttattataatgctcctgattttgtagattggtagtatcagacagtggatagtggatctactatcaaatagtaattcccctctcatgctttgctgcataaactgatatctgccctatcaatctcatgagccaaatgtcattttctgaaggaaaaaggggttacttataattatggtagttacaaaatcaagtatatatatataacatatttaaataaattgtcggtagctgtttttaaccattgatggtgttggrctaggacgtctgctttatctccttgtctgtcagaaattataaagttctatttgttcaaggtgaggagagcatagtacaaaagatattaagtggcttcccttgggtaaataccagataaaatcatgtaattaaagagccttacttctaacttcccaatattatccaagtgttatagtagacagtcagtgtcctacaatgtctgtcaagccttgtcaccaaaaaacactggaacattgagaaaagcatgtggaccagcaaacctgctgtaaaactgatagtaatggcaccagccctaagcag

SEQ ID NO: 59947 - DNA, 601 bp, Human
gttacaaaatcaagtatatatatataacatatttaaataaattgtcggtagctgtttttaaccattgatggtgttgggctaggacgtctgctttatctccttgtctgtcagaaattataaagttctatttgttcaaggtgaggagagcatagtacaaaagatattaagtggcttcccttgggtaaataccagataaaatcatgtaattaaagagccttacttctaacttcccaatattatccaagtgttatagtagacagtcagtgtcctacaatgtctgtcaagccttgtcaccaaaaawcactggaacattgagaaaagcatgtggaccagcaaacctgctgtaaaactgatagtaatggcaccagccctaagcagcttactttctcagaaaaataatcagcctttttgatataatcaagtatgatacattttatctttcaatttaaatagtgctaaataaaaaacaatgatattatattgtggagaaaaataaagtgagaaaaatttatgtaactaaacaagaatcagaatctgcttcaaacatggtcataatcatcattttcttctcatttattgttctgggaggattcagccagga

SEQ ID NO: 59948 - DNA, 601 bp, Human
actttattaggatcagtgcttagtctgtttccccaggaagcagacctcaggacaaaacttgcatggaagcagctcactgggatagtgaacccagaacaaactgaaaccaggaagggaggaaagctgatagacagtgcaggaatttccaagaaaccttgtccaatgcactccagaactgtccattcaggagacaaaaggagagagttctaacctagctgctctgtcctgcattggtcaatggttgcctacaggagttaatgtcctcatgcttctaggttgcacatgtgtgagtggtagctargttccaggtgtttgtactgagatgtcagaggtattcagaaagaggctgaggccagccattgtccggttgcagctgcatcaacctggttaaaatctgtgtggtaccagtcacgtgtgcaggggcaggagaaagaggcagggccaagaggatttccaaaggtacacaagaaggatctgaaatatcactcacttgattttcattattcagggttcttcatcactatttttcatgggctttttaaaaaattttgttttaattgaaaaagagtagtatacattaatatgtatggagtacaatgtg

SEQ ID NO: 59949 - DNA, 601 bp, Human
ggaagcagacctcaggacaaaacttgcatggaagcagctcactgggatagtgaacccagaacaaactgaaaccaggaagggaggaaagctgatagacagtgcaggaatttccaagaaaccttgtccaatgcactccagaactgtccattcaggagacaaaaggagagagttctaacctagctgctctgtcctgcattggtcaatggttgcctacaggagttaatgtcctcatgcttctaggttgcacatgtgtgagtggtagctaagttccaggtgtttgtactgagatgtcagaggtatkcagaaagaggctgaggccagccattgtccggttgcagctgcatcaacctggttaaaatctgtgtggtaccagtcacgtgtgcaggggcaggagaaagaggcagggccaagaggatttccaaaggtacacaagaaggatctgaaatatcactcacttgattttcattattcagggttcttcatcactatttttcatgggctttttaaaaaattttgttttaattgaaaaagagtagtatacattaatatgtatggagtacaatgtgatgttatgataaggtagacattgtgtaataattaa

SEQ ID NO: 59950 - DNA, 601 bp, Human
ctcaggacaaaacttgcatggaagcagctcactgggatagtgaacccagaacaaactgaaaccaggaagggaggaaagctgatagacagtgcaggaatttccaagaaaccttgtccaatgcactccagaactgtccattcaggagacaaaaggagagagttctaacctagctgctctgtcctgcattggtcaatggttgcctacaggagttaatgtcctcatgcttctaggttgcacatgtgtgagtggtagctaagttccaggtgtttgtactgagatgtcagaggtattcagaaagagsctgaggccagccattgtccggttgcagctgcatcaacctggttaaaatctgtgtggtaccagtcacgtgtgcaggggcaggagaaagaggcagggccaagaggatttccaaaggtacacaagaaggatctgaaatatcactcacttgattttcattattcagggttcttcatcactatttttcatgggctttttaaaaaattttgttttaattgaaaaagagtagtatacattaatatgtatggagtacaatgtgatgttatgataaggtagacattgtgtaataattaaaacaggctaa

SEQ ID NO: 59951 - DNA, 601 bp, Human
ttttgaaatatacattattaactttagtcaccatgctgtgcaatagatcactaaaacttatcccattggccttaaaagttttttttaacaaaagatacactcctcatgttctttatactatattgatttatggatgacctcactcaagatacctataaatgacctgtactgctgattaaccacctagagatctcttcatcccaaattctagtcctatttcccaagcaattttctatgcactagggagctgggccacagctattttctgaatgaatgaatgaataaataaataaataaagtrgattttctgttatttatttgtatttattctcattgcacagagaattgtatagatatatagtacagaatgaatgaagtaaaagtaatgcagttgctacttactcacttttttcaatggccaggtatacttcatctatttgagtttatgttggccagatgggcacataattcagggtcagtgagttcaaatttctaaaggacaagtaggagacagttcctcatggctgccagccctatcggtgctctttcagaatgtggcctctggcttctaggattctggccacagttcaagttactgcat

SEQ ID NO: 59952 - DNA, 601 bp, Human
cagggtcagtgagttcaaatttctaaaggacaagtaggagacagttcctcatggctgccagccctatcggtgctctttcagaatgtggcctctggcttctaggattctggccacagttcaagttactgcataagaaataagaaaggttctgtggaaaactatgcccaataaagccttgtggagctttcttagaacactgaggtaaagggaaagcttctaaagattatgtgtaatgctgggcatccagtaggtgccctactctattccattcacttagcattattgagaacccagtttgaayaaggtattatgcagagttgagaggaatgcaaagatgaacaagacatagcccatgccctcaagatgctagcacgtagttctgtggtttttaagtttacccccacgtatcttctggagaaactgatgaaagccatggacctatgtttcaaaatatacatgaccctgagcataaaatttagctcatgattttatattaagtggaatttataattccaattatggaatgatataaaacattcaggaaaaaacttgtttattaataactatggaaaatatgtagtgtcataaatggtccaataga

SEQ ID NO: 59953 - DNA, 601 bp, Human
tttacccccacgtatcttctggagaaactgatgaaagccatggacctatgtttcaaaatatacatgaccctgagcataaaatttagctcatgattttatattaagtggaatttataattccaattatggaatgatataaaacattcaggaaaaaacttgtttattaataactatggaaaatatgtagtgtcataaatggtccaatagatatgtgaagtgctctgggagcaacaaaagggagaaagtaatcctacctgagggtataagaatgagcatcctcagggacatggcatgtgagtgstaccttgagggatggtgattgtagggcacacctggtggagggagcaggctaagtaaaggcacatacaagaaagccaagggaatgtcctggaatttaagaagtccagtgtggctagagcataggactcttggaagaagctggagaatagtgggagatgggactacagactagtagactgaggtccaaacactgattttcatgcttagcctgttgggttttactcaataggcaatggagaacggcatggccagagcagaaccttataatatttcttaggatagatagaaagagacagaaagt

SEQ ID NO: 59954 - DNA, 601 bp, Human
caattatggaatgatataaaacattcaggaaaaaacttgtttattaataactatggaaaatatgtagtgtcataaatggtccaatagatatgtgaagtgctctgggagcaacaaaagggagaaagtaatcctacctgagggtataagaatgagcatcctcagggacatggcatgtgagtggtaccttgagggatggtgattgtagggcacacctggtggagggagcaggctaagtaaaggcacatacaagaaagccaagggaatgtcctggaatttaagaagtccagtgtggctagagcayaggactcttggaagaagctggagaatagtgggagatgggactacagactagtagactgaggtccaaacactgattttcatgcttagcctgttgggttttactcaataggcaatggagaacggcatggccagagcagaaccttataatatttcttaggatagatagaaagagacagaaagtggaggtgagtaggaggctttcttctaagtagaaggcttttacaagcctagattagggcactagaatgtagggaatgataagaccacattaaagatgtgagctctaaaagccctttataaa

SEQ ID NO: 59955 - DNA, 601 bp, Human
tgtagggcacacctggtggagggagcaggctaagtaaaggcacatacaagaaagccaagggaatgtcctggaatttaagaagtccagtgtggctagagcataggactcttggaagaagctggagaatagtgggagatgggactacagactagtagactgaggtccaaacactgattttcatgcttagcctgttgggttttactcaataggcaatggagaacggcatggccagagcagaaccttataatatttcttaggatagatagaaagagacagaaagtggaggtgagtaggaggcttkcttctaagtagaaggcttttacaagcctagattagggcactagaatgtagggaatgataagaccacattaaagatgtgagctctaaaagccctttataaaatgactgtccacaggagaaataagatacaagattttcttgcttctaaagtgattaatattctgaataaagttaaacactggcaatgagaaattagttatcattcagatctgtcttttcatttaccttctcttattatttttgtaatccttggtataatactttaaaaataatgggcttaataaatccttgttcaattgaa

SEQ ID NO: 59956 - DNA, 601 bp, Human
gggcttaataaatccttgttcaattgaatgtttttagatttaatttatagtgtgacagctactgagtcaacaattttcatacctcactttgaataacgattctggtctgcagacacaatttaaggaatactgaataccttttcctaataggcaatggatgtactaccagggcctgtgaagattggcatgatattcaatttgattttacaccaaaaatatgttgtagaccttttcatgaaggtttattacatcatcttaaccaggaaattaaagtgaaactaaaatgttatctctgtaagayatgatgcttctctctaaggatccttagcaaagagaactaccttggagataaaagcatgctttcagagccagaaagacgttgagattggaagcataaaaacgcctagtgagctactcagctgttgtttgggttcacattttataaaggtatagctcatgctcactaatggaaaacaaatctgaagattgtgcctttagtaacattttctttctgatttcaatgtttggttaatgtgggtgatggcggatagcttcagtgtaatcacataaaaatgtatctattgaccctggaaaagcatac

SEQ ID NO: 59957 - DNA, 601 bp, Human
ggtctgcagacacaatttaaggaatactgaataccttttcctaataggcaatggatgtactaccagggcctgtgaagattggcatgatattcaatttgattttacaccaaaaatatgttgtagaccttttcatgaaggtttattacatcatcttaaccaggaaattaaagtgaaactaaaatgttatctctgtaagacatgatgcttctctctaaggatccttagcaaagagaactaccttggagataaaagcatgctttcagagccagaaagacgttgagattggaagcataaaaacgcytagtgagctactcagctgttgtttgggttcacattttataaaggtatagctcatgctcactaatggaaaacaaatctgaagattgtgcctttagtaacattttctttctgatttcaatgtttggttaatgtgggtgatggcggatagcttcagtgtaatcacataaaaatgtatctattgaccctggaaaagcataccatttaattgagtccttcttccctaaaagatttttaaataccattttctcatgataagaggcctgaacaagggcataaaaataaattatttattttagagctc

SEQ ID NO: 59958 - DNA, 601 bp, Human
taaaagcatgctttcagagccagaaagacgttgagattggaagcataaaaacgcctagtgagctactcagctgttgtttgggttcacattttataaaggtatagctcatgctcactaatggaaaacaaatctgaagattgtgcctttagtaacattttctttctgatttcaatgtttggttaatgtgggtgatggcggatagcttcagtgtaatcacataaaaatgtatctattgaccctggaaaagcataccatttaattgagtccttcttccctaaaagatttttaaataccattttcgcatgataagaggcctgaacaagggcataaaaataaattatttattttagagctcttaacaactaggtaatttgcacctggctttcttggccacagtgctcccaggaaattcctctgaatcaaaggagcatctctattcttcctgtctcttgtctaactccattctttaagttgtgctccatagcagtggttctcaaactttattgtctaacaaaatcatctaagaagctgattatacctagggatgccctggccacactctagacctatggattcaaactcgatagtttgagacccactt

SEQ ID NO: 59959 - DNA, 601 bp, Human
tctattgaccctggaaaagcataccatttaattgagtccttcttccctaaaagatttttaaataccattttctcatgataagaggcctgaacaagggcataaaaataaattatttattttagagctcttaacaactaggtaatttgcacctggctttcttggccacagtgctcccaggaaattcctctgaatcaaaggagcatctctattcttcctgtctcttgtctaactccattctttaagttgtgctccatagcagtggttctcaaactttattgtctaacaaaatcatctaagaagytgattatacctagggatgccctggccacactctagacctatggattcaaactcgatagtttgagacccacttatggctctaaagaacagcccgggtttccaccaccatacctcttagctttagatggggctctgaattaactcacatagtagtctgaaaatgaaattaaacatttaactttaggagattcaaatctttaataaaatataaaaacaaagatattccctcattgaaaaattaagagtgttatatactgggcagtataaatgaatagttatagaccctgctttcctctaagct

SEQ ID NO: 59960 - DNA, 601 bp, Human
cacgttctcttttaatctcactataactgcctctggatggcattcgtttcctcattttaaaaaaggaataatacaatgtataaacaaaatattattacattttatttttattaataaaatttgcccagttttgcagttatttccagagccaggaatgaaaccttaatctctgtggctgcaaaatctgaattctttccactatgccaccactggaaaataaggggtacaatgtgcgtgactgcagttttttctgcatagtaccaccttgtagacaaaaataccaccatcccttactggaackaaaacaatatgctccaactacttcccactgtgtgcctgtccgtctccgctcctttcttcccttaaagtcagaaatgacatttttaagctgcattcctgatcatgttgctgtcctacttaaaacccatgtcttcatactcagcataaagagccaaatccttattgtagttatggtgctcctgcaaccttatcttgttctggcccaatcaagaccatatcgtaatcccattttatacctagcatgctatatgtcacagtatgtcactatttctgatcacccgtttgtgtgattgtgtgagtc

SEQ ID NO: 59961 - DNA, 601 bp, Human
gtatgtcactatttctgatcacccgtttgtgtgattgtgtgagtcatgtctgtattcccaccagactgttagctcccataggcaggaaccacatctatattgtttgtattgagtcctcacaatctaccatagtgtttgcatataattatgaaaactagttttacttaaatcatttttaattatctattctcacagttagccagaattattttatttttcatgaaatatttttcttttacgttccttatattaggaccttcaatatgtaagcacataaatgcagcatatttatgtttaatamctttcatataatttctaggtatttgattataataataaacaactattgtctcctacatgacatgccctattccaagtgttttacaggcattattttattcagctgtcatagtaatcatccgaaagtagatgctattttcagttccacttttctaacatgaagattcagagaagttaattagactgacagtatacctaggattcaaaccagtgtctctgtgattcttcatgactatgccttattgcattttagaaagcaaatgcatccttagaaaaccctgtttcactgttgagtcatttc

SEQ ID NO: 59962 - DNA, 601 bp, Human
agacaaactgttggtctacacaagagtgcccactacatgctgtgatggggaaggacagagctctaaggtggtgcatgcaaggggtataaaacccggagacagggtttctgatccagcccagaaagatatccttgaggaagtaatgttgacgccaaggtatagtagatgagatgtagatgagaagtacacaggggctagatgaaaaaagaaaagaaagaaaaaaaacttcaatccttgtttagatttcaaattaatgggaagttattaaaggactttaagcagcatactatatatatatatwttttttttttttttttttttttttgagacggagtctcgctctgttgcccaggttggagtgcagtggcgcaatcttggctcactgcaagctccgcctcccggcttcacgccattctccaagcagcatacaattttaagcagcatacaagtgatatgtcaaattacggtttagaaatcacactctggctgcagtgagtagaaagggagtacagaaagaatgaaaaaagaactgactcagccaaacagtaagcgtgatagcattgggtaacgaaattgggtggtggcaataaaggttcatgga

SEQ ID NO: 59963 - DNA, 601 bp, Human
acaaactgttggtctacacaagagtgcccactacatgctgtgatggggaaggacagagctctaaggtggtgcatgcaaggggtataaaacccggagacagggtttctgatccagcccagaaagatatccttgaggaagtaatgttgacgccaaggtatagtagatgagatgtagatgagaagtacacaggggctagatgaaaaaagaaaagaaagaaaaaaaacttcaatccttgtttagatttcaaattaatgggaagttattaaaggactttaagcagcatactatatatatatatatwttttttttttttttttttttttgagacggagtctcgctctgttgcccaggttggagtgcagtggcgcaatcttggctcactgcaagctccgcctcccggcttcacgccattctccaagcagcatacaattttaagcagcatacaagtgatatgtcaaattacggtttagaaatcacactctggctgcagtgagtagaaagggagtacagaaagaatgaaaaaagaactgactcagccaaacagtaagcgtgatagcattgggtaacgaaattgggtggtggcaataaaggttcatggaaa

SEQ ID NO: 59964 - DNA, 601 bp, Human
tgctcctctccccagatgtctgttccacatcatccacaaccaggaactaggtgaggataggtcacagggaccaagcaggacgacaggctggatgtcatcagcactgctttctttgcatcctgcacccagacacatcctgatgactagatccagaagattcacagatcaaatctatagggagtaattagaggaatcccagctcttcccaactagaatttaaataaataaataaatttagtttataaatgccatttccctgggagtgttttgcttgctagatagaagagttggataaataacrccaagaaatacaaataatttccttgttgattaattcttgatatacagaaaaggttgcaaatttgaaatcacttaaatctgaatttttccaaaactaataaatatttattttagttggtatgtgatttgtactcatctgctccaaatcagagatatattgcaatatatttttcttttgacatgactcacattatttacttgttcatctataatgcattgtctgctaggtaccaggaactaccactttttactctatgcatttttccattttaggaatgccagccccatttcatagatgaag

SEQ ID NO: 59965 - DNA, 601 bp, Human
catctcttggatctcaatgtgcacacaaagttagttatgagaaccatactttaggtttttgtttttctttatgcctaatttgaaaataagaatgtctgaacagattgctctctctctcttagggttctgtggttacagatcctgcagttaaacctagcctgggaaaagggtctgacttcaaaagactgttggctagttggctcatttgttattataatggaagaaattggtgacaagttctcctataccaaaagtcagaaaccatagatctgttctgaaaagcaaaagtaagagagaagtmaagaaaaaagtcacatagctcaattcatagtagaagctgatgttagttttgcttattaggtatatagccaggagagagcaatgaggtagaagacaaaaaaatagggagctgttagtgaaaaaatatatatacagtgcatatttctcaaaaacggaaactgttatatttcattgagaataaacaaaatatttatttgcaaatgcaaaagcataatgaaaagtcaaccttaaatggtgaagatgtggaggaactggaactctcgtacactgctgatgggaatgtaagatggttcaactactt

SEQ ID NO: 59966 - DNA, 601 bp, Human
agcacaaagaaattgtcacttgtttggtgtctcgcagcatgttagtggccgagtggggacttaggtgttcaacaaaggtttctttaccaaggtatatgtggattcccctgaattacattctcagcctacaatttcaagagggctttttgccaatagcctccaacctggacgtagtaccaccccctccacttccactgcttgttttgaatattaaaaaggaaaattgctaacctgacctttcagcaatcacattttgagattctcagaaggttttacttagtctcattgtctggccaatgcytggaagtatttacccccgcagtggagatgttccagccaggctaatgttattttgcaattcacaaaagctaccagctgtcactttgcaacttagagtgttaacagaatcgttcctgctcagtttttccagtgtgcattattgtcttcgtgatatttatattttgagaaattcttcagttaaaataaacaattttacaactagcattccaggttggtagagtctttgcttcggctgtgcacacttcagaacgagatgtacagctctagcttaatcactatagtaactggatgctggggcagg

SEQ ID NO: 59967 - DNA, 601 bp, Human
ccatagccaacacaagaatgaatcaatgaatgaaaatccaaggttgatctttctgagctcttgtcgtactaatttcttttaactatttttttttaagaccgagtctcactctgccgcccaggctggagtgcagtggcacaatcttagctcactgcagccttcgcctcctggcctagagcaattcttgtgcctcagcctcccgagtagctgggactacaggcgtgcaccaccacacctggctagtaattgtgtttttagtagagatagggattcaccatattgctcaggctggtcttgaacctctgggctcaagcaatccacctgcctcagcctctcaaagtactgggatttacaggcatgagccaccatgtctggccagttttcttttaattctttttctgagattaagtcttccttgatctccaatatattacaaagactagcgggtcccagtcacctagattcagaccctctatttttacttctgctccacagaaaaaaaaaacaagtgttcatggttaccaatgttggtgatcctatttttacaaaagacttctatgtactcctctcaccttctccctgcttccccaggaaacactaa

SEQ ID NO: 59968 - DNA, 601 bp, Human
atagccaacacaagaatgaatcaatgaatgaaaatccaaggttgatctttctgagctcttgtcgtactaatttcttttaactatttttttttaagaccgagtctcactctgccgcccaggctggagtgcagtggcacaatcttagctcactgcagccttcgcctcctggcctagagcaattcttgtgcctcagcctcccgagtagctgggactacaggcgtgcaccaccacacctggctagtaattgtgtttttagtagagatagggattcaccatattgctcaggctggtcttgaacctctgggctcaagcaatccacctgcctcagcctctcaaagtactgggatttacaggcatgagccaccatgtctggccagttttcttttaattctttttctgagattaagtcttccttgatctccaatatattacaaagactagcgggtcccagtcacctagattcagaccctctatttttacttctgctccacagaaaaaaaaaacaagtgttcatggttaccaatgttggtgatcctatttttacaaaagacttctatgtactcctctcaccttctccctgcttccccaggaaacactaaaa

SEQ ID NO: 59969 - DNA, 601 bp, Human
ttttcagtagagacaggatatcaccatgttggccaggctggtctcaaactcctgacctccagtgatctgcccacctcagcctcccaaagtgctaggattacagacgtaagccaccgtgctcggccagagcttttacttttgcccctttaaaatagcagctctctttgaaaagtaaatatatcacataagcacagttggcttgtgggtaggaaatgatggttgaaaaaaatgtgtgatgaaaaagtccccatagttaccctaacctcaaattcagaaattctctgacaaaaaaaaaaaaaaatgatgtttctgaagctctgtttaagtaaattatagagattctggaattattgtgtgcaaaaatcattttatgaaactccaagtgaaaagcatgttctgttatttaaatccatagttagctagtagatattcctctggctatcagcccatattttgagcaagtgacatatacaaagaataagctaagagattctgatgtctcttaaggaaacattgaatagacagttcttcagatatgtgcattgaattgttttcacaaccttttataaaatggatgtgcccacataaggcatgcagctat

SEQ ID NO: 59970 - DNA, 601 bp, Human
gaaaaaaatgtgtgatgaaaaagtccccatagttaccctaacctcaaattcagaaattctctgacaaaaaaaaaaaaaaatgatgtttctgaagctctgtttaagtaaattatagagattctggaattattgtgtgcaaaaatcattttatgaaactccaagtgaaaagcatgttctgttatttaaatccatagttagctagtagatattcctctggctatcagcccatattttgagcaagtgacatatacaaagaataagctaagagattctgatgtctcttaaggaaacattgaatagrcagttcttcagatatgtgcattgaattgttttcacaaccttttataaaatggatgtgcccacataaggcatgcagctatgtatcctgtgatttctacagaatagaaaatgtcaaaccttgttgctggaagtactccaaatgacatcatggttttgttttgtttttgtttttgttttttttctattaccattaaacagggaaggccatggtaaaatttcagtatttgctgtcaaaatggctttagccacattgtgtggagggaagatcatggacaaattaagatgtaagttattattcctt

SEQ ID NO: 59971 - DNA, 601 bp, Human
aatcattttatgaaactccaagtgaaaagcatgttctgttatttaaatccatagttagctagtagatattcctctggctatcagcccatattttgagcaagtgacatatacaaagaataagctaagagattctgatgtctcttaaggaaacattgaatagacagttcttcagatatgtgcattgaattgttttcacaaccttttataaaatggatgtgcccacataaggcatgcagctatgtatcctgtgatttctacagaatagaaaatgtcaaaccttgttgctggaagtactccaaaygacatcatggttttgttttgtttttgtttttgttttttttctattaccattaaacagggaaggccatggtaaaatttcagtatttgctgtcaaaatggctttagccacattgtgtggagggaagatcatggacaaattaagatgtaagttattattccttgtgtgtctgtttgcttttccttgctaggtaccacccttttctctccctcattcctctatgtcccctccccatttgtatctttcctcattctatgagagttgtttgaaatacatttttcactgatgtttggattttgtcat

SEQ ID NO: 59972 - DNA, 601 bp, Human
aagccaacaatgtcaggaaagaagaataggaattacatagagacagcattggcagagttaactagatgccagtaaaagcatggtagctaaagtacattgagtaattgtgggccttaatgaacattttgtctctaaatatggtagagttccttaaccaacgacacactggggattgtttgtttgtttgtttgtttgctttaggtaaagaaactgagactcagttaaccatatggctaagacgatgccaggatttgaaccctgacttttttttctacacaggtggttcacaaattttagcatrcatcagaatcaccttgagggcttcggtaaaacatagatttctgggtcccaccccaagaatttctgactcagtaggcctaggatgagggtgggtgaaaagcatatttatttctaactagtttaaaatgatgttgatgccgctgtttaaatttaaaatttccatttaaccctatccttttccctaaatagtatgagttggggctataatgctgtgttagaaagggcactgtcctgggaattgggagttccaggttgcaagcccagctatgtgactaatttgctgagttatcctttgtcagtt

SEQ ID NO: 59973 - DNA, 601 bp, Human
tgaagggatatggaatgtttcaggcttgagggttttgttttcccttctttaaagtttttctaattcacgttaagccaaaatgccagctgtgcttgtttggcaatttttctatttttgtgcatagggttgagagatatttagctcgttccagctactcccttattgttggtgaacacagagcaagaataactggctgaaaataagtcggaaattttaaaaaacaaagagaaagcaacagaaaatttgaagttgattttcttaacgctttaaaatgcattagaagagaaaacaacactatgttgcaacataatttccagtaattagggcaccattcagtggtagggtgttccctgtgtaattccagggagcatcattgacacagcttaggagatgaagggcgccccctgcagtcatgtgccatggcaacctaaacataaacttacctaataacactactattttgtcagattgttcttggcccaattataagctgttttaatgggttggaacatttgtttatacttctgtcttagggctcctggatagttctaaggatcttaagggattctaaatccaatgctgtaagcctggtatgtcatgt

SEQ ID NO: 59974 - DNA, 601 bp, Human
ttgtgattgctatgtgccagaatcatctacaaaaagaaaccagagaaaacattatgccaggaatatttcagcataaaaattagcttttatattattctttcataaaaaatgtttattttgctacttttttgtcatttgtagcagatatattgaacaaaaacagtggagaatgttcatgtgatgaataatatctttccttttcctttcatcagatattttctcaatgatttctgactccagtggggtgatggtttatggacgatatgaccaattccttcgggaagttctcaaactacccackgcagtttttgaaggtccttcatttggttacacagaacagtcagccagatcctgtttctcccaacaggtaggagaaaaatatgtttaaggaagtatctctttcaaacagtggttgctctccttctagatgtcattccaggtcacagatactcagacaaattattctgtgtgatagcaacctgtattgtatttttcagcctctggcaaatgacctctgagccagtaactaaacccagcacatctggatcacaataatagacagtgtttactgaccatgaggcaggcactgtgctaaattttt

SEQ ID NO: 59975 - DNA, 601 bp, Human
tttaactctggtcttctaattccatctgttaatgttattcttgtgttcttgttgttgttgcttttgttttgtgcactttcagttcatatttacaaatatgcagatgatctgactcaaggaaatgtaactacctgttgtattacttcacccagtcatggaaacaagaataatttcatttataactgaattcttgaattttagttagtgtattatagaataattggtaaatgtgctaatgcctcagaatatatgtctcattcaaaatcagctagaataataggactgggttttaaaaaaaaaatcttaaaaggacctatgctggtgtgatggctcacacagtaatcctagcactgagaggctgaggcaggaggagagcttgagtccagcagttcaagaccagcctggacaacatagtaagatctcatctctgaaaaaaaaaaaaaattaaacaattagccaggtgtggtggcacacacttatagtcccagctacttgggaggctgagatgagaggatccctttagcccaggtgttcaaggttgcagtgagctataattgtgccactgcactccagcctgggcagcagagtgagatcctgtctc

SEQ ID NO: 59976 - DNA, 601 bp, Human
ttgttttagatccgaatttctcatatttgcatacacggtactgattatttcttcccaggcactcagccagaaataggtgggagaaatgagaaaaaaaaatagatgatagcaccctgttaatctttagtcatatgttccagattgtgagctttcaatagttgtacttacgttaaagataagagtaaaataactttcgtatcatgtctttttttaaagcaagtatttctaggataaaaggaactactgttggcatatccagatttaaatatgaaataccatttggggcaaaatttacagaaawttaaacatggagcagttcagtgcctccatctaatctttaggtgttcctacttattgttcaatgtaactctgaaatttctccagacttgacgaggaaataatttagtctctatctcttactgagatttaacttaagtctctatatattactcaacttctgtgtatttctttaatatacattgcagctaaagttagcttaattttaaattatcattcagaatttttagcatctgcccttatttatctgttagttagaagttatgaatttatcctgtttttctcatggagaaaatttaaagaa

SEQ ID NO: 59977 - DNA, 601 bp, Human
cttcccaggcactcagccagaaataggtgggagaaatgagaaaaaaaaatagatgatagcaccctgttaatctttagtcatatgttccagattgtgagctttcaatagttgtacttacgttaaagataagagtaaaataactttcgtatcatgtctttttttaaagcaagtatttctaggataaaaggaactactgttggcatatccagatttaaatatgaaataccatttggggcaaaatttacagaaaattaaacatggagcagttcagtgcctccatctaatctttaggtgttcctayttattgttcaatgtaactctgaaatttctccagacttgacgaggaaataatttagtctctatctcttactgagatttaacttaagtctctatatattactcaacttctgtgtatttctttaatatacattgcagctaaagttagcttaattttaaattatcattcagaatttttagcatctgcccttatttatctgttagttagaagttatgaatttatcctgtttttctcatggagaaaatttaaagaatgaatttattttatttttttgcaatcactaacaatcatagtttttttatg

SEQ ID NO: 59978 - DNA, 601 bp, Human
ggagaatagctttaccaaaggcaagaattgttattgttgttttagtatctagctcatagcatgtagacaattacttggatttgatcacttaaatctaatattttactttgcttcaaatctagtattttgctttgcctgctttataattcaaatttcctaccaaagaaagttaaccgtctcttgaggcatttgaattatttagaactgttttcagataatttgcacatcttttttagggccctatacacctgcctcaggaaagaaaaaaaaatctgtttgtcagatgtaggcaacaccactygttaagtaagccattagtcactctattttttaaaaaataacttaattatctcatccacaccagttttccattctctgcccatcttcctttcttttttcttcctctcattctccgtgtctctgatattcgctctcttcccactggacaatcagcattcaccccttgtgcttctgagtcttccagtgagctgtgctggtctcctggagacagagagcagtttggggtaaaggcaagtctgtttggctaatttaaattcttgtaatgtgagagatgggaatagaaagagcaaatggcattaca

SEQ ID NO: 59979 - DNA, 601 bp, Human
tcatcttcattccaagcctatttcctcacaaaccattttctgttcttaagtgagagcagtccttctagaatcaggtctgatgctgtcatgcctgtgatgtaaactcttcatggtctgcctctgtcctggggataaagagacagttcttaacaagccatataaagattttgatgatctgcctcctgctttcctccccagaagggctcccttcactgttgctgcttcctccattctcgaatgaccttcccagtctgctgagtttttgtcagaaggattcctgcaggcccattaagtcccagckcaggtgccccatgcacaatgcctgcttccatttattgtagcatttgctgacactgagcagcaggaggcagcttgttcggaaactcttttccgagcattgagcaaacttccagactcagaatcagcactgaaaaaggatttcttccgtaaatgaatatctattatgaaaagcaaatcatttgataaaatattacataaatattagctgttgtcacttctgccttccttcttctttccagaaatcacctgctaagaagctgactaatgcattaagcaagtccctgagctgtgcttccagccg

SEQ ID NO: 59980 - DNA, 601 bp, Human
gagagcagccagtgctccctgagctctgccgagagtaatttcctaccagccctgctgggagtttcaccccaagagagcagccttcaacagagctgctgggtgtcatgaagatagagggtgtgggtgtgaatagcctggctctaagagctttgctgcttcccactcctccaaagaattagaacgtgatgcactgcaacgtaaaagtccatttcacagtgagtcccactggagtattatctagctcagggcctgtacccagtgggtgctaggattgggtggtgtgtgtgtgtgtgtgcacgtrtgtgtctgcatgagagagagaaagagagggagaaagaagtatttaattggctgagtaataatttttacattttgacttacggggcaatataatctgttttgttatttattgaattaactgagggctatagcctcacaatgcgttcttagtttatgttccatggagagattttaaaattctgtacaaaatgtgtcttctgagaaaaacctctatgtattttaccagatcctcaagagtccttgaatcaaaatactgatctctactcactgataacatattttcccaggatgaaagttttaa

SEQ ID NO: 59981 - DNA, 601 bp, Human
ataataagtggaaaatgctttatcaatacattagaaaatatttttattactcatttaaaactcaagttccaactttttcttttttcttctttttttattttttgtagaaatagggcctctctatattacccaggctggtctggaactcctaggctgagattacaagtgtgagccaccatacctggccacaacttaaatgtgaaaaaatggcaaaaatatggcacagtctgactatgtaacaagttaacattttacaggtagccttagatacagtaaaaaaaaaaaaaaaaaaaattaaatyaataggatttttaaacaggttgcggtactaatacacacacatatacacacacatacatacatttgtatatggaaatgaagcatgtgacacacagaaaatgccattttttttttaactatagccaagggactttttttttctacccaccttgtagagaggtgctgccagtcatgaattagtccttaaatagaaatgagcaggtggtgacattttggtattttgacatttgttcttagctattgtattgcttgtaaatattaccatgattaacggtctctattctgttcaattcttcgctgc

SEQ ID NO: 59982 - DNA, 601 bp, Human
cattagaaaatatttttattactcatttaaaactcaagttccaactttttcttttttcttctttttttattttttgtagaaatagggcctctctatattacccaggctggtctggaactcctaggctgagattacaagtgtgagccaccatacctggccacaacttaaatgtgaaaaaatggcaaaaatatggcacagtctgactatgtaacaagttaacattttacaggtagccttagatacagtaaaaaaaaaaaaaaaaaaaattaaatcaataggatttttaaacaggttgcggtastaatacacacacatatacacacacatacatacatttgtatatggaaatgaagcatgtgacacacagaaaatgccattttttttttaactatagccaagggactttttttttctacccaccttgtagagaggtgctgccagtcatgaattagtccttaaatagaaatgagcaggtggtgacattttggtattttgacatttgttcttagctattgtattgcttgtaaatattaccatgattaacggtctctattctgttcaattcttcgctgccaaaagtgatacttggtaagtagtgcag

SEQ ID NO: 59983 - DNA, 601 bp, Human
gccttgattctgtggtaagaaaaatattctcatgcaagccaagggcagaatattgttactagaaactaacttgcaaatatccattataagttttcaatttcattcatttgtatgcatttaaagaggggtagggtggctttggggattaatgtcatgtctggaaacctgcatttataatttacccacagtaagaatgtgagggtatgtttcagttttactactgacacacatgcatcccatctcattaaggaagtcacgttcatagtcctcagagttgaagtcaaagaactggaatttcagratgcaatggtgtgttactatataaatggtgaaatgtgtcattatttaaagctaagatacaaaagaatcctttgttggtgaaccctggagttcctgaggctagaggataaagaccaaacttggaaatgtagtttccatataagtaatttcacgataataataagaacttttttaaaaggtggatctgcatctcatttctttgcacaagatccattgccatgtgagcaagaaacaggagaagcaaatatttctctaagagttagcatcagacatatgcagggtcaagaggtgctctgagtca

SEQ ID NO: 59984 - DNA, 601 bp, Human; identical to SEQ ID NO: 35428

SEQ ID NO: 59985 - DNA, 601 bp, Human; identical to SEQ ID NO: 35429

SEQ ID NO: 59986 - DNA, 601 bp, Human; identical to SEQ ID NO: 35430

SEQ ID NO: 59987 - DNA, 601 bp, Human; identical to SEQ ID NO: 35431

SEQ ID NO: 59988 - DNA, 601 bp, Human; identical to SEQ ID NO: 35432

SEQ ID NO: 59989 - DNA, 601 bp, Human; identical to SEQ ID NO: 35433

SEQ ID NO: 59990 - DNA, 601 bp, Human; identical to SEQ ID NO: 35434

SEQ ID NO: 59991 - DNA, 601 bp, Human; identical to SEQ ID NO: 35435

SEQ ID NO: 59992 - DNA, 601 bp, Human
aaatgcatgtttatgttttgaattctaacaataaattatttttctacatcatttcttgatattattcccaatacaaattaatcaaagcacttcattctgtatatcagatttctggctcatccagatgtaaataaacctcagttctaaatcatgccaatctagtcctcattatttaggaaagccagacaataatctcaccattgtctttagtagtgccacatgctaaaggagaagacacctttataggtccaactcttagaaatctcccaacaatagtacattgttaaaaaaaaaaaaaaaaccaccacagaacttttatatgtgtttccatttcacttttacttttggttcccaatttctatataaattctaaaataaatatacatccttcaaacaactatttctaattaatctcaggaaaccataaactgatttccaaacctaaaagacccttccaaataatgctttaaaaaaaacttttcatgcacatattttcaattcaatataatatacctccattagagatagaatagctttcaaagcgtctcctttctagcatcctccaggaatactgcaccgggaaacagttgccagtacagga

SEQ ID NO: 59993 - DNA, 601 bp, Human
atggttattgccagggtttgaatgtgttccccgaagttcctgtgttggaaacttaatctccaatgcaacagtgttgagaagtggaaccttcaagaggtgattaggtcctgagggctctgttcttatttacttatttatttttattttttcttttgagatggagtctcactctgtcacccaggctggagtgcagtggtgcaatcttggctcactgcaacctccgcctcccggcttcaagcgattctcctaccccagcttcctgagtagctgggactacaggcacgcgccgccacccccagcwaatttttgtatttttagtagagccggggtttcaccacgttgggcaggatgatctcgatctcttgaccttgtgatctacccgcctcagcctcccaaagtgctgggattacaggcatgagccactgcgcatggcctctgttcttatgaatgaattaatgtcatgatctctggagtgagttcctaataaaataatgcgtttagaccccttcccttctctctcacaaaagggctcccttctattttctgacatgggatgaggcagcaagaaggcttcttggacttcccaaccctcagaactgta

SEQ ID NO: 59994 - DNA, 601 bp, Human
acaaacaaataaactaattgattgtgatggtagcttttacagaggaaaaatgagcaacaacatagcaaaaattctttcttggcctcaggtaaacaacaatgaccatgtaaacagagtgcttagagaacaatgacccacatctgatattcaaacaaacctttgatattagatttgaaaaatctcatctaattaggtcaattgggtagagcatggcgctagtatgaccaggctaggccttagatccccatatgtgcctcttagctttaccccatggccctagattaaacccctaaaacccttcagccatctggcaactgtagttacatccagtgagaaccaataaggttgttccttattctcaaaattagtctttcaacttcttaaatttattctctgagtttttctcaaccttccaattttctaacagctccaaaacacttcaaaaactcgtaactgtgagaataactatcacaaatgaatatttgattaaaattagaaagagtggaacataagaggctattgaataaacctcagatagaaaggaagaaaatcaaaataaaatcaacgtagagaggagagactaatttacaatttcctccag

SEQ ID NO: 59995 - DNA, 601 bp, Human
cagcattttagaaatttttgtcttgtgggcttcatggtttctgactaagtctgcagtaatttcaattactgtttgcctacaaataacgtgtaattttcccctggcttctttcaagatggttttctttcattaatttcaattatgatgtgtttgggaatcatttttctttgagtttatcttgtttcagttccaccaagcattttgaattgccctgcgaacaaatttggaaaacattcagccattatttttctattttttttatctaccaattcctttgttttctccttctatgattccactrgcacaaatattagatcttttgatactgcactacagattcctgagtctgtttttttaaatattttttctactctgtttttcagcaacgataatttctattgagtccatgaattttaaattcatggactctttcatctgccatctccattctacttttgagcccacctagtgaatttttatcatgtattttttaattcaaatattgacatttgattcttttgatagtttgtgtgctgaaaaggtctatcttttcatttacttcaagagtgtttgcattttcaatatagagcatgattatgtt

SEQ ID NO: 59996 - DNA, 601 bp, Human
ccagatatccttgtaatatcatatctattcatactgaagaacttccttcagcatttattttagaataggcctgctggaaattaattcatggtttttcttcatctgagaaaatcttatatcacctgttttctaaaaaaatgtttcactagagatacaattattttctttcagcattttagaaatttttgtcttgtgggcttcatggtttctgactaagtctgcagtaatttcaattactgtttgcctacaaataacgtgtaattttcccctggcttctttcaagatggttttctttcattartttcaattatgatgtgtttgggaatcatttttctttgagtttatcttgtttcagttccaccaagcattttgaattgccctgcgaacaaatttggaaaacattcagccattatttttctattttttttatctaccaattcctttgttttctccttctatgattccactggcacaaatattagatcttttgatactgcactacagattcctgagtctgtttttttaaatattttttctactctgtttttcagcaacgataatttctattgagtccatgaattttaaattcatggactctttc

SEQ ID NO: 59997 - DNA, 601 bp, Human
agtctggaaaactcatcataatattatttatgccatgaacaatagacctgaaggaatgttgatgaagtaatagacagttttcacactttaaatgatataacaattctctcagtagataaagagatatgaaaagaaaatgtagcctagatattcatgagttcccgagaagtagctctgctttctacgcctccccagtgtgtaagaattctaggaaacgaaacccaaatagttttggaaaattatgaaattccaaatgtatcagcgggtggcatgtattttacacttttctccacccaaagcrgtttctgagcagtagaatagagataattgaatgccggtgcatgttagtataagacagcctcacctgggaaattaggtgagttcatcccatgaactcttgggatgtcgcagcaagaaagagacgaaaatatttaagagggtcctaatcttgcatattccctgtgttcagaagcaagtgaatcacattgacaacctacatgtcagaagcaaattgtatgggaaaatgtgtatataagcagttgccaaggtgattagcagataaccaagaccctatcccctcctcactctgggaatatgaccc

SEQ ID NO: 59998 - DNA, 601 bp, Human
gacaacattatatgacatcttagaaaattgctgatcagagccacttgagactgatcaccacacacattcacagtcttctcaactgtgcagagtcagaatcacaaagtggtttagatcacaacataattcagtaaataataaagtaaatggcctgtcctctaagtgaagttgacattactgagctattgtcagtagaacatgaattttgattagatgttcacagcagggatttgggggccctcaagcaaatatttctgagagggtttattcacactttgttaactgcaaaacatgtatttgyagcaaacttccatgcaatggaaagattacttggcatttacagaaaacagcagaaagggacttttcccttacaatagtttaacttattttccattaacttttgtctttctccatgttataattccttcatctacacttaaaggttcaagaaactaaataatattaaacaaataattgagtttagttttattatatatggtatacaaactattttataactccttatatacttctgataacagtcttcgagaaggcttggtaaattaatgagcagatactttagaactttttgaaatacatt

SEQ ID NO: 59999 - DNA, 601 bp, Human
aaactacctacctaggctgggtgcggtggctcacgcatgtaatccctgcactttgggaggccgaggtgggtggatcacctgaggtcgggaatttgagaccagtctgaccaacatggataaacttcatctctactaaaaatacaaaattagccgggcgtggtagtacacgcctgtaatcctagctactcgtgaggctagggcaggagaatctctggaacctgagaggcagaggttggggtgagccgagatcacgccattgcactccagcctgggcaacaaacaagagcgaaactccgtctcaaaaaaaaaaaaagaaagaaaagaaaaagaaaaactatctacctaaatgtgaatatgtgaatatctttttaagagctatttaacatacagatattttacttactccaacccacttaattcaaattaatgaaaagtttacagtaaaaaaggattttcaaatgaattacccaaatcttctaattacagccttgttaaatcaattacaaataaaattttaaaagatactttatcagaaattactgatacagttttcaagaaatgctaaggcatcactgcaacatttttcttaaatcttcacttt

SEQ ID NO: 60000 - DNA, 601 bp, Human
taaagaaaatgtggtatgcatacacaagcaaatacatgcagcattaataagaaggaaattgtgtcacttgcaacaacatggatgaagctggaggacataagtgaaataagccaggcacagaaagataaattcttcatgatctcatttatatgtgaactttataaaacttgaataaacagaagtagagaatagaatggtggttaccaggggctagggtgggggataggggttggggaaatgttggctaaaggatacaaaatttcacttaggaggaataatttcaaaatatagaatgtatgayttggtgactacagttaaaaaatgtattatattcttgaaaattgctaagaaagtacatttttagtattctcatcacaaaaaagtatgtgaagcaatgcgtatgttaattagctcaatttagtcatcccacaatctatacatatttcaaaacatgttttacaagataaatatatacaatttttatttgccaattgttaaataaatattttaaaagcaactaagaaaagaagaaaagaaagattaggaaaaaggtagggaaggagggagggagggaaggaaggaaggaaggaaggaaggaagg

SEQ ID NO: 60001 - DNA, 601 bp, Human
ttccacctggtatattttaaattaatgtattctatttagaaataattcaatctgaaaaaataatactaagccattttaaactgagttcaaaatatgtactttattttgagtcctcatttgcaaaataaatacatattttttaattcccataaggctgagttatttgaatccaaaagagtcatattggcagtgctctatggacttggagattcattttaaacatctattttgcaggttgctatgacatcatgaggtttccatctaaacttcatactggacaattgctcttttttagagttamaattccaatagtagagaaagttagatatatgcatatatatatatacacacatatatagcttgttatatatataacatattattttatatatattacttattttatatctacatatacatacacacacacacacacgcatatatatgtattagatcttttgcatatagatagtatccaaacgaatttcaacatctctgttttggcaggaattcagatttataaacagcaagcttccatctggaattatggtctatataaagtggcaaaacagattgattgatattcatttaccataattac

SEQ ID NO: 60002 - DNA, 601 bp, Human
aggctggagtgcagtggcgcatctccactcaccgcaagctccgcctcccgggtttacgccattctcctgcctcagcctcccgcgtagctgggactacaggcgcctagaggcgcccgccaccacactcggctacttttttgtattttttagtagagacggggtttcaccgtgttagccaggatggtctcgatttcttgacctcgtgatacgcccgcctcggactcccaaagtgctggattacaggcgtgagccaccgcgcccggccagtccacttctttttaatgctaaaatatttcattgyctggctataccagtttatttagccaatcacctgctgaagaacttgttacttttaggttttaaaaatttatttaaaaaaattttgcaggttttatgtagacctatgtttttcaactcacttgtgtaaataccaaggagtctgattgcaggattctgttttatttaaaaaaccatgaaactgtcttccaaagtgcctgtactattttgcgtttccaccaccatgaatgagagttgtattgctccacatcctcacgaacattggtactgtcagtgctttggattttcaccattctaataggta

SEQ ID NO: 60003 - DNA, 601 bp, Human
aaggaagatccacaagcgacagagtgaacagcaagaattctgagaaggtgggggttcagttccaaaggtgatatggaaataaaagctccttatgaattcacaaaacattaggggatagcatttgacttttcaaatttcagaatggaggctaaaccaatcccatttagatgtgacaggaagggcacttccagctgacatgtgggagcaatcaaactgtctactctcaaacaacttatgaaaataaaccacttaaaaatagggtttgtataaagtaagtggtgaagaagacatacaagtaacwaatgggtgaaactgaaatttgggtaaccagaagttggaattcagaagcggtgagcagaaacctgtggaggctaaataggacctcagattagggactcaaaattttcttacctgtcatctcatcctctaacaacactcaatctctatcttgtccctagttaaggctttcagttacttcctcctgtctcatggttccatttatcagtactcttttcagcttcacttgcctccttacactagattcccatggtcaaccactaaagcaatgttgatgttctaatctgaaaactgtcaattgtga

SEQ ID NO: 60004 - DNA, 601 bp, Human
gcagctctattcataattgccaaaaatggaaatcattcagatgtccttcaacaagtaaatgggtaaattgtggtatatccctacaaagaaatagtatttagcaattaaaatgaacaaactattgattcacataccacctccactgcctttggctaaatgaaagaagccagactcaaaagtctatatgttccacagttccactcatataactttctggaaaaggcaaaatagagacaagagaacccaccagtggttagaggagctgtctacaaaaaggaagaatgagggaatttcagagacratggaactgttcaatgttatggttgtggtggtagatgtatagctctaagcatttgtcaaaacccatagaactgtatataacaaagagaattttactgtatgtaaataaatatgtaaataaaaatataaataaaaatgaatataaaatgtattcaagataaaaaaatgcaactgataggatatgaaaagaatgaaataaagttaactatgcaaatgaaccccatcccaaagcatataatgacacatacacttacacacacacactcagagcttaaaatgtatttttatctaaacattgaac

SEQ ID NO: 60005 - DNA, 601 bp, Human
tgtatgcaattgtagcagctctattcataattgccaaaaatggaaatcattcagatgtccttcaacaagtaaatgggtaaattgtggtatatccctacaaagaaatagtatttagcaattaaaatgaacaaactattgattcacataccacctccactgcctttggctaaatgaaagaagccagactcaaaagtctatatgttccacagttccactcatataactttctggaaaaggcaaaatagagacaagagaacccaccagtggttagaggagctgtctacaaaaaggaagaatgagrgaatttcagagacaatggaactgttcaatgttatggttgtggtggtagatgtatagctctaagcatttgtcaaaacccatagaactgtatataacaaagagaattttactgtatgtaaataaatatgtaaataaaaatataaataaaaatgaatataaaatgtattcaagataaaaaaatgcaactgataggatatgaaaagaatgaaataaagttaactatgcaaatgaaccccatcccaaagcatataatgacacatacacttacacacacacactcagagcttaaaatgtattttta

SEQ ID NO: 60006 - DNA, 601 bp, Human
ttatataaaatgtttagaataagcaaatcccattaagatagaaagttgaatagttgttaggggctggaaggacaggaaaataagcactgaatgctagcaggtgtgaatgatttttttctggaatgaagaaaatattctacaactatatagtggtgatggttgcacagccttgtgaatatatttaaaaccaataaaatatacactttaaaacagtgaattttaagctaggtaaattacattaataaaaatcaatacactgatacatttgtgaatagtttcatatcttcactaatttattatyaactgagtgcaggaggaataaagcctgaaaagatatgctccagaatgtttatagtgaatatctttgggtagtgagaataaggatttttttttaaaaaattaaacttcttctttcatttttaaaaaataattgcattaactttataatccaaaaatagttaagtgaattaagttgataaattaaaaatggataaaattaaaatggccaatagaaattattagacattcgtttaccaaaaagtacatgaaatttgaccattcttcacactttgttaactcaaaatgaactatagagtaaatt

SEQ ID NO: 60007 - DNA, 601 bp, Human
gagcaaaacctgactgtaaatgcctgcatttaaaaaagaaagatctcaaaaacaaacaaaaataacaaaacaaacaaaaaacagccttccaccttaataaactagaaagaaaaatcacactaaactcaagacaagcagaaataaggaaataatagtgattatagtagaaataaatgaaatagatactagaaaaaacagagaataatcaataagaccgtaagttggttggtttgtggtaaagatcagcaaaacagatacatctttagctagaataaattatttttaaagaaagaaaatactmaaattactaaaagaatgaaaaaaaagtatattactaccaacttacatttttaaaaaagattataaggtgatactacaaacagctgtttaccaaaaaaatagattaatatgtttaataatgaacaaattcatagaaagaccccaactaacaaaactaattgctatggcctaaatacttgtgttccccaaaattcatatattgaaaccgaatcaccattgtgaaggtattaggatgggggatatcttttgccatgtgagcacacagcaagaagatactctctgtgcaccagaaagcaggccc

SEQ ID NO: 60008 - DNA, 601 bp, Human
ttaacccaatttcaaaaatggatagaataactagacagaagaccagaaaagaaatagagaacttgacaatgtgataaaccaacctgtttggacagctacagaatacttcatccaacaatagctaaaatacatagttttctctattgtacatgtagcattctctaggataagtgatattttagactatagaacaagtctcaaaataataaaaatgacttaaatcatacaaggtatgttttatgaccacaatataatgaaattagacatcaacaacataaatcaatttggaaaattcacaaaygtggaaattaaacaacgtgctctcaaaactaatgagtcaaagaagaagtcataaaggtaattagaaaatactctgagatgaatgaaaataaaaacacaacgtatcaaaacttataggatgcagcaaaataacttctttgagcaaaacctgactgtaaatgcctgcatttaaaaaagaaagatctcaaaaacaaacaaaaataacaaaacaaacaaaaaacagccttccaccttaataaactagaaagaaaaatcacactaaactcaagacaagcagaaataaggaaataatagtgattat

SEQ ID NO: 60009 - DNA, 601 bp, Human
gacttaacccaatttcaaaaatggatagaataactagacagaagaccagaaaagaaatagagaacttgacaatgtgataaaccaacctgtttggacagctacagaatacttcatccaacaatagctaaaatacatagttttctctattgtacatgtagcattctctaggataagtgatattttagactatagaacaagtctcaaaataataaaaatgacttaaatcatacaaggtatgttttatgaccacaatataatgaaattagacatcaacaacataaatcaatttggaaaattcacwaacgtggaaattaaacaacgtgctctcaaaactaatgagtcaaagaagaagtcataaaggtaattagaaaatactctgagatgaatgaaaataaaaacacaacgtatcaaaacttataggatgcagcaaaataacttctttgagcaaaacctgactgtaaatgcctgcatttaaaaaagaaagatctcaaaaacaaacaaaaataacaaaacaaacaaaaaacagccttccaccttaataaactagaaagaaaaatcacactaaactcaagacaagcagaaataaggaaataatagtgat

SEQ ID NO: 60010 - DNA, 601 bp, Human
aatgatgaaggaatttttcagcttgaaatgaagaaaactagaaagtaatttgaatccacaagaagaaataaagacctctactaatgggtaaccatacagataagtatatgaagggagagttaaatataaatgatgtattttttgtttgtacctcttttttcctacctagcttaaaagacaactgcataattcaatcattataaccttgtgttgatggacaaacaatgtatagagatataatctgtggcagcataaggactagttgagactatttaggagcacaagttttatatactattgctattatgttggtataaatgttaactagattgttatagattaagatattaatggtaatccccacaacaaccactaagaaaataactcaaaaacatattgttaaaaaaacaagatgtgtattaaaatggtaaacaaaaaaataactactcaatacaaaggaagacagtaaagaaggaattgcggggaagaaaaacagacacagacatagaaaacaaatagcaaaatagaagcaggttattttgtatcagtaatgatattaattttaatggactaaattaatggataaaaattatccaaaaat

SEQ ID NO: 60011 - DNA, 601 bp, Human
taatttctaataagaaattaggaaggccaaagcaatggccagacgtcatggaagccagaatgtacatagtcaaagcactaaagaaaataatcctgtcaactagaattctatatccagaaaatctattcttcaaaaataaggataaattagttcccagataaacaaaaattcaaagaatttgtcactagcatacttgaactaaaagaaatgatgaaggaatttttcagcttgaaatgaagaaaactagaaagtaatttgaatccacaagaagaaataaagacctctactaatgggtaaccayacagataagtatatgaagggagagttaaatataaatgatgtattttttgtttgtacctcttttttcctacctagcttaaaagacaactgcataattcaatcattataaccttgtgttgatggacaaacaatgtatagagatataatctgtggcagcataaggactagttgagactatttaggagcacaagttttatatactattgatattatgttggtataaatgttaactagattgttatagattaagatattaatggtaatccccacaacaaccactaagaaaataactcaaaaacat

SEQ ID NO: 60012 - DNA, 601 bp, Human
tgcggtgtttgattttctgttcttatgtgagtttgctgagaatgatggtttccagcttcatccatgtccatgcaaaggacatgaattcatccttttttatggctgcatagtattcccatggtgtctatgtgccacattttctttatccagtctatcactgatggacatttgggttggttcaaagtctttgctattgtgaatcattgtggcaactcctcaaggatctagaactagaaataccatttgacccagcaatcccattactgggtatatacccaaaggattataaatcattctactrtaaagaacacatgcactttacatgttttttacatatgtttattgcggcactattcacaatggcccacattcctatacagcctggtagccaccagagaaaggagaatggaactggggctttttcaacgcctcaatcctaaagaattatcacattattttacatgtctagtgcttccatggaagaccccacttaacaggctgcctcttgtcgacctgacttggatttcacccagtgtgaaaaaccttctcctcagcacccatgtaaaaaacaattacaggaaaatgttttatctttgcagct

SEQ ID NO: 60013 - DNA, 601 bp, Human
cagatgtatgaattttaaatcttggcagtgccatgtgttgtatgaatgcatttttactaaggaaaaggatcctctgaacatgagtgatatgttcaccttttctaatgtgaatgatataatatctattttaacttcaaacgtaatcattattaactactttctcatttaggagcctccaattaatgccgattcatgattctgattaattatttcaattgaactttaaaaatctcttatgaaacatgacctaatggagtgaatcagagccagagcagctgaacagtacaataccatgtaacartaagtgaagtggataatgactggcaaactgtcttacatcattcaatgagtagtgtcctaccaatttgcttgctcctttaggggacccgaaactaaagtgtcaggctaaaattgtactgttcaaagaaggaaacttaatctgtactatttaaatccagggcacagaagtaaaatcagtgaaaatggcagagaaagaacctctgaaaatttgctcttcataaaacaattttaaaactggcaaacactgtcaaaatcaacttttcaaaaactcttaatttatcaaagtttcacaacaatccaa

SEQ ID NO: 60014 - DNA, 601 bp, Human
tatgcatgtgtgtatatacatatactattttctttattcattcatgtgccaatagacacttaggtttgttttccatatcttggctattgtcaataatgttgcaatgaacatgcgagtgcagatatctcttcaagatactgatttcattcttttgaatttatacccagaagtagaattgctgcactatatggtagttctgtttttaattttttgaggaaactatactgttttccataatgactatacaaattcactttctcaccaacagtacaccaaggttcccttttctccatatcaacayttgtttttcttgccattttgatagccatcttaacaggtatgaggtgatatctcattgtggtcctaatcagcatttccccaatgattagtgatgctgatgaacttttcatatacctgttggccatatttacgtcttatttggaaaagtatctgttctggtttttgcacattttaaattgtgttgtttagactttttgctgttgagtatcttgcattttttatattaaccccttgtaaggtatatgatatgaaaatattttctctcattccataggctgtctttcaatgttgttgaattttt

SEQ ID NO: 60015 - DNA, 601 bp, Human
tgaatgtagtcactcaggaaagtcagaaactttgagtctgagccacatattctgaccatgacttttatcaagtagtattctaagtcactatttttatcaagcagcattaaattaagactcttagaactacattctagccttaatcagaattatactctctatcccaaatggtaatcaagttcttaaacattactaactggtgaaccatttggtgcaaaactccaatacaatacccagcaatgaagccttgcctgtacaaaagaatgagagcttttgtacaaaaggaaacacctcaaaatgmgaacttgacttaacttgtagttctggaggcacagaacagaagaaagctatgaagaacagaagtcctggttttatgatatttaataaggtattctaacataaacgtaaaagctttaagatcaggaactaaaagattaataattattttttctatatcacttgcagcattatttaaagcaaatgaactaaatatttttggataactacatcaaagtatttattgaaattaatcttttgactaatataactgaatcacccagctttaaatgctgattaaagtaaaaaatcaacttatacttcc

SEQ ID NO: 60016 - DNA, 601 bp, Human
taattggatagatatttgaatgtagtcactcaggaaagtcagaaactttgagtctgagccacatattctgaccatgacttttatcaagtagtattctaagtcactatttttatcaagcagcattaaattaagactcttagaactacattctagccttaatcagaattatactctctatcccaaatggtaatcaagttcttaaacattactaactggtgaaccatttggtgcaaaactccaatacaatacccagcaatgaagccttgcctgtacaaaagaatgagagcttttgtacaaaagsaaacacctcaaaatgcgaacttgacttaacttgtagttctggaggcacagaacagaagaaagctatgaagaacagaagtcctggttttatgatatttaataaggtattctaacataaacgtaaaagctttaagatcaggaactaaaagattaataattattttttctatatcacttgcagcattatttaaagcaaatgaactaaatatttttggataactacatcaaagtatttattgaaattaatcttttgactaatataactgaatcacccagctttaaatgctgattaaagtaaaaa

SEQ ID NO: 60017 - DNA, 601 bp, Human
tacatactatggctaagaactatgcttcaagcttattacaatttcccctataatagaccaagatgttgagcagcctaaatgaacactaaatatataatgagtgtatatttatgcacagttctaccagtaaacatccagtttgctataaataaaatacagttttctataattaagctaacattgatcagcatttttagcagatagaacatgactttgagggaataaatatttgaggctttcttttaattcatagaataaatggttagttagcctctcattttcttgtccacataagaaaaaytgcattataactgtagtttaccagatgttacatttactgttattagttcaattcaggtttattggttcttcaggtaatcatacaacacattttcttggtttatgttatgaaatgtgatgtagatttaggttttctcagccttctaccactctaagatctcaatcccccttttgttgttgttttttgttttgttgttttcatcaaaggctaccattaagtaaagaaggtagtacactttgtataaccatttgataggcttggctagttcaagaaataatacaaaaggaaaagtttcatcat

SEQ ID NO: 60018 - DNA, 601 bp, Human
taatttttgtattttattttattttttttagtagagagatgggtttcaccatgttggccaggctggtctcaaactcctgacctcaggtgatccacccacctcagcctcccaaagtgctgggattgcaggtgtgagccaccacgcccggatgataattctctaaaacataaaaagtaaaatacctcccttcataattgttttgaactgataacatgttgaaatggtaaaatgttgaatatattgggttaaatgaaatatgttgttaaaattatttttatctgtttttactttaaaatgactwctagaaagttcaaaaattacatctatggcttacattatatttctattggatagtgctggtgtagccatttttaatagactgaaaattctcattaggaaattctaatcatacctaaaaatgatcctcaaatcttgcaaatggtctttaaaaagaggatatcaatatacatactatggctaagaactatgcttcaagcttattacaatttcccctataatagaccaagatgttgagcagcctaaatgaacactaaatatataatgagtgtatatttatgcacagttctaccagtaaacatcc

SEQ ID NO: 60019 - DNA, 601 bp, Human
taagaactatttttttttttttttttgagacgaagtctcattctcgttgcccaggctgaagtacaatggcatgatctcaactcatggcaacctctgcctcctgggttgaagcgattctcctgcctcagcctcccgagtagctgggattacaggcacgtgccacactgcctggctaatttttgtattttattttattttttttagtagagagatgggtttcaccatgttggccaggctggtctcaaactcctgacctcaggtgatccacccacctcagcctcccaaagtgctgggattgcargtgtgagccaccacgcccggatgataattctctaaaacataaaaagtaaaatacctcccttcataattgttttgaactgataacatgttgaaatggtaaaatgttgaatatattgggttaaatgaaatatgttgttaaaattatttttatctgtttttactttaaaatgactactagaaagttcaaaaattacatctatggcttacattatatttctattggatagtgctggtgtagccatttttaatagactgaaaattctcattaggaaattctaatcatacctaaaaatgatcctca

SEQ ID NO: 60020 - DNA, 601 bp, Human
aaatcactttaaatataattgatatctgaacaaaataacagtgtatattgggatttatcacatatgtataggagaaatatataacaacaatagcataaaccaagaaggaaatagaagtattttaagctccttacatcatgtaagtggcataataattcttgaaggtagacttaaataaggtaaataagtatactgtaaaccctaaagtaaccattggtatttaactaatttttaatgtgcaggaaaaagaaggtgaaaaaaacaaataacagattgggcaaacaggaaaaaaaaaaaaaaacagcaagatgatgatggaaacctaaccacattaaatgtatatgttctaatgaacatccaattgaaagtcagacatcagattaaaaggcaagctccaaatatatgccacttacaaaaaatgtacttcacatttaaagtcacaaatagttaaccaataaagggatagaagaatatgcaccatgccaatactacaagggctaggttatcaatggaatacaaggttggtttaacatttagaaaatcaattgtcatccattgtattaacaaactaaaaagaaaaatgttcatctcaataacacaa

SEQ ID NO: 60021 - DNA, 601 bp, Human
tttcatattttggccccttcattcttctcttaggtgcctaaagtatctttctaaaatgaaaaatctgagactgtttcctcaaataattagatagatagatagatagatagatagatagatagatagatagacagacagacagatagatagaggtttgtatggggagaagaaacaaccacattttaaatgtattgttaagctcacacatatgtatgtgaaatcttcaaggaccccaaaattaaaatttaaataaatgctaaaatgaaaccagattagtgagctataacagaaaactagagcwgaggcctatctgagagcaatttcctataccaggaaccataacatctgaggactggagggagtagggagaagcagtgaagtcttggattctagtaaatttgggtaaatgtagctgttttataagtgcaaggaattggagggaaaggaataatataaaaatgactacattttcgacaatatcttcacatccatttttcagtgcactaaatctctttttaatgttatctaagcttctattgaaacaattgagttcctgcattttacatttttttctgttttattttataaatctgtctagtca

SEQ ID NO: 60022 - DNA, 601 bp, Human
tttaaagtatgtcatacatttctttattttaatctattattactaacaacactttctttcaatattttagaatgtttaagctgtaactgtgtactagaaaaaagccaatagaataaaaatttacaaaatatgtctttccaaaagttgggaaattttcaccgattcttaaaaacaattacagggccagataaactttagtctctagcttagttaataaacaatatgatattacaagaaactgtaatattttaaatattcattaatatttgtataagcttttcaaattttaaaagcacatgaygaaatgctgacagtttttatctactgatgtttcagaatataacattatagtttatctgagccagtggataccaaggaatttataagttggagtcaaagtatttgatgaaaaggcattaataaaacaataaaagaacaacataaaaatagccaacttgtaattccctctcaacaaggtatgccactttaaacaatggatcttgtatctggaactgaagtaagtaaacagactttgtctagaagagggaaaaggagaactgaaaggtatttgttttttacagaaagtagataatgtgaaaat

SEQ ID NO: 60023 - DNA, 601 bp, Human
gatagcattacgagatatacctaatgctaaatgacgagttaatgggtgcagcacaacagctagcacatgtatacatatgtaactaacctgcacattgtgcacatgtaccctaaaacttaaagtataataataataaaataaaataaaataaaataaagactgtgtatagactagtgtttaaaacctcagtttacatccttagtatctcacagcagatgggaaatgatcagaacacccatgttccagtgtgtagatgtttaattgaatgggaaagtaagtagaaaagcttttagtcttctgractggttcttctgccatttgaaaaggttagcctagcacaccaccctttgtgtatttcacatagcattagaagcctcagtgggtattgcatgctttccagctgggtctcaatgtttgcatattgaagtgctgctttatttctgtcaatgcacaatatatagtaggacattaaattacagagagtaacaaatatcttcttatgaaagctttcaaaatgaataattatcttatttgacattagtgtacactagaattaaggagactagaaaaagttaagaggtgatcttaaagaatctagaat

SEQ ID NO: 60024 - DNA, 601 bp, Human
gatagatacccagtagtgggattgccattctatttctagttttatgaggagcctccacactattttccataatggctatactaatttacattcccaccaaccttgtataatacatcaaaaggaggacaattttgcaagaaataaacactattatgtttattccttcttctccacgacctctccagcatttcttgttgtctttttgataatagccattctaactggggtaagatgttatctcctgtaggttctgatttgtatttccttgacgattaatgatgttgagatttttttttcatayacttgttggccatttgtacatcttctcttaagtgatgtctattcagatcatttgcccatttttaaatcagattatttctttttatgctgttgagttgagttccttgtatatttggaatattaattccttgacaaatgtgaattagagatttgagattagatatatgccttaaaataccaactaaagtgttacctgattgttaatttagatatgttctggtgtctttgcactgaaatattcaactttataaggtagtcatttccatagattatttttctaaggaatttccctttaaatgtg

SEQ ID NO: 60025 - DNA, 601 bp, Human
gatattttatatatgtgtacaatgtgtaatgatcaaattggggtaatgagcaaattcatcacctcaaacatttgttatttctttgttctgggaacaatcaagatcctctcttctagctatttataaatatacaatatattgttgctaactatagtcaccctgcagtacgataaaacattagaagttattcctcttatataggcataattttgtgtccattaaccagcttctccctattttctctccccttcaccctttcatcctgtagttaccactcttctattctctacttctatgagaycaactttcttagcttccacatgagtgagaatacgtggtatttatctttttgtgcgtggcttatttcacttaacacaatgtccttcgggctcagcaatgttgctgtgaatgacaggacttcattcttttttatggctgactagcattccattgggtatatataccatattttctttatccatctgttgatcgacacttaggatgatatcatatcttggctattgtgcatagtgctccaataaacatgggagtgcagatgtctccttgacattctgattttctttcctttgatagataccca

SEQ ID NO: 60026 - DNA, 601 bp, Human
gtaagtagtcgaatatttaatttaccccccaccctcgagttcaaaaacagagccatgtggaaataaatccccttgcaaagtcaaaaactgacctcaaacacagatggattagagcccagaaaagagattttagcactggcatatagaactggaaatgagatgggaaaagaaggggtttctaaacagctcgtttttacgtactatgtatcccagatatcctgacacagaattgttctactcatttgtcaaaaagtgtttatttcaggggtgcttagcagcaagagaacattcctataaatakctatatatccttctaatgaaaactagggattctacatatctgctgtaatacaagaaacacgctacttttaaaatatatttcttctgataattaaatagggcccaggacagtgttttgtagaattaaaccagctgtctgctaatagaagaggcgtggcagacggtataaaaggaagcgttttccatcctctagaccatttactctggaagatgctgagatacaaaatgtagaatggaaagccaaataaaggcaggcatggtaatggaacaaggacaaatgttggacgtctgccctctcact

SEQ ID NO: 60027 - DNA, 601 bp, Human
ccctcccccactgcaggatctttgtgactgctattatctctgcctgacatgttttttttctccagcaacttacatgtttggcttcttctcattcttcattttggtttaacacataaaacttttttggaccatcctgtgtagagtactcttctcagctcttctttatcatataacacctggcttatttctgtagtagaatttaccaaaagctggaattatattacttggtcataaatacattaatctttcttttctactagaattaagcttcatgacactgtctggcatatggtagatgcctgtaagaaaatttcattagataaatatatacctcaataaatggccctcatgcttctgatcttgtgtaagtaggggcatagggtcattaactgagatagaaaatacaataagaaaatcaaattttggataggaaaatagttcagtgagtcacaggttgaatttgagatgcctgcaggtaagatatatagaattgtccatgaagtagctcagaaaaaaggtctagagctcagagaaaagtttgcacaagataacacagatttagaagacaagaaaataagatggcagataaaacaattgatgt

SEQ ID NO: 60028 - DNA, 601 bp, Human
ggccctcccccactgcaggatctttgtgactgctattatctctgcctgacatgttttttttctccagcaacttacatgtttggcttcttctcattcttcattttggtttaacacataaaacttttttggaccatcctgtgtagagtactcttctcagctcttctttatcatataacacctggcttatttctgtagtagaatttaccaaaagctggaattatattacttggtcataaatacattaatctttcttttctactagaattaagcttcatgacactgtctggcatatggtagatgscagtaagaaaatttcattagataaatatatacctcaataaatggccctcatgcttctgatcttgtgtaagtaggggcatagggtcattaactgagatagaaaatacaataagaaaatcaaattttggataggaaaatagttcagtgagtcacaggttgaatttgagatgcctgcaggtaagatatatagaattgtccatgaagtagctcagaaaaaaggtctagagctcagagaaaagtttgcacaagataacacagatttagaagacaagaaaataagatggcagataaaacaattgat

SEQ ID NO: 60029 - DNA, 601 bp, Human
ttaaaaacttcatatccattttctttctaatcactgtaacaagaaaaacaaaatgatttaatgcaggctcaaagaaagcaagattaagaaatcagaaaggaacagaaaatgctttcctatagaagggtttccccaagaagggagatttgatgagcaactattttggatgcctgtttgtcagaatatttcccatttccttccatgccagacatgatgcctttcctcttctgattcttagtcttactaacaagttacaaggaaaggctgcagaacttcccgtgcattatattaaaatgtttaycagagtaagatcttacatcctctatcattttccatcagcagcaacatcataatctaaaatttactgagacttgccatatactgtgtgttatatgcattatttaatccccataatatcctgtaaataattattattactgttattcctattttgtagctggagaaaatgaaacagaaaggttaaacaatttgcccaagtgacactgctagtaagtcattggagcatggctatgaaccaaggcagcttaactctggagcctactttcttaactattgttctctaccttctccttgtcaggta

SEQ ID NO: 60030 - DNA, 601 bp, Human
ccaatattttattggctggtctccctttttcttatagttctctataaagtctgaatacgaatcttttgccaatttgtaactttcttcttagtaaagagtttttgaatttttgaatgaaaggatgacaagagtagctccatacttcgaaaaaataaatctgccacaaatacgtgaaagttggtcagagagatgttaaaaatgtaacatatatatatatatttgaaaaatatgagaatctaatttagacagaggaaaacaacaatgaaaagaaagaaaaatgttgaaaggtatattttataamgaatcactgatttattcaataaatcagagaaaccttgataactgagttggaaaattatgagatacagaccattcatgaaggatactaataacttgataaaacaaggcagtcaatattggcttagttgtgaatgcaggaaaactgaagtttggaattacagtcatgcattgcttaatgagggggatatattctgagaaatgcactgttaggtgatttccttatcatgcaaacatcatagagtgttcttgcacaaacatagatggcatagactactacacacctaggctgcatggtatattg

SEQ ID NO: 60031 - DNA, 601 bp, Human
ccttcaaatatatgactaagcctattacatgaagaaaatgttgagaatagtgccctcaaaaaatgtggaaggaaatttaaaggcaccaagtatagccaacacaatattaaaggagaagaataaagtcataggactaacactactcaatttcaaggcttactataaagctgtggtaatcaagacagtatgtattggcaacagaacaaacgagtatcagtagaatagaatagagagcccaaaaatagacctacataaatatagtcaactgatctttgacaaaggagcaacagcaatacaatgragaaaagatagttttaacaaacattgcggaacagctggatatgcacgtgtggaaaaaaggagtctagacacagaacttacattgttcaaaaagaaaactgaaaatgaatcctagactaaatgttaaatacaaaaaatatatacaacttttgtcctagaagataaaataagagaaaatctacatgacttgggcatggatatgactactttttagatacaacaccaaagtcatgatccatgaatgaaagaattgataagctagacttcattataattcaaaacttctgatcatgaaagacat

SEQ ID NO: 60032 - DNA, 601 bp, Human
taagggtcaatcttgtgaataataatcccagaaaataaaaggacttttattttgggaaaattctgggactagtaactttgttagggtgcacgtggccacaaagtaagaatttttaacctaaatacaagggaaaggatttgaagcctagaaagaaagattattctttcactactaaattaatcagaatagctatgatagtgttttaataggaagtaaacatgaagatttagcaagtaagatctgtgagagagatatcaaaactttgttatcatcataccctatgtttttattgatgaataawatcccattgcatgatgaagccataatttgtctttctattctccagttgatgaccatctaggttgattccagtgtggcaccctttggagaaagctactattttattttaacttgtctgttcactatatgacactctacacaatgaactcattaagagaaaatgcttagtgatcattattttgaaaatggaatacctagaattgtccctggtatatagtacgtaatcagcaaatattcaattgaagtagaatttatacctctataacctggtttatttgaagaatttccttgctgaaagtta

SEQ ID NO: 60033 - DNA, 601 bp, Human
atcattgtgtgatagagcagtaaattccttttcatagctttggggataggatgcagagcaaagaaaataaaaattaggttgagacatgctaatattcatagtgattttaatgattaaaaataggtcaaaatatttctggtgtccatagccaacaatctgtaatacatgagtatattggaaagaaatgccaaaagaataaaaatctttaaagccttcagagataagggtcaatcttgtgaataataatcccagaaaataaaaggacttttattttgggaaaattctgggactagtaactttkttagggtgcacgtggccacaaagtaagaatttttaacctaaatacaagggaaaggatttgaagcctagaaagaaagattattctttcactactaaattaatcagaatagctatgatagtgttttaataggaagtaaacatgaagatttagcaagtaagatctgtgagagagatatcaaaactttgttatcatcataccctatgtttttattgatgaataaaatcccattgcatgatgaagccataatttgtctttctattctccagttgatgaccatctaggttgattccagtgtggcac

SEQ ID NO: 60034 - DNA, 601 bp, Human
acaatactacactatataaaaataattattcatgacgagttttgagcacatattcccttttaatattaattacttaataagtttatatcattcaacctttggtaattgctgtgtttcataaatggattgcaaaatttccaaaaagttacctgttagctctcatgagttagtacaatccagctccaggatatcaacatttttatgtcattcaagatgagtaaatgacagattcactgaattcagtgacgattttatagactagttcctgtggtcaactattgacataaaaagcttcaaagarcaagaactcaaaaaactaactcatctaatgtgacacctcagggtgctatgaaaaacatagctactactgaaaaaactttacattaaagctaatttgatagcaaaactaaccaaatttgtaaatcgagttagtgatagcaagtctgtgctcaacaaaatgatgggtttatttaaagttttgttgtattatattaacacactgaaatgattgaaggaaagaaaagttaggctaaaaacgagttaccccttatttaactttacgttttctcactaattgccaattggtaagataatatacatg

SEQ ID NO: 60035 - DNA, 601 bp, Human
ccctcagcttctttaaaacacataagattataaacagcaatagttataacaatatattgttgtattttaacatatatagatgttttacatgtgtgtgtcagttttatgacttatcagccatagaacaaaatatatatcagtcacagaacaaaaaagtgggaaaaatatagctatataaaattacaatttctttacttggttgtaaccaacatactatatatctgaagtagattctgataattttgaatgtatattgtatgctcaagagcaaccactaaaatataatttaaaaatataattwaaaaagagactcatttcatagtaataaaaagttcaactcaccagacagacaaaacaacgatcaacatatatggacccaataagagactccaagtgacacacacacacacacacacacacacacacacacacatacacacacacacattgatgaagcaaaaacagaattaaagggagaaatagacaattcaacaataatagctggaaacgtaaaagctcaccttccaaagtagaacaattaggcagaagatatataaagaaatacaagacttgaacaatacttaaaatttaaaaaaaaact

SEQ ID NO: 60036 - DNA, 601 bp, Human
atcgcttgaacctgggaggtgtaggttgcaatgagctgagatcacgccactgcactccagcccgagccacagagtgagacttcgcctcaaaatatatatatacttttctactttcttccctcagcttctttaaaacacataagattataaacagcaatagttataacaatatattgttgtattttaacatatatagatgttttacatgtgtgtgtcagttttatgacttatcagccatagaacaaaatatatatcagtcacagaacaaaaaagtgggaaaaatatagctatataaaattamaatttctttacttggttgtaaccaacatactatatatctgaagtagattctgataattttgaatgtatattgtatgctcaagagcaaccactaaaatataatttaaaaatataattaaaaaagagactcatttcatagtaataaaaagttcaactcaccagacagacaaaacaacgatcaacatatatggacccaataagagactccaagtgacacacacacacacacacacacacacacacacacacatacacacacacacattgatgaagcaaaaacagaattaaagggagaaataga

SEQ ID NO: 60037 - DNA, 601 bp, Human
aacatagagaaactccatctctactaaaaatacaaaattagctgggtgtggtggtgcgtgcctgtaatcccagctacttgggaggctgaggcaggagaatagcttgaacctgggaggtggaggttgcagtgagccaagatcacaccattgcactccagcttgggcaacaagagcaaaactccgtctcaaaaaaaaaaaaaaaaaaagtgaaatacactatcccagatgaacaaaactgagagaattcaatgctagtagacataacatatgataataatgctaaaggaagttatttgggctraaggtaaatgacatcagacagtaattcaaattcacatgaaaatatccagaacaccagtaaaggtaaaaataatataatataatacaaattaatataatgtaatgtaatatattaatgttaaagacagtataattgcatatttgttcttgaatgacttaaaaggcaactggataaaacaataggtaattgatttattggaataataacatagagaaatgtaacacacttgacaataacagagaaaaggggcagaaacaaaggtgtattggagtttggagtaaggaaatgataccttatggt

SEQ ID NO: 60038 - DNA, 601 bp, Human
aattgtctattatcttcttgttatgtggacctgtttactctcaactatgatttaagcacaatacacctgtactctataagtaaaaatcaaaaatgccttcagaggttaggtctaccatataaatcagccaaatatcatgagttagacagtaaggtataattaagtcattcagaaactggaagaaatatatttaatgagcttagagctcaacaaacccaaagtttcaaaaacgcaaaaaaaaaaaaaaaagtaaatagacacagtacagtagaaattaaaaccaaaggcaaagacaaaagtyttgaaagcaccaggagataaaagacacatcacatataagttaaccccaattacaattaacttcgcaaaagaaacaaaggaggtcagaatgcaatgggatgaaatattcaaattgctaaatgtaaaaaactgtcaacaaggaatcttatagccagagaaacctatctttcaaaaattaaggtgaaggccagatgcagtgactcacacctgtaatctcagcaatttgggaggaggcagaggggggtggatcacctgaggtcaggagttcgagaccagcctgaccaacatagagaaactccat

SEQ ID NO: 60039 - DNA, 601 bp, Human
ttgtctcaagaaattggaagttcagtgtttgtcaggataatattaaaatcacatatttgtggaggaaaattgtctattatcttcttgttatgtggacctgtttactctcaactatgatttaagcacaatacacctgtactctataagtaaaaatcaaaaatgccttcagaggttaggtctaccatataaatcagccaaatatcatgagttagacagtaaggtataattaagtcattcagaaactggaagaaatatatttaatgagcttagagctcaacaaacccaaagtttcaaaaacgcaaaaaaaaaaaaaaaagtaaatagacacagtacagtagaaattaaaaccaaaggcaaagacaaaagtcttgaaagcaccaggagataaaagacacatcacatataagttaaccccaattacaattaacttcgcaaaagaaacaaaggaggtcagaatgcaatgggatgaaatattcaaattgctaaatgtaaaaaactgtcaacaaggaatcttatagccagagaaacctatctttcaaaaattaaggtgaaggccagatgcagtgactcacacctgtaatctcagcaatttgggaggagg

SEQ ID NO: 60040 - DNA, 601 bp, Human
ggtataattagaaactttagattaatatattactccattttgacactatatatttcgatatctagcagttaattaaatctgctttttacaaaatttatgacaaaaacatcatatacttccatttttaaactttcaagggcattagatctattacaataacacatatcttttaatattctatcctggaaaattaagaaatacatacccttcaggataaatacattgaatataaggagacataagaaaagtacataaaatattcctcatgactttattattactatgaactagaaaatacctmaacatattaatatgatttgatggaaaataattgttgacagtagtggtagtataaaagttcttatgttccagtccataattcatatgctatgactcattgaatatataatattcataatataatatataatatatgtccccatttgtgggcatttgattgggactaccacatattatacatttttaaaggcaacaatatgaaaattctagagacagttttaaattatatgaatagactagtgaacatacaaccaaaataattatagtttaaatgttgggcatgaccatcatatggcctaat

SEQ ID NO: 60041 - DNA, 601 bp, Human
tttcaaggaatgatatactgcagatagaaaaaacaaatgcattcaaaagttaatccaacattaaaggaccaccatttcctgcagagtgaaaacatagaaagatttgcaaaaaggcaaagtaaataaaatgaccactagatctattgataatattgttaagacagtatgatacactttaatgattagttatataagtatggtttcttggccatgtaggaaaaaggagaaaaagaaggtcaataaacataatcatcatgcatgctctataagctaatgtttaagaattagaagaaatcttaarcttaatgggaaccattataattgcaatagttatctagctaatcctacctatgactagccaaattcagcattagtattaagaattaaagtctggcccaacagtctatggccttaatagcactaaaccgttctatttcaaatcacattttagttttatgcctcattaattgaacacttacatcaaattttaacattagacttaaattcattgtagagtcacatgcacagtttcactggcattgcaagcagttctatattttgtttctttcctataatgaattattactgcataaaaaggaaa

SEQ ID NO: 60042 - DNA, 601 bp, Human
attgtggcctatgcacaaagaggctacatgaattgttcagaattcttgagtttgactttagtgctacttttccacaccatatggctgcaaatttggttaattagtcccattataagttgacaaaaattctgggaatttttacatgacaaactagcagaaactggtgcaagttagaatattctatttagcaatagagacagtgaaccaatagatatttataaaaagaactaggcaaaaaataatgctaactagggttttaaggttaagtgtcctagatatgatagtataaatattttctttrttaatgttcggagtaaggctgtagagattctacatgaatatgttactattctacagcatatctctggaaaggaatattccattcatattaaaagcatttttttaaaaaaagagacaattttatttttttccagaaaattaatttgaaattagtttaacagatttaatctttgggaaaagcaaatgaaataactgaaactctcacgagtttcatttggcaggagagctcctaaacacaagaactctggcctttcctcatgctttcttataaacccaaaccgtggacttccagggatagtga

SEQ ID NO: 60043 - DNA, 601 bp, Human
gagaccagcctgaccaacatggtgaaaccccatctctacttaaaatacaaaaaaattaaccagccatagtggtgaatgcctgtaattccagcaatttgggaggctgaggcaggagaatcacttgaactcgggaggtggaggttgcagtgagctgagatcatgccatttcactccagtgtgggcaataagagcaaaactgtctcaaaaaaaaaaaatcagacaggtcctatgctaactgggaggtcaatagattgctctatgccaataactcacattttctttctatctcactcctgacttragttaaatttagctagagatgagagacagaaacaagtatgttaaatgatcatataaggtatcaatgactgctggcagcttaattgattctccaccttctcttgcctaatgatatttgaattttatataaaaatacaggggtcaatggtttaacccaaatagattgagttctaattgtaaaacttgaggcactatgacacagaaggaaaatgtgcttgagaccaaagacttcctggcatgaatcaaaaaggtatgtagataaacccctatttcaatactgttaagatctgcaaactctaca

SEQ ID NO: 60044 - DNA, 601 bp, Human
actcatataagaatcaaggcttgatgcgatggctcatgcttgtaatcccagcactttgggaggccaaggcaggcggatcacctgacgtcaggagtttgagaccagcctgaccaacatggtgaaaccccatctctacttaaaatacaaaaaaattaaccagccatagtggtgaatgcctgtaattccagcaatttgggaggctgaggcaggagaatcacttgaactcgggaggtggaggttgcagtgagctgagatcatgccatttcactccagtgtgggcaataagagcaaaactgtctcaaaaaaaaaaaatcagacaggtcctatgctaactgggaggtcaatagattgctctatgccaataactcacattttctttctatctcactcctgacttgagttaaatttagctagagatgagagacagaaacaagtatgttaaatgatcatataaggtatcaatgactgctggcagcttaattgattctccaccttctcttgcctaatgatatttgaattttatataaaaatacaggggtcaatggtttaacccaaatagattgagttctaattgtaaaacttgaggcactatgacacagaa

SEQ ID NO: 60045 - DNA, 601 bp, Human
aatatactccaacatttttaaatattttgaatagacatagttcccctttttttgaaaataaagatttttctgtggagtttgctgagacttcttcctcatcttgatgacatgcttcttaacttctaactgtcaaacacataccaaacgctattaggtgtgatgccacattaggactcatataagaatcaaggcttgatgcgatggctcatgcttgtaatcccagcactttgggaggccaaggcaggcggatcacctgacgtcaggagtttgagaccagcctgaccaacatggtgaaaccccmtctctacttaaaatacaaaaaaattaaccagccatagtggtgaatgcctgtaattccagcaatttgggaggctgaggcaggagaatcacttgaactcgggaggtggaggttgcagtgagctgagatcatgccatttcactccagtgtgggcaataagagcaaaactgtctcaaaaaaaaaaaatcagacaggtcctatgctaactgggaggtcaatagattgctctatgccaataactcacattttctttctatctcactcctgacttgagttaaatttagctagagatgagagacagaa

SEQ ID NO: 60046 - DNA, 601 bp, Human
ttatttcaaaatatactccaacatttttaaatattttgaatagacatagttcccctttttttgaaaataaagatttttctgtggagtttgctgagacttcttcctcatcttgatgacatgcttcttaacttctaactgtcaaacacataccaaacgctattaggtgtgatgccacattaggactcatataagaatcaaggcttgatgcgatggctcatgcttgtaatcccagcactttgggaggccaaggcaggcggatcacctgacgtcaggagtttgagaccagcctgaccaacatggygaaaccccatctctacttaaaatacaaaaaaattaaccagccatagtggtgaatgcctgtaattccagcaatttgggaggctgaggcaggagaatcacttgaactcgggaggtggaggttgcagtgagctgagatcatgccatttcactccagtgtgggcaataagagcaaaactgtctcaaaaaaaaaaaatcagacaggtcctatgctaactgggaggtcaatagattgctctatgccaataactcacattttctttctatctcactcctgacttgagttaaatttagctagagatga

SEQ ID NO: 60047 - DNA, 601 bp, Human
cacgctggagtgcagtggcgcgatctcggctcactgccagctccacttcctgggttcacgccattctcctgcctcagcctccccagtagctaggactacaggcgcccgccaccacgcctggctaatttttttgtacttttagtagagacggggtttcacagtgttagccaggatggtctggatctcctgacctcgtgatccacccgcctcggcctcccaaagtgctgggattacaggcttaagccaccgcgcccggcctgatttttaaataggattaagtttgctagataaaatataagamacctagttcagtttgaattctagataaacatacaatattggagccaaacgtattacaaactattgtttatctgaaattcaaatataactggttatcctgtgtgtgttaaatctagcagccttaaagactatatttatctaatatgaatgaaaatattggcttgagtctgaaggtaattttaactttggaaaaaattgttatgtcaggaaaatctaaggatataccaaaagcagaagtgatagggtaggtggaagcaattattggagagtctgcaggcagcttgaaatcatagtgcctatt

SEQ ID NO: 60048 - DNA, 601 bp, Human
ctctatctgaggaaaataaatctaggctctatgcatatcttcaattcaaggaacatctgtctttttctgttttatatattgaatatctttgcatttaggactttacaaggtatgcaatcactgtcacatttgagcccaagtggaatataatgtgataacttacattagctatgactttgatagttttctagatgtgttataaaattgaaatgctcagacaataattttcttttctattaaaatatattttaacccatttgtccatgaaaaaggattagcagtgtacatcattgtactactrcagaggaaataattaatttgcagagatgtgtaaggaaacagtcttgcaaagataaagacattttcaactacatatttatttattcagcaaatatctattgaatgcataggcaccataattacccctgaatactactcaatatggttctacagcattaatgtgcctggatatatcaaattattggaattatctattggtagttatttgattagtttcaaagcaactctgaaaaaggctttaatcaggactcaaaaagaaaactctcagataaaaagttcttgtctagcaacaatcagttag

SEQ ID NO: 60049 - DNA, 601 bp, Human
aaatattacagtctaagtcctttaggactggaattcatcagtaaaacagaaaataatagattaaattatttccataaattagaagtagaaatgacctctaccatccaaaaagtatagtaatacttccatataaaagtaatttaaccacagcctcttttgatggactgaacaataaaatcagcctctggagcaataacagcacaacattagtgatccagtgacaaacttatccacctgcagaaagctcaatgatcaagttctataaagggcatggtttcctatcttccatctgtgggttataaaaaaaaacaagcaaactcttgggaataccttactgaaaatcccacggacaaatatacttgtctacttgccaatgttctgcttttcggaagaaaaaaatggtactttaagaagccctacaactataaagccaaatactggccattcctgagtattactagccttcgcctttaacacaatgcagttaaggtaaacttataagttatccaaaaatctgaaattttaaaagcaatcacaagcaatctaatttgcaaaactcatcttgtaaattcaataatatataatactaaagttttttcac

SEQ ID NO: 60050 - DNA, 601 bp, Human
gtggggactgccagagtgtcacaccctatgcaaatgacacacctagtcctaataggttttttacgccctatgtagatgaaatactccctccccagtaacttgcttataaaaacccttgcatttccctgaagaacggtaaccctttttcggggacttctctctgcagcagagagctgttctctttactttgcttattaaatttctgctctaatctcacccttggtgtgtccacgttcttgatttccttggcagtgagacaaagaatttcagtgtcaccccagacaatgaggccatttcagamttatctacggttgtggagtgggggaatttggcacaaggtacatttttcataacttaccacttgtaaaggccttaattcatttgagtattgggaaacatggatagtgttttcagtgtaaatattacagtctaagtcctttaggactggaattcatcagtaaaacagaaaataatagattaaattatttccataaattagaagtagaaatgacctctaccatccaaaaagtatagtaatacttccatataaaagtaatttaaccacagcctcttttgatggactgaacaataaaatcagcct

SEQ ID NO: 60051 - DNA, 601 bp, Human
tacagacacgatctaccatgcacaactaatttttaaatttttgcccacccccctcccccttagcacatgcacagtggggaaaagataagcaacatggaataacttaggctaaagacctgcctgggcaataaaaggttggggtggggactgccagagtgtcacaccctatgcaaatgacacacctagtcctaataggttttttacgccctatgtagatgaaatactccctccccagtaacttgcttataaaaacccttgcatttccctgaagaacggtaaccctttttcggggacttctctytgcagcagagagctgttctctttactttgcttattaaatttctgctctaatctcacccttggtgtgtccacgttcttgatttccttggcagtgagacaaagaatttcagtgtcaccccagacaatgaggccatttcagacttatctacggttgtggagtgggggaatttggcacaaggtacatttttcataacttaccacttgtaaaggccttaattcatttgagtattgggaaacatggatagtgttttcagtgtaaatattacagtctaagtcctttaggactggaattcatcagtaa

SEQ ID NO: 60052 - DNA, 601 bp, Human
gtgtaattagcaagtttcacatgcatacagtgggtcccagtaagcactgtgggccctagtgagcacattcctttccttttttggacatacaccagtaaggaagctggaagcttgcatgaaggtggtgcatgcagctgcaccaatcgaaagaactaccttgggccagtcacatccaccatggccaggcacgtcacccaagctggagtggagtagcataataatagctccctgcaacctcaaagtcatgggctcaagcaagcctcctgcctcagcctccttgactagctggactacagacacratctaccatgcacaactaatttttaaatttttgcccacccccctcccccttagcacatgcacagtggggaaaagataagcaacatggaataacttaggctaaagacctgcctgggcaataaaaggttggggtggggactgccagagtgtcacaccctatgcaaatgacacacctagtcctaataggttttttacgccctatgtagatgaaatactccctccccagtaacttgcttataaaaacccttgcatttccctgaagaacggtaaccctttttcggggacttctctctgcagcaga

SEQ ID NO: 60053 - DNA, 601 bp, Human
tgatgtgaagaaaagggaagccttgtacactactggtgaaaatgtaaatcaacccagccattatagaaaacaatatggtggttcccctagaaattgaaaatagaactgccaagtgatccagcaattccatttctgggaatatatccaaaggaaatggaaatcattatctcaaagagatatctgcactcctatgttcattgcaaccttattcacaatagccaggatatggggacaactaggccaggtacggtggcccacacctgcaatcccagcactttgggaggctgaggcaggtgaatcrccagaggtcaggagttcgagaccagcctggccaacatgatgaaaccttatctctactaaaattatgaaaattggccaggtgtgatggcaggtacctgtaatccctgctacttgggaagatgagacaggagaatcacttgaacccgggaggcagagtttgaagtgagccaagattgtgccactgcactctagcctgggtgacagagtgagactgtccccccccaaaaaaaaaagatatggggacaatataagtgtctactgatgaatggataaagaaaacatgatataaaatatatatcaa

SEQ ID NO: 60054 - DNA, 601 bp, Human
gtcacttgtattcaatatggtactagaagtcctagtcagagtaataaaaagttagaaaatgataagccatctaaacttgaaagaaagaaataaaattttctttgcttacaagtgaaattatcttatagacagaaaatcctaaagaccccaccaaaacaatgttagaacttataaacaaatccagtaaagttgcaggataaaaaaatcaggatacaaaatcagctgaatgtttatagataacaatgaactatacaaaaaagaataagaagacaatgtcatttaaaatagcatcaaaaataamataaactagaaaaacaattcaatcaagacgataaaagagatatacaatgaaaactataaaaaagaaagaataatctctgacaaatataccaagaacacacaaagagaagggataatctctttaataaatggtatttggaaactggataaccaaatgtggaagaaataaattggcccttgtatcacaccttatacaaaaataaacttaaaatggattaaagacttaaatgtgtgcatatgtgtgtgtgcacacatagaatgtgacaacccatagaatggagggaattatttgcaaaccata

SEQ ID NO: 60055 - DNA, 601 bp, Human
ggaaaatgatcagaacaattctaaactattttgtgaaaaattttatattatttaataagaaaatatatatataatttaggttctcattcattttctctctctttccctataaacacacacagcatatatgaatttgaatcctatttttctgtttttacagagggaataaacacttctaactgacttatttcattagagatcattattttcttactctctgaagaaatattttatactaattcagaagaaaaagtctataatgcatgcttcatccttatattttatatttcaaagcatatcragttatagtccattagaactaatgcgtctgaccagtaaatttattatcaagtaggattttaggtaaaggctccattggtttttctagatttctattaaattttttatctactttataaaagagaaatatttcattgaaagataggtaagtgctggagttggagagacactccattggcttccacggtcctgatactttctgaaatcttctcttttccccatgctaatgaagcacttgtgtagaaaacccttcaggatagatttatcattgacctgaatcaatcctatgacttgtctagca

SEQ ID NO: 60056 - DNA, 601 bp, Human
aaataaggaattggtagatttaaaaagacattgatagaaaccaatttccttgctgaatatatctaaaatagcatgaaatacatataataaatgaaaattaaaacatgattacagggaaaaatgttatttgccacagctgaaactgtctttcttctaagaatgggcactgaattactttgtaagtggatattcaaaattcactgcctcctacttgaataaatgagatgatctgacttgttgaactgtttcagtctaccacgtttttataaaaatgtgagatacaaatggccattatgaatamaattactttaaatctcactatttgacactgcagctacctttatgatctgttccatctgggtttaaatgcattcttttctggcactctgagcagctcattagaaatcgtgtcaccgcttctcttggtaggaaggcatagctctctgaaatctgaaatgattcacaaaatacaggtgttattatataagctcactgagcatgatttaacagaaatgatcattgtatttccaaataagacacgttattccataatggcaggaagcacaatgaaagcatgcattgcataccatgcatcatttca

SEQ ID NO: 60057 - DNA, 601 bp, Human
aaaccatacatatataacttagtccctgctttgacatagcttcaaccaaaatggctagctaactagaatcctacagagtatttaagaaatatgtttttagtgtctatacatgcagcatgttgctaaattttcactatacaaattaaataggataacttaaaacatcaaaacacttctaattaagaatgaccacagattgtctctaggaaatgcacagaagtaaataaataatatatagaatagcagttaattaaaaaataactttaaaatttacataaggtttgaatgatggagaaatgayaatacttgaaatacccattaactctacttttctgattgccatgcaaaatagccttagtacttaaatttccttagaatctcaattatttcggatactttactgtgaacttaccccctctgaactttgtagcactttaccaaggccagctcagtgatggtctactaaggaaaatgtagctttcttgggaacaaacaaattcccacataacactaagacagaggtgttaagcaggggctctgtattgtggactaggagtttctgctcacttttcccatctgtgcaactgtggtgagattcatt

SEQ ID NO: 60058 - DNA, 601 bp, Human
ctatttccattcgcctacctctatctgatccctcctgtctgtgctccattctaaggccaacttttccaattttgtacaagaaatcctacctattaatgccaaggatattgcttcatcaattctccttcctcttttctaaatcattattttcctctgctacatgaatctcatcaacatgtaaatatgctataatttctctgattttagaaaaaaatatataataaaaaactcctgttcccatgctccctccatctcctacctctttcccctgctccccttcatagcaaactcttcaatggccttgctgctgtcatcctgagcaccccataaaaactgctcttgtaaagaacaccattgacttccaccaggctaaacacaaatttaattttcagacttcagtataattgacttatcacttgatttgacataatacattactgtagacatattgaaaaacctttttccagttttattctagttcacaaactctcctgcctctcctaataccctgggtgctctttctcagtatcctctgttggttcctccctatctgccagatgttataacattggaatttcccaaatcaaagttattgggcttt

SEQ ID NO: 60059 - DNA, 525 bp, Human
aaaaaaaaaaaaaaaaagacaactacgcatgcttcggtccctgattacttcagtgtctctggaaacatcctgacctgtcactttcatgaactcttccctaatgatctggtcttctacctttcttcaaccattttgctctcataatcatgttctatgcatttcattaccagcaactgcacatcctccaaaaccttgattttaagcatctcactctctacacaacakctcaaatttcccagctcacttgctctagtattgcatgtattctagtattccgatgaaatttctatcccactgatatttatcaccccttgattctaaccctctaacccttttgcattgacctcccctgctctcgccccacctctctcatgatctcacttatattcttatgtggctagaattccatggcttgtcattttaatcatacccttatataacacttctattcttttgacaagacccaaaatgtgagtaattctctttttcccttactgtcttctacccatgcccctatatagctgg

SEQ ID NO: 60060 - DNA, 416 bp, Human
aaaaaaaaaaaaaaaaagacaactacgcatgcttcggtccctgattacttcagtgtctctggaaacatcctgacctgtcactttcatgaactcttccctaatgatctggtcttctrcctttcttcaaccattttgctctcataatcatgttctatgcatttcattaccagcaactgcacatcctccaaaaccttgattttaagcatctcactctctacacaacagctcaaatttcccagctcacttgctctagtattgcatgtattctagtattccgatgaaatttctatcccactgatatttatcaccccttgattctaaccctctaacccttttgcattgacctcccctgctctcgccccacctctctcatgatctcacttatattcttatgtggctagaattccatggcttgt

SEQ ID NO: 60061 - DNA, 601 bp, Human
aaactcagcaagaaatgtaagaaaaaagtatcttacatgtaaggcaaggaagggttaggcctaggttagaatatcatcaatatatcatgagaaagtgcttttccctaagagtatataatatttggagttattctactgcatttgattaaaatcaatatagatttatatcacagcagttgtgccatagccaaagacctgcagcttgcaacttcagtcaagtaaacaatgaatttgcatgatgagagacatcctctacattctctatacaccctctacattatctatattccctaaaattatagactaagacggcaaggagatacctaagttaaatgcataagcaaattaatggagtgatatacattactaagaatatttcagttactctatgatcttggtactatacaatggccattaaaaaaatacaaaatctgaggaatgcctactcatgttttagaagaaaagagaaaatttatatctaaatcagaaaaacttcattcttataatatttccaaataaatcgcttttctactacaatagctattttagcacgtagcaattaagatactatcttaaagtcactgataatcaatgcattcct

SEQ ID NO: 60062 - DNA, 601 bp, Human
gggcaacagagcaagactccatcttaaaaataaaataataaaacaaaataaaacaaaagggcttgacagaaggagtttgcccctctttggatcctgccaccatgagaggatatggtgttccttccctcgggaggattcagcaataatgcactatcgtgggagaacaagctcttccagacactgaacctactggcacctagatcttggactcccagatcttggactccagaactgtgagagataaatttctgttctttataaatgactcagtctcaggtattttgctgtagcagcagaaacrgaaaaagacataatcaatcgaggcattttaaagaagatatttatcaaattatgtttgtatgtagattctaataatccagtagagtggggaaaacctctgatgcaggagaaagaggacggatcactgcaagagaaaactcagcaagaaatgtaagaaaaaagtatcttacatgtaaggcaaggaagggttaggcctaggttagaatatcatcaatatatcatgagaaagtgcttttccctaagagtatataatatttggagttattctactgcatttgattaaaatcaatatagatttata

SEQ ID NO: 60063 - DNA, 601 bp, Human
tgtttgtgtgtgtgttctaaagtccagtgtgtgcagtgttcatatacataagactgaaaacagactgtaaaatttcttagagtagaataggagcattttcaaaatttacaaaagaactgtcatatgtggcaattgtcataactaagaaagcagagctaattgaaacacatacaaacacatacatatactaggaatgaacttacatgctattcctcattcaaaaagtaactcagaagttactggtcacaacatttgagcatgaagtgcaccaatgtgacttaatcccctttagacctattgycattttggcactccagaacagctaggtagaatagtaaagaatatcttcacaagcatagtgtggagcactggttcccatacttacatcccacacaattgtcttagtcatcccatctgagatgggtcccatgaatctgtatttttaaaataaattcccaatgtaggagtttcaggaggccagtttagcacataatctgaattaggatataagaaaaagtgaaactccaacagttatatctgttaatgtacttatttatctcacaatcagattgctattttttgttaacttactcccctctat

SEQ ID NO: 60064 - DNA, 601 bp, Human
tgagtctaagggttgagtgcatttcactataaaagtaagcagatggggaagaaatttcaaaatactatttcaatttaaaaagtatttatattttattgtatttcaaatactgtgtgtggctccaaagagaatatgcaaggatacataagatatactttgttttttgtccccaaagcactcccagtcaagtggagaaatgagactggtaagaaaataattacactgtaaatttataataattataatgaaatatcctttcaacccctttcttcaatactttccaactgttctttctttatawcacccacaatctaactaggatctctataaacctagtaaataaagattttcatggccaatttacccctacgttgtagttgatttatctgtctgcacagctggcatgcaacaccagcttcaaagccctactaaacactgaaattgctttgcctaaaggctaaagctgtttttaaaagaagtagtagctagctgacccaaattagtacaagaaagttataaaggaacacagcatggtgttcagtttacggtaagagtttataaaggctagccaggtgatagtaaaaacaaaaacaaaaataga

SEQ ID NO: 60065 - DNA, 601 bp, Human
tctaaggaagggccagctgggagaaaaatgggggtgtctccattgcttttaattcctttctctagtttaagaaagcactaaaccagtttagagatgtacagaaaatgagacaagataaaatgttaggaacaagaaagagaaccctaacagggtgaacacacagatggttctggaactataataaagtttagagagagattatctaaagcttctcatttacaaatatagaaaaggttgtccaaagttgtcaataatacttaaataatgttgcagaactagttactggccgagctagtgtcartatttatggctgagaggtcttttatgctgtcttcttaatggattcactttaacataccaaagctactaattattttattgcttcatagtagattgtggttgtagataaggaagaattcacaggcctcaggaaccccaaagtaagatataaaaaagacagaatattcatccatggacgttgttgttgtttctttctgtgtggttttcttttagcagtcaggcccttcttccttagggctactgcggtttgttgggggttcactctggactctattcacctgggtccctcttgcccctggag

SEQ ID NO: 60066 - DNA, 601 bp, Human
tgcactaaactccactgtccctatgttgataacctgatttctcttgtttgtttcatcacagatttgaataaagacagggctaagcagtgatgagttgcacgttttattctgtatggcaccaggaatgattctccctaacattgttacaccataacaataatgacatgttagtgaattaacctcatagggagagatgggctgactgatgatatgtgactgccagaaaccctcaaaatttctaaaatgtatatgaacatttaaggttgccaaagacataacaatgcagtggttgaaggaaatyccaagaaatactccagtacctcaaaacctcaggaaatattttatgaaaagtgattgagtggaaattaaaaattattgttgaaacagctaaattttgctctctctctctgtctttatatatacacatacccatacatatatacacatgtacgttcaagatggattagggataagggttcttatgaatgagattcttcatagaggaaaaagaaggaagtgatgatttcacaatattttggcaatatttgtgagctttcatgttgactatagtttcttgaaaatggagtggcagattgggagg

SEQ ID NO: 60067 - DNA, 601 bp, Human
aaagcttattcctcaaacagcgcctagcgttcagtaaacagtcaagaaattttagttctcgtcatcatctgtcctttgagttagaaatgccttttaaaaataatttgattttatatggttgaattggatgagagtttatatggtttttattgactctaaaatagaatcatgcacacaatattttagataaacaaactactggttctgctggcatgctttaagagagtaggcatgtcctcacagagaccactttagaaccccacatcaccattcagtgcactaaactccactgtccctatgytgataacctgatttctcttgtttgtttcatcacagatttgaataaagacagggctaagcagtgatgagttgcacgttttattctgtatggcaccaggaatgattctccctaacattgttacaccataacaataatgacatgttagtgaattaacctcatagggagagatgggctgactgatgatatgtgactgccagaaaccctcaaaatttctaaaatgtatatgaacatttaaggttgccaaagacataacaatgcagtggttgaaggaaatcccaagaaatactccagtacctcaaa

SEQ ID NO: 60068 - DNA, 601 bp, Human
gtaatagtacctcaatgggtaaaaaaacagttttcaaaggaaaaagccaaagtatctagtctatctggaacttatttataaaattttcatacccagaataacattctgcagtcttctttttaagaaattagaagatggccctttatctactgatgcaaatgcagaagctggcctatttacagattcacaattgttagacagaaaatatgcctaagtggtaactgattctattattaacttctcaatttactaaacataagttctcaggaccacaatatcttttaagtacttttaatgaatkttattggtctagtttctttatttccacaaatgcaagtaacttcaattaataatattaaaacttcttttgaagtttggcattttattttgaaaagtttgctcacatttgtgtaggactgaacatatttgataagtctacttaactataatctggataatttccacattatacacattttaatattcttttaaaatattttattagattgaaatgactatcactattatataatgtatgttattttaagacatgtgacttgtataattgatagctgaaaatagcctatttttctgaatgctt

SEQ ID NO: 60069 - DNA, 601 bp, Human
ttttaaagatatataactatgctattaattttaaaatatctacttaaacactcaaaagccaagcaattgattgttgtttctttctataccagacttagcctaagggctgttcattgggaaaatcctgaattctgcttaaaggagatgtggtaagcagaagtaaaaggcattgaaaaacaaagcatacctaataccaaaatattgccccatttgtaccacaacaatttagaaggcacgaggccttgacacatcctattgcttctgccttacatgttcttgtgccttttgtcacctgtgatgkgtcattcatcctctggatctctgtcccttacattgagaagcatttgcagctcctccatcctcaggtcaaactgtagccactgctagactctctcataagactcctcttccagtttgtagttatacatatattcctatagttatctaatggcctcacccctgcaaccagattacatatcatctgcaagattgtgggcctcttctattttgcacactgctgaatctccagccctgcatatagttctggcacatagtaggtggtcaataacattctgttgtaaatgactttattatctaataa

SEQ ID NO: 60070 - DNA, 601 bp, Human
tagaggacagtcaatagcatagagtatatctgtgagtaaattacagaagggctgcctatttacgaaaggtgcttcctctggtcagatgaattatgaaaaggttccctctcccctacgcaaatgcagcttcccactagcaaagttggcttggcaaagcagaacatgacctagaatgggcctctactttctccatggttagcagctttgtagtgcgcacaaactttttcactttattatacccatacggagcggccaggaggaaccatttctgacatccaccaaatccctcacattggcagtrgcctattctacttactccaaaggtcatcctgaatagtgtaaatgattatctaacaatgtgacaaaaaatactgcccattaactggactgagcaaaagttacccttagacttgaaagaacgatgaaaatgatattcctactaagctttgaaagctgggactgttcaaagtactgcagttgcaggagaccctcagactggagggtgtttcttagtgattcaaatgtcacctgagtcccactccaggaacagaagtcacttgaacaatttgtactgagctcctcctatgcgtccgagttcaaa

SEQ ID NO: 60071 - DNA, 601 bp, Human
agacaaaattatgaaaagtcaaaacacattctcttatgttcctcttcctccaatttgaaaagttttcacatggataactgttacagctggaagacgagtacattcatatattctagtactttctttgagtgcatttgaatttttgtatatgagttgtatgtgaaatatatatatatttccataaaagcagaaaacaacctctaagttcctgcagagccttcccagttactaattggtcatttcattttaggtgttcatttataattgctaaggctttatttttttgtggggggagtataarttttttataagaaagaaaatataagaagtttcagatccccaagttatgatggtaaaaatttaaatactatcataggtgaatgagagacactttaatagaggacagtcaatagcatagagtatatctgtgagtaaattacagaagggctgcctatttacgaaaggtgcttcctctggtcagatgaattatgaaaaggttccctctcccctacgcaaatgcagcttcccactagcaaagttggcttggcaaagcagaacatgacctagaatgggcctctactttctccatggttagcagctt

SEQ ID NO: 60072 - DNA, 601 bp, Human
tgaaattcacttatgtttcatatacaccttgtatacagagcctgaagttaactttacccaacattctaaatcattttttgcattcaattttatgtacattgaacaattttattaacctttgtgggtgtgtgtgagagaatctaggagtgtgcagaaaatatatattgccactgaatagagccaagggtcttttttccctctgagaatactgaagaaattgtgttgggtgcatgcattttgactgtgatttgtcacatgaggtcaggtttggaattttccacttgtggcatcatgttggcaytcaaaaatttcagacttttgagcattttgggtttcatatttttggattaggaatgttcaacctatgtcatgtttatcacagttgaacaaaagtggggaagaggctacactccatgtaaatcttactgcaagtcatgacattagagacacggtcaaggtgagacaaaattatgaaaagtcaaaacacattctcttatgttcctcttcctccaatttgaaaagttttcacatggataactgttacagctggaagacgagtacattcatatattctagtactttctttgagtgcatttgaatt

SEQ ID NO: 60073 - DNA, 601 bp, Human
tttttaatattacatattaatatctgagattgtaaattatttatatgcattatttcattaaaacttaaattaacaatgatataagctcattatagaatttttgaaaaatacaaaaagtctaaagaaaagaaaaatcatatttaatgtattttagagataacactcttcatattgttgtggtattatatataaccttgtgtaataaacacaaacaaaaaatacatacactaagaaatttgcaagtttttatattgttttacttaactgataacactttgaattgtcagtttttatagtatcyattttttatgcttatctaaatttataagcaatatatcacaaatcatgaaactaatgcaagcataaagaataataaaaatgtgttttataatggggaagaggaataagtttcatagcccaaggaagatgatatttcacgagtaccaagaattaagggaatattagggcacagtgtaataaacagatagatacttttttggacttttctcttctggttatcaaacaattttaataaaaatggttcttaagagaataaagtagtatttctgttattgttccaatacaaaatggttttactttt

SEQ ID NO: 60074 - DNA, 507 bp, Human
tggatataccaaaaaacatgatttgatcattacacaatgtatacatgtatcaaaatttatattgtacccactaaatacgtacaaagattgtgttaatttaaaacaaaatagtgaacaaagctcttttagtaaacaaaaagtaaaataatatggtgaagtatgaattcaaaacttgctataatatagatacatattgaaattcccagacaaccactaaaaaaatagagtttaaaatactcccgttaaaaggcagagattgtcaggctgaagatatacacaaatagacagacagacagacagccacacacacacacacacacacacacacacacagatgatccctgacttaacgatggttcagtttataatgttttgactttgcagaggtatgaaagtgatgcagattcagcagaaaccatactttgagtatctatacgaccattctgtttttaactttcagtagattattcaataaactacatgagatactcaacactttattataaa

SEQ ID NO: 60075 - DNA, 601 bp, Human
tacattaaaataaaatggtgtggtcaatgggtacaaagttacagttaggagaaataagttctggtgttctatagcatagcaggggtgacaatagtaaacaatagtgtatatttcaaggtaactaaaagagaagattctgagtgttctcaccacaaagaaatgatagatgttttaggtggtggatataccaaaaaacatgatttgatcattacacaatgtatacatgtatcaaaatttatattgtacccactaaatacgtacaaagattgtgttaatttaaaacaaaatagtgaacaaagcycttttagtaaacaaaaagtaaaataatatggtgaagtatgaattcaaaacttgctataatatagatacatattgaaattcccagacaaccactaaaaaaatagagtttaaaatactcccgttaaaaggcagagattgtcaggctgaagatatacacaaatagacagacagacagacagacacacacacacacacacacacacacacacacagatgatccctgacttaacgatggttcagtttataatgttttgactttgcagaggtatgaaagtgatgcagattcagcagaaaccatact

SEQ ID NO: 60076 - DNA, 601 bp, Human
taaaagaaagttgaaagaaataataaatacataggtatatataaagattctttatgcttcttactctttgtaaaaggctattataagcaaaaataacaatataaacatgaatcttataatttatgaacaagtgtaatatataaaatcaataacacaaagaacaaaggaaacaattggaaatatataattttaaaattcttacattaaaataaaatggtgtggtcaatgggtacaaagttacagttaggagaaataagttctggtgttctatagcatagcaggggtgacaatagtaaacaayagtgtatatttcaaggtaactaaaagagaagattctgagtgttctcaccacaaagaaatgatagatgttttaggtggtggatataccaaaaaacatgatttgatcattacacaatgtatacatgtatcaaaatttatattgtacccactaaatacgtacaaagattgtgttaatttaaaacaaaatagtgaacaaagctcttttagtaaacaaaaagtaaaataatatggtgaagtatgaattcaaaacttgctataatatagatacatattgaaattcccagacaaccactaaaaaaat

SEQ ID NO: 60077 - DNA, 601 bp, Human
ggctgggattacaggctcgtgccaccacgcccagctaattttcgtatgtttagtagagacagggtttcaccatcttggccaggatgttctcgatctgctgacctcatgtccacccacctcggcctcccaaagtgctgggattacaggcataagccaccgcgcctggcagagaattgcttatttctgagcatcctcacagtaattgtattccaaaagcttttccaatttaaactaaatagtgaataaccatatctggaattgcaatacaacatcctctcagttcaagtactgactagatttraaaagctatgtctgggagattagaggtttggcaactcaaagatgaactcaatattattaaaactatggtgaaagaaaagggatttattatctgggaaataaacaaaaacaataaaatattattatttaatcattcttttatagcaatactcagaatacaataaaactctaaaagatacatgaaggaaaaaattatccataataaaggtaaagcaaaataaaaagaataagacccatgtataactcagttattgaaattaacatgtctgggctttaaaataaccattattgatgtgtgaaa

SEQ ID NO: 60078 - DNA, 601 bp, Human
gaatcatcgggcttagaatctactgtaggataggaaaaaatacaagagtagaagcaaggagatcaggtatgaggctactttaataaaccaggcaaatgatgagatggtttggactagggtagagactcgaaagtggagaaaagtgttcagattttaggtacattatgaaggcagaaggaacaaacataagagtcttctgatgcacagaatgatatgtattcaagaaaaatgggagttataaatccaagtcttttggtcggagcatctgggaggatggagttgcctttgagaaggaaaggaytgcaggtggagtaggttttattttatttatttatttagtgaaagagataagctcagtttgggatgtgtttattttttttaattttgtgcctgaatggtactgtcaaatatcctgttgggtatataagcctggtttggggggtgggtctggtttggagatataaacatgagtcatcagtgcataggcagtagttaaagatgtgtctagacaatatcatcaagagagtgattgtatataaaacaacaaaaaccatccaaagatgaagccacaaggcactgcaaagtaaagagatgggagaaa

SEQ ID NO: 60079 - DNA, 601 bp, Human
atattgaactatttacatagaacttgaatgttcaaatatgtttacactgtacaccccaacctttcaaagcagcatgtagtggctagtagaaagcttgcatgtcaaatcagtactaaagtattccaaaactgtctatgaaacaaaatattttaatttattatatttgaaaagtttcttatttccaaagcttttcttctaaaaaaaaaaaaaacaacactgaagtataagtgtatgttcctttcctaagataacatttaacctttgttcaagaaaattgtgttggctttttctattctatctstaacaataattccaaaactctatatataattaatgtaaaagaataatcagaaagaagtcaggaattactataaaacaaagaaggctcttcatctttagactcgttggtaatacaactcaatagctgactaataaagaatcagccactaatgtattaacacatttaaaaatacctttatacgtcaggcattattctatggataaagcatacagaaaatagaaaatatattttttcatcctacttatattccaatgggtgaaaaaagaaaataaacaaaatactaaagtaagttatatagat

SEQ ID NO: 60080 - DNA, 601 bp, Human
tcctttagcagagaaaggagcttagtcttgtttagaaactagcatagaaatccagcctagaagagatagcaaatgcttgaaagagaatacacacatataatttagtttattctctcaaggatccccaatcatctcataaattcatttgattgtgtagcccctttgacacttaatatttattaattttctctggaggttaaaatgttaaagaaactaagaaccagtaagagcttattaaccctcacataaactggtttccattaccctttcggttaaatgcatcctccctacctgcctattraagttaaaatgatgtcacagtgcattctacaatttagagactaaaagagagaaagatgaagtattgtaaaagtaactacccaataatttcatgtaaagcaatgcttcattttttaaggctaaaatgcagaatgttttaaatcaattgtgctactagtaaggattctggcatgcaaatgagccccaccccacacaaaacatttttaaatggatttctctgtcattacattacaaaatgcacagaaattgtagtgaagcttcattttatttttttattataaatcatgcaaatctatgtcta

SEQ ID NO: 60081 - DNA, 601 bp, Human
tcaaaaaccatgagttttattccctatggtattttttaacacacaacacacacacacacacacacacacatcatatgtgtcttgtttttatgccaaaaaagaaaaatatacaatagttacttgcataatctatagaaacaatctatagaaatgttttggatttattaaagcaattcaataaaaacaggcagtcaacttgaataaaaagggttagataatgatatcactacgtcctttagcagagaaaggagcttagtcttgtttagaaactagcatagaaatccagcctagaagagatagyaaatgcttgaaagagaatacacacatataatttagtttattctctcaaggatccccaatcatctcataaattcatttgattgtgtagcccctttgacacttaatatttattaattttctctggaggttaaaatgttaaagaaactaagaaccagtaagagcttattaaccctcacataaactggtttccattaccctttcggttaaatgcatcctccctacctgcctattgaagttaaaatgatgtcacagtgcattctacaatttagagactaaaagagagaaagatgaagtattgtaa

SEQ ID NO: 60082 - DNA, 601 bp, Human
tttatcatagttgctacactcctctagtcatgttatcaggaactacctctttcttcaattaccaaaggaaataactgtgtattattcagaatgacatatactgagagagacgttaagcctaccaagataggaaaaaatatatagcaggagcacagataaaagtgaggtaaagataagacttggcaagctaagggaaatggtcaaaggaagcaattgaagactcaaaataagaaatgcccaatgagaacatgccgtatttggtattctgttcaccgacgtaacaaacctgcacattctgcamgtgtaccactgaactttaaaaaaaaagtttttttttaaaagatgccaaatatcaaagtttgtgctgttaataattaacagaaagactcaaaggaacaaaagaagaaaaggggctgtaaaaatttggtagaagagacataataagagatattagttatatacttcagataaccagaaatgtaacactgaataatgctagatctcatttagtactgaataattagatctcaaatatctgagcttcacctaagggacaaggaggggaagttgccgaacctcttctggaatttataaattagct

SEQ ID NO: 60083 - DNA, 601 bp, Human
aagaaccacgaataaatgaaagacaataaaatatagtcagtttattataatatttactgtttatttttatattgggcaatatttttattcataatattataaactaattgagataaagggatcacgtcttaaatatctattgtatttcttttaatatccagaatgattgaacagtcagtaggcagttaacaatatttatcatagttgctacactcctctagtcatgttatcaggaactacctctttcttcaattaccaaaggaaataactgtgtattattcagaatgacatatactgagaragacgttaagcctaccaagataggaaaaaatatatagcaggagcacagataaaagtgaggtaaagataagacttggcaagctaagggaaatggtcaaaggaagcaattgaagactcaaaataagaaatgcccaatgagaacatgccgtatttggtattctgttcaccgacgtaacaaacctgcacattctgcaagtgtaccactgaactttaaaaaaaaagtttttttttaaaagatgccaaatatcaaagtttgtgctgttaataattaacagaaagactcaaaggaacaaaagaagaa

SEQ ID NO: 60084 - DNA, 601 bp, Human
catgaagaggaagaggctctgacacccggagagaaacagacccaaatggtctagtatcccaaattcattaccgagatgagccttccagccttcccccaccagagcatcggtcattgagtgagccacctctgacagtccgggcaagtcaagtcctcggaggactacagctcccaccaacactgggagaagcagaagcatcaccagctaagctgtgtcaactcacagaatcacaagagatactaaagtggttattgttttaaagggctatgcttttggatggttatttttaattagcaataartaattataatatcctgtcccccagtctctgaacagcttgagagtgaatctacactatatccacccccatactcacagtccctggaacagcactttctaccaagtggtcattaatgaatgtctactgattgaattaataaatttaattattctccatttgaatatgtaaacacaggattgtgtttactctttcaattttgaactagtttttaatgatattgctttatatggttgggaacttaaatcatttctgaatcaactggcttaacttatttacatatcccaaccacatggcctaact

SEQ ID NO: 60085 - DNA, 445 bp, Human
tgatgccatgtcctgtatatgtctcatgctgtttctcttcctggcatatcctgttcctcactgactggttaattctgattttttttcttaatgtctagctcagcatccttttgctcttggaagcctcacctgaatgcacccagaktgatagattatcttcttcagggtttccacagtaccttgtgtatattgtaaacactgtcgcttgggatcactagcttccaaaaatggcttcaaataatctgtgaaacccataactttctccttgtgaaataacctccctgaatctggagtggtctggtctgggactccctttaaccagtagaatatagaggaaatgaccctgtgtaagttctggaactaactcttgggaaggtctgtcaagttctttagcactttttgtaccactgagccaccaagtaaatgtctcactatctgctggaga

SEQ ID NO: 60086 - DNA, 601 bp, Human
ggaattgtaaatgacttttttgcttattgatttcagctgttgataattttccagttattttttctcataaatgtcatttctcccattctcttcattgtatactaagttctggccataatgatgctatgctatatccagctcctcactttaacaggcctgctcacatctccaggtctatattgtgctcttcctctgctggcctgttgttccttatttcttttttttgagacaaaatctcactctgtcacccaggctggagtgcaatggcacgatctcggctcactgcaagctccgcctcccrggttcacgccattctcctgcctcagcctcccgagtagctgggactacaggcacccgccaccacgcccggctaattttttgttatttttagtagagacggggtttcaccatgttagctaggatggtctcgatctcctgacctcgtgatctgcccgccttggcctcccaaaatgctgggattacaggcatgagccactgcgcccggcctccttatttctaactctttgtttttgcccctgctttgtcctgctaggtgaggcctttatctttctaaaattttctcctgctggctttcatgtct

SEQ ID NO: 60087 - DNA, 601 bp, Human
tggggtattgaagtctcctactattattgtgctgctgtatgttccttccttcaattctgccaatgtttgcttcatctattgggaactctgatattgggtgcacgaatatttataaaatattatatattttcttggcaaattggcccttttataattatgtgatattattatttgtctcttctaaccatttttattttaaagtctccttttttaatgttagtatagcacctctgctcttttttagttatcacttgcatagaatatgtttttaatctttgtgactctcagcctatgtgtatcyttaacatctaatgttagtctagtagacagcatatagtttgatcttgattttttaaatccattcagcaaattatatcttttgatcagggagtttaatccatttacatttaaagtcattactgatttagggaaggagatactattgccattttgttaattgttttctgtgtgtcttgtagctctattacttctcctttcctctcttactgcttttctttgtcttttgttgacttttggtaatggcatgctttgactttcttttcatttcctttcatatacattgttactgttgcaattagac

SEQ ID NO: 60088 - DNA, 601 bp, Human
cagcatcaagccagttcaatacttaatttaattcaaatgatctgtgcccccttatctgctggaagatggaaaattgtctctgagccagataacattcctaagaccctctctattatcactctactatttttcatacataatgtccagacttaagaaacatacttaagaaaataatgttaggaacatataggaaacagataaatggtaatatcagttctatgctgataaatgtttaataaccagtttccaaaaaagggggagcaatattataattatactgatataaaagatttttaacacrgtttttgaattataaaatattcaatactctattataaatttaatatatccaattgattctttcagaatactcacattgatttttaccaaactattatatttgtaggcagtgacaatcaagatgactgcaactgacaatcaagtatacttcaacatggatatggtttcatttttttatttactcatgtttatgagtaagatgaaagtgaatgttaaagatgaatactggaaattcacatacttgtaagtgatgcaagcaaattctcacataattatttttaaatgctagatagttggtata

SEQ ID NO: 60089 - DNA, 601 bp, Human
agtgtttgctgtactctcagttctaaactaaaaagccaaggaccattagggaggaagagcttttatgaggagtcctggatctcagctgggacaaccagtaggttagaccctatgagtggaaggaaacatatggagaaaaaagcttattataagaactaaaacccagcatcaagccagttcaatacttaatttaattcaaatgatctgtgcccccttatctgctggaagatggaaaattgtctctgagccagataacattcctaagaccctctctattatcactctactatttttcatacayaatgtccagacttaagaaacatacttaagaaaataatgttaggaacatataggaaacagataaatggtaatatcagttctatgctgataaatgtttaataaccagtttccaaaaaagggggagcaatattataattatactgatataaaagatttttaacacagtttttgaattataaaatattcaatactctattataaatttaatatatccaattgattctttcagaatactcacattgatttttaccaaactattatatttgtaggcagtgacaatcaagatgactgcaactgacaa

SEQ ID NO: 60090 - DNA, 601 bp, Human
tcatataacaagcatgtagatacagtcataatggaatagattggagcagtccaatgttcccaatgagaataaccagaaaagctaattttgaaatatagatgattaaaatatatttaaaggcatcagacagctaagagagaactaggacttgagagcccaagatccctgagggaaggacatcagagaaatgtgaaccaacattctgtaagcagctttttccctcagggaaaacaccaattttggtgtgaaaagagagacgaagaatatgaacatacattgctaataggtagagaacttttgraactcttaaaatactgaagaaaaaatggatttcagattgaagatggtagcaatgatgtaagtagtcaagattacagagagaaggtagtagcagagaagtaagaccaccattctatggatttgcctttaaggctttgcatactcttaaattgccaagagcaaaagacaaatgagacaaacagaaaactgttgaaaaaaaaatacagtagtgtttgctgtactctcagttctaaactaaaaagccaaggaccattagggaggaagagcttttatgaggagtcctggatctcagctgggacaa

SEQ ID NO: 60091 - DNA, 601 bp, Human
ggaaaaagagtggccaactctctcctaaggaatatgggaaggcttcacagagggagtagtaaaaatctaatgaggattaaatatgtaaaaaggttcttatctgcatattaactagcatttactcacatcatctatataatttaatatctaataaaacaaagtgaataaatactatctaaggatactaaagtatcaggacagaaatagaaatttgtctaataactaatccattataggtttacaatgctcaaaaatattcctttagttaaaaagcatgttattctagcaagtggagtaatacatggttgatctataaaagtaaaagtaaattgcccttactttgacaccattgtctttttttttctaagataaaaaacaactaaagaaggataattataactcactttatttgtacagcaaaataaattccagatggcttaaacatttaactcttttttaaaaagctgtacaagtactgaaagaagttaaggaaaatgtgttaaacacaaacatagaggaaaacaaactttggagtatctgtcaggtaaataattggctgtttggtccagaaatctacaaatctattcccacacttttaaat

SEQ ID NO: 60092 - DNA, 601 bp, Human
taacaataacatctcctttagttttataagagaatgagttatcacttattagaaaattgatttagcatctgctttattagatattgtagtaggtgctgggatacaaaggcttagaccactgtgcctgtcttcagtgagttcacaatttaatgcaggaagcatacagtcactcagcatagtctatgtgccagacactgctctaggtgctgggggtatgatagtgaaccaaacagaaagaaatgtctactataaggaagtttctccctgctagtgtgtgagagagtgtgtgtgtgtgttttcmggcaggggaaatgaatgtattttaagtattagtgcttcagaggaaaataaattcaaattttggaataagaaaggcagtagaaatagggataaaattttaattttaaaaagatacatttaatgcaaattgataagggccataaaagagccacaaagaaagcaccatgcaactaggaaaaagagtggccaactctctcctaaggaatatgggaaggcttcacagagggagtagtaaaaatctaatgaggattaaatatgtaaaaaggttcttatctgcatattaactagcatttactcacat

SEQ ID NO: 60093 - DNA, 601 bp, Human
gataattttcccttcatgatcctcttttcagagcttgctctgaagatgcattctcataattcaaaaagttatagcacctgttttcattatgttcattattatctaattagtaaagggctttcattttttggaaaaaaaaattcactctcatattcagggaaactggataaatgccaacacatgtaaacaacatatggtttactttcaaaatcaatcaaccagaattatttctaaatcatttcttagttaaaaatgtgttgaaataatttactgctataatagataatgttactatctgctrttcctttaggactgactacctggacatcgatcatattatatattgtctagcttccccaagaagacaatattgtttgtagaaaaaattatttaagtagttatggtgagtgtgccacaacttagatttggatgttaaaagtgagttataaacaactaaggttatatgaatgccagaaatcactactgcaagaaattctatagtttttaaatttttcctcatgtattatttttatgagccctaatttttcaacataatattcagcagatctggtaaattaaaacaatatgtttgtcttatggg

SEQ ID NO: 60094 - DNA, 601 bp, Human
catgtatttacatttagtagttcatttaaaagagacagcatattttaaaactcattttgatttgtatttgttatttccatcatagtaaaaaatgctgttaaatttttgctaatgtgtgccttggaatatatctccaggatacatatgtacccacttcacaatatatgcagataattttcccttcatgatcctcttttcagagcttgctctgaagatgcattctcataattcaaaaagttatagcacctgttttcattatgttcattattatctaattagtaaagggctttcattttttggaaaaaaaaattcactctcatattcagggaaactggataaatgccaacacatgtaaacaacatatggtttactttcaaaatcaatcaaccagaattatttctaaatcatttcttagttaaaaatgtgttgaaataatttactgctataatagataatgttactatctgctattcctttaggactgactacctggacatcgatcatattatatattgtctagcttccccaagaagacaatattgtttgtagaaaaaattatttaagtagttatggtgagtgtgccacaacttagatttggatg

SEQ ID NO: 60095 - DNA, 601 bp, Human
agcttctaagctaaaaatcatatgcttcataagaattggggaaggaactgtgtaagcacaaaccaaagaggaaaagaaaatgaacaaacccacatagacgtagacatccccccagaacaaaatccatctgaggcgatcaacaaaaaatcctgaaaggtatacacattgcacatgccttatgctgaaaagttgaagtaccagcaccaaacagaatagctatattaattgctcttcactcaaaaatgccttttcatcatattataatgacctaaaaaaccacaccacttgcatacttctaaayggatttttaaaatatgtatgcataattagaaaaggacatttacaaacctaaaatgaaatttcatcacttttggtgttgaagaaacacaacttgcttacacatgcagatttgtccatgaatattttttctctctcttgatggaattttaggtttaaatgcacaacaatctagggtaaataaattaaatgccaaaagcatataatatattctttttgcttatctaattttaccatgctcctgagattttagatggatatttaaaaagtacctaaaatttttcctcaagtttctaatctggtc

SEQ ID NO: 60096 - DNA, 601 bp, Human
tcaaatatttaaaattcatacaaggtttctagcttctaagctaaaaatcatatgcttcataagaattggggaaggaactgtgtaagcacaaaccaaagaggaaaagaaaatgaacaaacccacatagacgtagacatccccccagaacaaaatccatctgaggcgatcaacaaaaaatcctgaaaggtatacacattgcacatgccttatgctgaaaagttgaagtaccagcaccaaacagaatagctatattaattgctcttcactcaaaaatgccttttcatcatattataatgacctaaaaaaccacaccacttgcatacttctaaatggatttttaaaatatgtatgcataattagaaaaggacatttacaaacctaaaatgaaatttcatcacttttggtgttgaagaaacacaacttgcttacacatgcagatttgtccatgaatattttttctctctcttgatggaattttaggtttaaatgcacaacaatctagggtaaataaattaaatgccaaaagcatataatatattctttttgcttatctaattttaccatgctcctgagattttagatggatatttaaaaagtacct

SEQ ID NO: 60097 - DNA, 601 bp, Human
aataattttatccaacattttaatatacctgttcaactctaggaccaatggtctcttctagcattaagtttcagggaaaagaagtgcatgtgtgatctgtgctctgtttttgcagcaacacccaagtctgtctattctgagaaattaaaacagcacacttcaattggcaattaaatgtttttatgataatagctatatttagcgtagactgtaatgttatttgtagtgtgtagtacattactagcaggattttacacaggggaaacaatcccagtttctaaatatatgttataaatatatraacatgatggaaacaattaaaaaacatcatgtatcacggatgtagcctgatacaattttcatcatgaatattttaaatactaaataaatacattcaggggaatacccattgatagtcataaacacaagggttatatattaatataatatgtaaaatctacatagttttgaaaaattcttttcaattttgtatgtggattaaagtgtcttttgaggtaattaagtttttgaaagactagatatcttcacaatagacactaatatcaaatatttaaaattcatacaaggtttctagcttcta

SEQ ID NO: 60098 - DNA, 601 bp, Human
gtcttgaggtcaacaagaagcaaggctaaagtaaaaggttaaaattctcagcttaagagaagaacttgggagcaatgccttgagcaattgtaacaaaaactgagtgaaaaaaatcacattcttgggcctttacccccaatccctactgtgaagaatggcaaacagaggaaagaactaaaggcaaagaaaatccttaatatcctcctctatgtggcaggtgttaagggaagcacatgtctctttcctgatatgggaaatagttatccatggggaccttattagctaaaatgaaaaaaaaaaagccacttcgttatcacccttaaatttcttacatgcttaaagcaatttctaggaagtgaattcacatttgctgcattctttaacaaagccctggcttctgggattttctaaatttctaaacttctttcaaagcattagaaaagcattatagattttcttttttttcttcctttttaaattttaaccttttagtagttggggtgaccgatattaaacaaagttggaagttacagacagtatcaatcaaagttaatttcttattctacctttaaaatacaccttgggtttgttctacaagtca

SEQ ID NO: 60099 - DNA, 601 bp, Human
gtggtggcaaacacctgtaatcccagctactcaggattacaggaggctgaggcaggagaatcgcttgaacccgagaggtggaggttgcagttagccaagattgtgccactgcactcctgcctgggcaatagagtgagactccatcttaaaaaaataaataaataaatagcatcacagttgcaaaaacaaagaaggtaaaattgtccctctttgcagatgacataatcctatatctagcaaaaccaaagattccaccaaaaaactcttataactgataaccaaatttagtagaattgcagartacaaaatgaacatagaaaaaatcagtaccatttctgtacaccatagtgaaatagctgaaagtgaaatcaagaaggcaattccacttacaatagctacaaaaaatcccaagaaataaacttaaccaaggaagtgaaaggtctctacaaggaaaactgcaaaacactgattaaaataacacaggaggacacaaacaaatagaaagatatcccatgctcatgaaaaggaagaattaatgttgttaaatgaccatactacccaaagcaatatacaaattcaacacaatccctatcaaaataac

SEQ ID NO: 60100 - DNA, 601 bp, Human
ctctactaaaaatagaaaaattagatgggtgtggtggcaaacacctgtaatcccagctactcaggattacaggaggctgaggcaggagaatcgcttgaacccgagaggtggaggttgcagttagccaagattgtgccactgcactcctgcctgggcaatagagtgagactccatcttaaaaaaataaataaataaatagcatcacagttgcaaaaacaaagaaggtaaaattgtccctctttgcagatgacataatcctatatctagcaaaaccaaagattccaccaaaaaactcttatawctgataaccaaatttagtagaattgcagagtacaaaatgaacatagaaaaaatcagtaccatttctgtacaccatagtgaaatagctgaaagtgaaatcaagaaggcaattccacttacaatagctacaaaaaatcccaagaaataaacttaaccaaggaagtgaaaggtctctacaaggaaaactgcaaaacactgattaaaataacacaggaggacacaaacaaatagaaagatatcccatgctcatgaaaaggaagaattaatgttgttaaatgaccatactacccaaagcaatata

SEQ ID NO: 60101 - DNA, 601 bp, Human
caaaggaaattcattagcactagactctccctacgagaaatgctcaaggcagtcttcaacccaaaagcgaaaggacagcatttaccatcatgaaaacacgttgtaactaatactcactggtaaagcaaacagacaaatgaggaagagaaaggactcaatgataacactacagaaaaccaccaaaccaaaatgacagacaataaggaaaaaataaaggaacaaagaatatactaaaccagaaaataacagcatgacaggaacaaaatctcacacatcagtaacaagcttgaatgtaaatgaattagattctcctcctaaaagatatcgacttgctgagtgaatttttaaaataatccaactacaaactgctcacaaaaaataaactttacctctaaagactcattatagaatgaaagtgcagagatggagaaagatattccacacaagaaaaccaaaagggaagccagacacggtggctcatgcctgtcatcccagcactttgggaggccaagtcgggtggatcacttgaggccaggagttcgagaccagcctggccaacacagcaaaaccctgtctccactaaaaatacaaaaatcagctg

SEQ ID NO: 60102 - DNA, 601 bp, Human
gagacatgtgttaatggatacaaaattacagctagataggagaaataagttccagttttctgtaccactttggattactgtagttaataataatatatagtttcaaataatagctagaaggagcatattgaatgttctcaacaccaagaaataataaatgctttaggtaatggatatactaattactctgatctactctacatatactatatatgtaaaaacatcactgtgtaccccgtaaataagtgcaattattatttgtcaattaaaaataaaatttaaaaagatgattatttactcyattgcttaaattgataaagtttttcagatataaaaatcaaaatatgtaaaaaaatagaagattaaggttgacaatagggagaacaagtcatggtggggagagggagggagaggagagatgaatgggtaaagaggtggcaggatagggaatcacaagggggctgaatggatgagaaaataaaagggaagggatggagagaggagaagagtagttcaggaagggcacttatctcagtttgaataacaaaatcactggagaattgttatttgattaatatccgggtgtctcccaggactcaag

SEQ ID NO: 60103 - DNA, 601 bp, Human
gagcataactaggttaaatattcaaagaatcctgaattcaaattcttatttcttttgcttattttttcttctgggggtatggagaggaaacagggtcatgcatatagtgggacaaaaggcctaatcttcaccacatagcaagggctcaagagattctaagtaaattcctcaatagaaggatggaagaaaggaaggaaaggaggaagggacaaaggaaaagggatataggcatatactctttggtaatcaaagtgagaatataataatcttcaaaaattggaatattgaaattgttttgtacttgttgataggagagacatgtgttaatggatacaaaattacagctagataggagaaataagttccagttttctgtaccactttggattactgtagttaataataatatatagtttcaaataatagctagaaggagcatattgaatgttctcaacaccaagaaataataaatgctttaggtaatggatatactaattactctgatctactctacatatactatatatgtaaaaacatcactgtgtaccccgtaaataagtgcaattattatttgtcaattaaaaataaaatttaaaaagat

SEQ ID NO: 60104 - DNA, 601 bp, Human
aataatttttctttaaagtactattttatacaaccaacacaacataataaccaattttcaataataaatatagtgacaaaaatctaaaataaagtagtaaattaaaccaggaaaaagttccacaaattttcacatacaaatcacttcagctattacttacaaatgttattaagtagtgggaaatgtactataattcagtgattctgtgcttcagaaaataaactgtttcttcatttatataatgagtcctatctcaaagtcaaagtaaagtaatgatctaaataaaattccactttgattmtatttttgggcttctagaaaaaggagcaatgcctattatatttgatattcttaataattttcaaaagccataaatgttaatctctactcatttttaaaggatacatgcaaagaaactgcatcctaagacagagcataactaggttaaatattcaaagaatcctgaattcaaattcttatttcttttgcttattttttcttctgggggtatggagaggaaacagggtcatgcatatagtgggacaaaaggcctaatcttcaccacatagcaagggctcaagagattctaagtaaattcctc

SEQ ID NO: 60105 - DNA, 601 bp, Human
aaaaatatagtaacatttaatgtatgaaagctttgtcaatatgttattaggttaaataaccctaagtatatattatattttaaaataaaatctacgttagcataagacaaatccaatatctatcttggttaaaaactaaacatcctacatctgtttcttcaatctgaaatcattatgtatatctaataaatggtatatcattcatttatttttcaggtaaggtaaacattattatttgtcaggaaaggctttaataagtgccttgtttttatatcaataaaaagtataaacaataaggtasaaaatatttttagatggagtagttcactccagatgttaccaaggtaactaaattcaacagcgttacatatttcattcctgagtaaatcagtatgttttaagaaaaacaaatacatgatttactcatttgtatcaaatatacatactcacatattttgcaatttaaatggtaaaaaacaataatgtctcacaacactgtcctataaatccaaatttaaaacaaagtttttgatgtctttattttaaaaataccatatagaacagtaagcagatattaaactgaggacaaattaagaatttt

SEQ ID NO: 60106 - DNA, 601 bp, Human
aagtccttaaaatgacctacatttactggtggagccgctttatacttcatcccttcacacttgttctctgctgcagccatgctaagctccttgcaaatacccatgccaggtacgctctctcatggctctgtgccttaaaacatgcttacccctctcccatacataatcagaataactcctacttgccattccacactcacctctggcatcaatctctctttagagttttcctgaagaatcattacagtccctcagcacccttcctctgttctttcatttcaccctcctgaccatatgtccytcatatcacttacagaatcagactgtaaccacaagtttgtccccactgttagaccatgagcttttaaagggcaggaatcttgctcttctcatttacatatttttgcttcctacaacagtgacttgcatgtaggaatcctttagtaaatatttggagaataaattaattggtggcaactagtttatcctgcaaaaggatgtcatgttcttcctcaatgccatgaggaagtgataaaatcatactgaggtcagaatggacaatgattccctagcctgagaccaagtcatcttccctatctgc

SEQ ID NO: 60107 - DNA, 601 bp, Human
tgctttcctatctcagcctctataactgtcttcaatcaaatttcccactaattctgttagtgtttcttctgccatgtgatttgaatccacctctgagcactaactctcctaaccaatgttcaggttcaggccaatgtcacttcatctaaggatcgcttagtttaacaatttatatcaatattgaaatgctccacattttggcttctaaaatatccccttcttatctagttactttcattttctccttgggtatatgtttctccacaaattccttttatatcacttgttcctaatggattgwtattctgcgaggtgacatatttcaactctctcctcattctatgctctcccaaggtgatcttatcaaccaccacagcttcaagcagcacttttgctctgaaatctttaaaatgtctctctctctccatcctgtacctttcttcagagctgacacatgtcccccgaatgcctattaaatatgtccaatggacactgcatgtgcaccgtaaactacacgtcaaaacctgcttcttcaaatgtttctcattctgaatcttagtaaacggattcgtcatccacttaggcaacaaagccaaaaatc

SEQ ID NO: 60108 - DNA, 601 bp, Human
tcatgggtctcattttccaagctctttatcatcatttcagccctctttggagctctaatgttattagttgtccttttaaaatgcggccatcagcaagtagaaaataaatatcacctaacttcattcagtgcaatacatttagtccttagattagttaatgtgattccctgctagtctagtgagttaatttgcataataataagtaatcagtaaatgacatagtccaactcaactattcgttttaagcacttctattcactgttcaatttttcaatgctttataatcatttttgtttgattwtattcacaataaaattgtgaaacaggtcaatattaaactcactggaatctaagcttttcacatattctatataattaagcttttatagccctccaaggaagaagaaatgtagtgtcacttcaaaaggtcacacagaagtgatggaacaatcctgaggactacaaaagattgcacagattgaacagaactttactatgaagttcacttcatagccttggggtaaagcaagtattgatccagatgcgggaatcctagagcactctacatttggattaagattgcaggaagaatctctaaagt

SEQ ID NO: 60109 - DNA, 601 bp, Human
atcattactacagttgatatagtatcccaatatcaaaactgatatatcctttatcctgtggctaaagtttcttttatactctccaccacctatctaatcaaacacccaattctgtccatttaattttctatatatttcttaaatttatgccctcctctccatcccaactaccaccttactaaggcaagtcttattctctgttagcagacttctcccttcttatgccacctaaagtcatcttgtaaaacacacgccagaatttttcctaccccaaaacacaatctgaccacactattttccrtcctatacccttaagtgattccttgtcaactaaagagtaaaatccaagcttcaaaaggatattcaaaaccttccctagtctgacactctagtctccagacttaaatcatcatcttccatcttcagcatttctagtccttacctcagtgctctgttcatcaatgttcctctgtttggaattctctattccctattgctaagtggccatctcctatttaaccaatgagaattaactcaggaaccttccaaggcataagtaagcctagaggagactcacacacaaatcaatttctgtattata

SEQ ID NO: 60110 - DNA, 601 bp, Human
ctaactcatatgaactattatatgtctaaaaaggaactcaaaatgcacatttcaccgaatgtgcagaattaaaatcaacttcaccttgcacttttcaaggcataaattatagaagcccctcaccttcttcattttcctgagatataaaatgtgaaatgaaccaacatggactggaacatgcatagtaggcataggcacttgtaattaatggccctgtccttcatcttcctgcaataacatatagagaatatgagcatatgcaatggcaaacatggtagcataatgattcaaaaggacactratttgggtgttaggtcatttgggtgggtctcaatttcctcgtctgtaaaatgaagtggttcctgattttaaagttgtattattctatataatatagttgattttacaatccctagtaatgtgggtatttattcataaaagcattgtatacatttaaatttagattgcaatatgacatatactataaagctattaactttattatatctttcttatgtatcattttatttttaaaaaatctactaagaacataataaaaaaatgtatccagtaatgagcagaactgaagaatatgtgatct

SEQ ID NO: 60111 - DNA, 601 bp, Human
tactcaatatacgctttcatttttccttgggactgagtttatgacttggctattttttttaaccttgtcatctgagttatcctcttgaccccagctaaccctaagatcgccattttaaaagtattaaaaagcataccatatttttgtacctattaaccatctacacttcccccctctccccattactcttctcaccctctggtaaccatcattctacactatatctccatgatttcaaatgttttaatttttggcttccacgtatgagtaaacacaggcaaaatttgtctttatgtgcttrtcttatttcacttaacatgtccttcagttccatccgtgttgttacaaatgacagaatttcgttatttttacggctgaatagtattccattgtgtatatgtaatacatttttaatccattaatccactgatagacacttcggttgattccaaatcttagcaactgtgaatagtgctgcaataaacatggatgtacagctagctctttgatataccaatttcctttagaaatatatctataacatacaatttataaaaatacgatttataactaaccagattatttacaaatgcatggcagt

SEQ ID NO: 60112 - DNA, 601 bp, Human
cccaaactagtagctgggggtctcagcatcaggtcaagtttgcagctactcattctcaaggcctacaccatgatcgtttaacattatagtggttaaaaggtgggttaaattatttgtagtttaaatacaaattttagaaattcttagtataatcatatatacaatttctttgaatcttggttttccaatctgtaaaaatgagaaaactaacagagcctaattccattggatcacagtgagaattacataagttagttattagaataatcctggcacatagtatacaagtactcaatatacrctttcatttttccttgggactgagtttatgacttggctattttttttaaccttgtcatctgagttatcctcttgaccccagctaaccctaagatcgccattttaaaagtattaaaaagcataccatatttttgtacctattaaccatctacacttcccccctctccccattactcttctcaccctctggtaaccatcattctacactatatctccatgatttcaaatgttttaatttttggcttccacgtatgagtaaacacaggcaaaatttgtctttatgtgcttatcttatttcact

SEQ ID NO: 60113 - DNA, 601 bp, Human
ctaacaccagtgataatatcttagttaatgaaaaatgtaaaaataaatattacaggttaatttttactttaaaatatttgtctcatacgtgaaaatgtaattgataaaaaatacttaattattttacgtgaagtttgcacattgtgatttgagaatcgcaatgcaaagctcataaggccccaaatatctcctttaccagcccgccatgatgcaatcctccttaatcaccataatggaaatttatttcatttgattcactgtttttggtgaaatattcaaaagggaatatatgcatcagagrggtaaaattgcctacaccttgcctgaaagagaaaagactctattccaaattaaggctaaagtcagctgcatagctgggagttcagggaagccaaatggcaatgagaagaaattaccagaatgaaaaagtgtatgggataagatcaatgcaacatattcccatgtcactgcattttatttaacaaacatttgacaggaagcaagcttcacgcatgtaaatcactttagtgtgctaccttacaacccaacaccctgccatcttgccctcattcctcatggatcttcccctccagaagttcag

SEQ ID NO: 60114 - DNA, 601 bp, Human
taacaaaagatgtactgacgctatattagggtatttaattattgttcattttacatcatcatatttaagcaactgcatatcagaagaataaacatcattcatggattttacctcctcttctgggtaaggcattagtttgttttctgttacgtgtagtatagttgtatcatgtcaggcagaattatctccttgttatttttttttatttggagattcagtatggtttaagaagttgcatatgggtgccgagttaataagtgggggacttgtgatggctaattttctgagtcaactagactgygctatagggtgttgagatagcttgtaaatattatttctgggtgtgtctttgaagatgtttctggaagagattagcatttgaattggtaaactggtcaaagaagaatatcaccttcaccaatgtgagtgggcatcatccaatctgttgagggcccaaataaaagaaagaggtggagaaagggcaagtccactccatttttgagctgcaacattcatcttctcttgccctcagatgttggcactcttgggtttatggtcttctaattcagactgggacttacaccattggctcccttggtta

SEQ ID NO: 60115 - DNA, 601 bp, Human
aaatatctttgttttctttcctgtcttatttccttcacaaataacaaaagatgtactgacgctatattagggtatttaattattgttcattttacatcatcatatttaagcaactgcatatcagaagaataaacatcattcatggattttacctcctcttctgggtaaggcattagtttgttttctgttacgtgtagtatagttgtatcatgtcaggcagaattatctccttgttatttttttttatttggagattcagtatggtttaagaagttgcatatgggtgccgagttaataagtrggggacttgtgatggctaattttctgagtcaactagactgcgctatagggtgttgagatagcttgtaaatattatttctgggtgtgtctttgaagatgtttctggaagagattagcatttgaattggtaaactggtcaaagaagaatatcaccttcaccaatgtgagtgggcatcatccaatctgttgagggcccaaataaaagaaagaggtggagaaagggcaagtccactccatttttgagctgcaacattcatcttctcttgccctcagatgttggcactcttgggtttatggtctt

SEQ ID NO: 60116 - DNA, 601 bp, Human
gcactacatgatgactcagaatcattgtggattcatgaaagttccattaagggctcacattttactctactgtaattgaagtctgaagtgaccatgatttacatttaagataaaaacctgggatcatgatgtaggcattctttaattctttatatgaaacttgtatgagtaaacattatccccatttttcaaaaagaggagtgccaggaaaacccactcaaaatcattctctgtgtccttgcataataattgtttttctggaggtgcagacataattttacatgttatttttgttacttaygtgagcatttagttcaaaaatctaccctttctgtgaacttcttaagaacaagcattaaagtacatgattatcttctggattttattgatatttcccagggttctgaaattttcttcatgtaagtatgctgcctagtgagtatctttattattgtatgtgttttattataattatctatgtagctgtctcactcaatagattgagcttttatagggtagcaactgcattttgttgatttttgcatcctcagtggctggcatgatatgtggcatatcgtacaccctgaataaatatttgttt

SEQ ID NO: 60117 - DNA, 601 bp, Human
tggtatttctaggtagcaacacagtacttggctcacaggagaggcttaataaatactcattaaatgataaataaaatgtaaacactttgcatcaaaatgtactattaaataaaaatctccaatctaaatgttaaataagaatttgcaatactcataccaattaagtccccatttactttcttatttatgaaaaaaggcactacatgatgactcagaatcattgtggattcatgaaagttccattaagggctcacattttactctactgtaattgaagtctgaagtgaccatgatttacatwtaagataaaaacctgggatcatgatgtaggcattctttaattctttatatgaaacttgtatgagtaaacattatccccatttttcaaaaagaggagtgccaggaaaacccactcaaaatcattctctgtgtccttgcataataattgtttttctggaggtgcagacataattttacatgttatttttgttacttacgtgagcatttagttcaaaaatctaccctttctgtgaacttcttaagaacaagcattaaagtacatgattatcttctggattttattgatatttcccagggttct

SEQ ID NO: 60118 - DNA, 601 bp, Human
ctatattttagaaattaggacaatatatcttaatgtacatcaacagtctcagtgtaagagtgattgtaattcagttattcctagtaactatatgatagatggttcagaaagcataatcatttttagtatagtagggtacaattcaatacaacttctctttacgtgaattcttcctaaatagactgagattagcatgcattccaaagcactaattttttagcgctgcaaataatgcgaactacatttcctaatcacggactgtaggtttgttctactacgcaattccaaactacataattggccttaccttttattcttcccatacctatagcattagctaagaacaatattccctttgttacctttcagctagtctgatttagtaaacatctgctagaaattgtgctaaatattaatgtcttaaagacttcatagccctgacacagtctaagtaatggatagaagcacaccacgtcaacatgacatgtgcaggtgcgtgtgtgtctgtgtttgtgtgatggcaagggcagggtagaggggtggggcaggataaggaaagcagacacaatgaactttctacatagaagaaaaacctgttcga

SEQ ID NO: 60119 - DNA, 601 bp, Human
agtgcaactccctcatttttatgatgtctaaattcagagaagtaggtgtattgtccctcaacacttttttttgatacagataatgctgagttttttttttttttttttagacagtctgctccattgcccatgctggagtgcagtggcacaatcatagtttattggctgtgtgctctaactcctgggctggcttaatcaatcctcccacctctgcctcttgagtagctgggactgtaggtgtgttccatcacacctggctagataatgctaatttttttattttcttttataatatctatawactcacaataatggttacattgttattatgaatataacacactaagaaatattataaaaatataatgttattttctaaggcaattatgaatgtacatataatatgtttattgactagtatctttatgagcttatttttataggtcaatgtttattggtaatttcctttacagggttgggagtggagtacctgtgtgagctgggaccagatgtttcagaggaagatgatgctgataattttgagctgtacagcgttatctcaggaatggcaaaggtgttcccctatgccatgctcatgaga

SEQ ID NO: 60120 - DNA, 601 bp, Human
taactaggcagaggaacaacaacaaaaaccagaagacctaaaaacaacattatactccagctagacctaatggacattgatagaacattctacccaacaacagcaatatatatgtattcttttcaagtgcatgtggatcattctgcaggttagacaatattctaggacataaagccaatcttcatgaatgcaaatttattgaaatagtataaaatgtgttctgacttcaacaaaaattaaattagaaatcacaaactcacaaatatgtagaaattaagcaatacatgcacaaataaccaaytggtcaataaagaaatcaaaagttaagttagaaaatacttttaagtaaatgaaaatgatgacacaacatacccaatcttgtgagatgcaactaaagcagtgcttagtggaaaatttctagctgtaggcacttatattaaaaaagaataaagatctcaaatcaaaaactgaaaattccaccttaacacacaggaaaacaaaggacaaacaaaacgtagtacaagcaaaagaaagaaaataatgaagatttgagtggaaattaatgaaatagagaatagagaaacaataggcaaaaacgaat

SEQ ID NO: 60121 - DNA, 601 bp, Human
aatgtatatttttattttaaattgcacattgcttcaaaatataatggtagaaataataaaaataaactaaatgtttttatttctactgtttaacatctactctgttgacagccattaaattatcttgtatacttggtttctctgggatacaacaattaatcctatcttattatttttacagtgaaatgattacactgcattttttttacaattgtggtgttggtgagtgctattctatgtgtgctgacagaggtgagatagggaggggaattataaatggatcaatgcatcagaattaccrttagctaattactctagccctgtggctcccatataatagcagctagccacatgtaccaatttaaatttaaatcaggtaaaattaagtaaaattaaaaattttgttcttgagtcatactaaccatatttcccatgctcaatagccacacatagccagtggtggccatactagacagagcagagcatttctgtcatttgcaaacctttctatcgaacagtgttgctccagctaaactgaattctatactgtacatggataggttatcaataggaggcataaaatgagacaaaatgaagtcct

SEQ ID NO: 60122 - DNA, 601 bp, Human
ggaaggaaaagaagacatctacaccacatggtatatacactgtatatattggaattctgtcaaagacaaaaaaaggccttgaaagcctctatattttaccttcttccttttctgcgggcaatggaaccaagtacaatttggaaatttttatcaagttatttaaaatagaggtttaaaattattggcaagactgggcacagtggctcatgcctataatcacagcattttgggaagccaactggaagactgcttgaacccaggactttgagactggtatgggcaagataaaaaagcccatttytacaaaaaattagccaggtatagtggtgcacacctgtagtctcagatatttgggaggctgaggtggggaggatcaactgagcccaggaggtcgaggctgcagtgagccatgatcactccattgcactccagcctaggtgacagagtgagaccccatctctacaaaaaaaaaaaaaaaaaaaaaaaaaaaaatcattggcaagtcattctgaatgaaggcctaaaatataggctggttagtgatattaaagggatacgctgccattcaccattgcatcctagtaagttgaatggtggcatt

SEQ ID NO: 60123 - DNA, 601 bp, Human
aaaatgcctactgtcaatattattcctccactcttccccaccccaagaggctatcactagacctccctacttctatacatgggagtggccataaaaccagacaaaggtggagatttcagtttcagaggatgctagaagtgtgaaatgttcaaacataaaaagatacttgagacctgatcatttcttttgggaaagattactcaacccaggaaatggtccaaactatgaaaccctgttcatgtaagaagatgcaggagaggtgggggcagctcctctttcatagttactctcctcatgggcrtgagattctttgtggactcttgaaacacaaaaagcattcccccactgattactatagatttggaggcagtgaggctcaacccagtatagatgatgtagattgacacagctgaagagtgagtaaaattgattacctggatgcagacacttgtttcccgcccccacccaagatagccagatatgcatcctctggggaaggaaaagaagacatctacaccacatggtatatacactgtatatattggaattctgtcaaagacaaaaaaaggccttgaaagcctctatattttaccttcttcct

SEQ ID NO: 60124 - DNA, 601 bp, Human
aaaagaatataattatcccatatttgatcctttgcagcacacaatgtgtgtttggatttagaatctgtgataatcctcattccaaaagcaacgataactgcaggaaagtatcagtgttctcatttttataaatgaattatatgagacaaagaaagattaaataattaacccaaagtgacaaaggtattagagccaggatttattcctaggtctcctgaatctaaacactgttcttttcccagtatacggttgatctcctatggactagcagccacctagaaggaagggcatagcagtaggwaggcaccagtgggcaggctgaattgaggagacttggagccaccctgatgtcccaatgcatactgaagccagatgatttctgcttttatcagcggagcttggtgaagtgaaagcaccctccccactccacatacactaccctactactttcctaaccaaagaagaaaatcaagaaccaagaagaaactcgtcatttcctgccattttcctggaggaggtcaaacacagggggaagggctcacttagcatatgaagtcttgggtttccaggttagaaaacaaggtccaaatgtttttaatga

SEQ ID NO: 60125 - DNA, 601 bp, Human
gataggggctgaaatgaccgtgatcatgatcggagcttggaaagtacatcatacagcagttggaaagtgaccctgaaagcttcacagaagcatgccatagatgaatgacacttgatcacgagaatgactggaaagcattcactaaagcttctaggaatgacatggggaggagaacagcaggggaaaacaattcactccctgactaagtaggagctcagaactgttatggtttgcacaataatgaggcaaagcctgtttttgtggtcttaagctggaaaagaatataattatcccatatttgatcctttgcagcacacaatgtgtgtttggatttagaatctgtgataatcctcattccaaaagcaacgataactgcaggaaagtatcagtgttctcatttttataaatgaattatatgagacaaagaaagattaaataattaacccaaagtgacaaaggtattagagccaggatttattcctaggtctcctgaatctaaacactgttcttttcccagtatacggttgatctcctatggactagcagccacctagaaggaagggcatagcagtaggtaggcaccagtgggcaggctgaattg

SEQ ID NO: 60126 - DNA, 601 bp, Human
tgctgtccagcctgaggaagtgtgagtcaattaaagctctttccttagattaacccagtctcaggtaattccttatagcagtacaagaatagactaatacactggtcaattttatcatttgaagtaaaacaatacaaaacaacaataacacaaaacctagtgaattctacattttttcgactctggaaaagggtgatatggcctcaagattttacaaagtgttagcatttgtacaaggactatctttaacttaagcaatcacattccccttcccccttttgttatttgtgtgaccttggaygatttattttacctaagtctgagatccttcattaaaaacagaataataacagtacctacctcacaggattataatgaggaataaatgagatagtgtttcagaacaaaaactgatcaaaaattatttcccaaagaaaaaagatgatataatgcatcaaatgagtaacattaactattttaacaattagctttaaaactttcttaaaaatttaaagaagcaactctaaatgtttaccacagttgtaaaatctcacacgaggttatttttgagggtaatgttttcgacacctgaggaattcag

SEQ ID NO: 60127 - DNA, 601 bp, Human
tgcagaatgagtattgatctaattttcactcatatcttaccctagggtcaaatatacagtgaaatatacctcaggatagacaccatatatatcagacttacatagaaatatccctctaggttggtgcatgagaatttgcaagcttcccaatgctataatagttgataggttttggatctgtgtccccacccaaatctcatgttcaataataatccccagtgttggaggtggggcctggtgggaggtgactggatcatgggggtggtttctcatggtttaacaccattcccccttggtgctrtcatcaccatagtgagttctcatgaactctggttgtttggaagtgtgtggtacctcccctcctctctctcttgctcctgctctggccatgtaagacgtctgctccctctttgcctttcagccatgagtaaaagctccctaaggctctccagaagcagatgctgtccagcctgaggaagtgtgagtcaattaaagctctttccttagattaacccagtctcaggtaattccttatagcagtacaagaatagactaatacactggtcaattttatcatttgaagtaaaacaatacaaaacaa

SEQ ID NO: 60128 - DNA, 601 bp, Human
gtatacataggtggtataaacacacgcacacacatgcacacacacagatacacacacatatatatgtatacacatatttatgaaaccaaatataaatattaggtatatgtatgtgtatgtataaatatatataaataggaggtgcatacacacatatatgcacacatatacacatatatgcacacatatgtatatacacatatacacatatatgtaaacatgcataatatatatttacatatatatttaaacattgttgctttcaaaccactcactgaatctttggctttctttttcactyttccctcactttttaaaaatattctttaacatgaagttaaaccaaaagcttagttgcccttttgcattcatgttagattgaatcatacagacttgttatatgagtcaaaaaaaagtcaaatattgacaattttaagtagtactaattaaaaattaacaatagaaaaaatagtaaaaatctaatgcctaatttacaaagtaatgtattaaagatgatgtatttctttgcttgcacataatttgagacagactaaagaaatcatttgggtttcaaccaagatatagcctgtgaaaaaatatt

SEQ ID NO: 60129 - DNA, 601 bp, Human
ttttttcaaagagcattagaggaagcataagtggaggtcaaataaaaatattttttctcattcttaattatctaacagataaaactgtgttttaataatactagcaacaatcgtacaataaccatagtttatctataaatgaaatgtgtgataacaagaacataagagaagtgagggaagaattaggagtatttcgttatagggtacttgtactactcatgaatctatatagtcttatttgaaggtggtcttgagttcattgtgaatgtctattgcaaactctagagcaagcactagaaasagtaaaaataaaaatataattgatacgataagaaaggagagaacatggaaccacataaaatgctcaaataaaattgcatacggcaggaaaagagggcaagacaaaaacaggaacaaagaacaaaggcaatgaatagaaaacagtaacaaacatagtagacattactcaaactatattaataatccctccgaatgtcaatggtctaaatataccaatgaaagaacagagatagtcagagtggatcaaaaatcaagatccaaccacatgctgtccacaagaagcccaattcaaatataaata

SEQ ID NO: 60130 - DNA, 601 bp, Human
cctagtgatatttggctgtgtccccacccaaatctcatcttgaattgtagcaaccataatccccacgtgtcatggagggacccaatgggaggcaactgaatcatgggggagagtttttcccaaggttttctaatgatagtgaataagtctcatgagatctgatggttttatacaggacagttcccctgcatatgttctcttgactatgccatgtaagatgtgactttgttcctctttcgccttccaccatgattgtgaggccttcccagccatgtggaactgtaagtacattaaaccacaytttctttataaattacctagtctagggtatttcttcacagcagtatgaaaatgaactcatacatctagcttcaatgcctacccatccatacctactatgttatcgaatacaaggtttaactgagataatatctggtttgatatttattatgttgacgtcatgtgacatataaatatattcttaaattaaattatatgttcatatatgtattggtcagtataatgctagctgcagttacagacaaaatccccccaatctcagtgactaaatacagtctggttatcattctcatgaagttta

SEQ ID NO: 60131 - DNA, 601 bp, Human
ttttattcaaaaggaagtagttttatataaatatttatttcactggcctaggctttagacattaaaagacaattgctgcttaacaatggaattgcccagcctggcatctatttttgcactactcttaggttgcatatagaatagttttgtttcatttgtcttattttaaaaataactctaatagtaaatgatagcaacatcatcatcctcattaataataataatatatacagtaatgataatttggtcttatagtgtgcttattatattccagaacagtacttagtactttacacatatyagagttcattctcacaaagatcccatgaggtagatactattacattcactttagcagtgagaaaaatgagagtgaatagtggagttgcaatttaaactctatagcctagtgatatttggctgtgtccccacccaaatctcatcttgaattgtagcaaccataatccccacgtgtcatggagggacccaatgggaggcaactgaatcatgggggagagtttttcccaaggttttctaatgatagtgaataagtctcatgagatctgatggttttatacaggacagttcccctgcatatgtt

SEQ ID NO: 60132 - DNA, 601 bp, Human
gtaaaccatgctgtacacagatgggctgtcatctaggctctgttccatttatagagcacaggcagtgtagatttagcaaattcttaagggccgtaggattttcataatgataaatgagcattgggttccacttaaagccgccagctacattagcccctaacaagatagttagcttgtcctttgaagctttgaagccaggcattaacttttctgactataaaagtcctagatggcttcttcttctaataaaaggctatcttgtctacattgaaaatctgttgtttagcatagccaccatcawcaataatactaactcgatcttctggataacttgctgcaatttctacatcagcattcgttgctttaccttgcatgtttatgttctggtgaaggcctctttccttaaaccttctgaaccaacctctactagcttccaacttttctcttgaagctttctcacctctcccagcattcacagaattcaagaaatttagggacttgctctggaataggctttggcttaagggaatattgtggctggtttgatgttctatccagactattaaaaccttctccatatcagcaataaagctgttttgct

SEQ ID NO: 60133 - DNA, 601 bp, Human
tgatcttctcccatgaatcacaaatgtttataacggtatatggaatactgtattctttccggaaggttttcaatttacctttttctgatcaagcagaacaattagtagctatggcagccacagccttgggaaatgtattcctgaaatataagacttgaaagtcaaaattactccttgatctgtcagctgcaaaatggatgttggttagcaggcctgaaaacatcattaatcttcttgtgtatctccatcagagctcttgggtgaccaagcgcactgtgcgggagcagtaatattttgaaaygaatcttttattctgaccagtaagtctcaatagtgggctcaaaatattaagtaaaccatgctgtacacagatgggctgtcatctaggctctgttccatttatagagcacaggcagtgtagatttagcaaattcttaagggccgtaggattttcataatgataaatgagcattgggttccacttaaagccgccagctacattagcccctaacaagatagttagcttgtcctttgaagctttgaagccaggcattaacttttctgactataaaagtcctagatggcttcttcttctaataaa

SEQ ID NO: 60134 - DNA, 601 bp, Human
ttttaaggctgatcacagtggctcatacctgtaatcccagcactttgggaggccaaggcaggtggatcatctgaggtcagaagttcaaaaccagcctggccaacatggtgaagccccatctcaactaaaaagtacaaaaattagctgggcgtggtgggcatctgcaatcccagctactcgggaggttgaggcaggagaatggcttgaacccgggaggtggaggttgcagtgagctgagatcatgccactgcacttcagcatgggagatagagtgagactctgtctcaaaaaaaaaaaaaaatttaaacaaaaatttagtccaaagattaaatcatttatggtatgctgcaattttttaaagctaaaagtaaatgtataaaaatgcctgcaactcaacaataaaaaaaaacaaataacctgattaaaaaatgagcaaagtatttaaatcaacatttctctaaagatgaccaagaaacatatgacaagatgcttagccttactaattatccgaaaaatgcacaccaaaactataaaaagctaccacctctcacccattaggatggcaactatatatatatttttaaaaaagtgttgaggatgt

SEQ ID NO: 60135 - DNA, 601 bp, Human
aaaacagttcagtttttgtttctcctgtttccatttcccttatactttcataccaggaataatagcacatgttcatatcagaatctgtaatcccaaacacctgtgtggcataatgcagttacgtttgttggttgaaatatttctggaagttattcctatattgggatgattagcagcaactcaaatgcatacagaagtgacagtgaaccttctcttttcccccattgttttgtagaaagtgttctgtgtatgagaattttgcagttggatctgtcctttacaagataggaaaatgatcaawtgagaagaaaaaaaggacattattcagagatcctagacttgaaactgtttacaataacaatgaaattttgaggtgatgtatttttgtagaggggtcatattttcagtttactcttgtgaactgcattttacaaaggaagtatttctaatttttagaactgtaagtgatgttgggagacctaagagaaaatgtacagttctaggggtaattactagtgctcagtcttaaagtactttcatcaggtaacttctgcaaagtaaaccggggcactgttcctgcctgcaaaggttccaagcctga

SEQ ID NO: 60136 - DNA, 601 bp, Human
acaaatcctacattttgtattttacatgtataataattggaagaacgtgaaagaatgtttttcattctaaactatggctgaaaacagttcagtttttgtttctcctgtttccatttcccttatactttcataccaggaataatagcacatgttcatatcagaatctgtaatcccaaacacctgtgtggcataatgcagttacgtttgttggttgaaatatttctggaagttattcctatattgggatgattagcagcaactcaaatgcatacagaagtgacagtgaaccttctcttttccyccattgttttgtagaaagtgttctgtgtatgagaattttgcagttggatctgtcctttacaagataggaaaatgatcaaatgagaagaaaaaaaggacattattcagagatcctagacttgaaactgtttacaataacaatgaaattttgaggtgatgtatttttgtagaggggtcatattttcagtttactcttgtgaactgcattttacaaaggaagtatttctaatttttagaactgtaagtgatgttgggagacctaagagaaaatgtacagttctaggggtaattactagtgctc

SEQ ID NO: 60137 - DNA, 601 bp, Human
tgtcggtgagatacaaatcctacattttgtattttacatgtataataattggaagaacgtgaaagaatgtttttcattctaaactatggctgaaaacagttcagtttttgtttctcctgtttccatttcccttatactttcataccaggaataatagcacatgttcatatcagaatctgtaatcccaaacacctgtgtggcataatgcagttacgtttgttggttgaaatatttctggaagttattcctatattgggatgattagcagcaactcaaatgcatacagaagtgacagtgaacmttctcttttcccccattgttttgtagaaagtgttctgtgtatgagaattttgcagttggatctgtcctttacaagataggaaaatgatcaaatgagaagaaaaaaaggacattattcagagatcctagacttgaaactgtttacaataacaatgaaattttgaggtgatgtatttttgtagaggggtcatattttcagtttactcttgtgaactgcattttacaaaggaagtatttctaatttttagaactgtaagtgatgttgggagacctaagagaaaatgtacagttctaggggtaa

SEQ ID NO: 60138 - DNA, 601 bp, Human
tttggcttcatgtgacatacttactttcttttatgtatgaattgtagaatgaccaatgattctgaagaaatacacaaaattattataaaattaaggcctataattcaaataataaggcctatactttaaaaattaaaagttttaaactgtaggatcacattattctcataacttatacagatcacattatcctcataacttatacagaatgttagataaatctatatatagaactttcgttactggaaaacttacttcttcaagctatttgtgtgtgtgtgtgtgtgtgtgtgtgtatgtgtatgtgtgtgtcagtggcaactttgtatgttatttctctcggagtttccaggcctcatctggacaattatatgtttgatacaatatgctgagagaaattcgataggtgagatccatacaatgtgtgaaaagagtgttaggtgttctcgggcctgctatgagtttatgtcatgcaaacacaagaattcagataaagtcttttgtgtgggattccaataaaagaaggaaaaggtggtgtgcttattcaatatttcttcaaaggacagaccttttcattttgactaggtgtcggtgagataca

SEQ ID NO: 60139 - DNA, 601 bp, Human
attattttggcttcatgtgacatacttactttcttttatgtatgaattgtagaatgaccaatgattctgaagaaatacacaaaattattataaaattaaggcctataattcaaataataaggcctatactttaaaaattaaaagttttaaactgtaggatcacattattctcataacttatacagatcacattatcctcataacttatacagaatgttagataaatctatatatagaactttcgttactggaaaacttacttcttcaagctatttgtgtgtgtgtgtgtgtgtgtgtgtggatgtgtatgtgtgtgtcagtggcaactttgtatgttatttctctcggagtttccaggcctcatctggacaattatatgtttgatacaatatgctgagagaaattcgataggtgagatccatacaatgtgtgaaaagagtgttaggtgttctcgggcctgctatgagtttatgtcatgcaaacacaagaattcagataaagtcttttgtgtgggattccaataaaagaaggaaaaggtggtgtgcttattcaatatttcttcaaaggacagaccttttcattttgactaggtgtcggtgag

SEQ ID NO: 60140 - DNA, 601 bp, Human
ctgtaatttctcagctttttccaaaaggtcaaaattgaaattgcagtttaaatgtcacattccactgtgtgaagggcacacaagatatctttttattattacttaacaactgcatgtgaatctgcaattattcatttgtataaccatagatggtatatggtatctggtttactcatttaccattttgtatatgctttcccattatttacattaattcttcttaatcaattttggacaaataagtcacatttgacattgcattttgacatttttccagtgcttgtccaaaaaaaaaaaaaaagatcaaatttaacaattactttgaagattcccatgaaattgtcatttaaaaataaatccttttatcataacctgccaatgaaaatctcttccgcttaataatttttaaacctcagctacattttttaggcacttcaaaatgatagagaacattattttaagccttgtttttcaagatattgtctggctagagcagtgttattttcattttgtcatgcgttgaaatcgcccaaaggacttggtaaaacaagttactggacccattcagtaggtctacagtggggtccaagaattttgattt

SEQ ID NO: 60141 - DNA, 601 bp, Human
aagattaggaatttgagaccagcctggccaatatggtgaaaccctgtctctactaaaaacacaaaaattagccaggcgtggtggcgggcacctctagtcccagctacttggggggctgaggcagaagaatggcttgaacccggaaggctgaggttgcagtgagccgagatcgtgccactgcactccatcctgggtgacagagtgagactccatctcaaataaataaataaataaataaataaaaattaaaataaaaaaatagcggattctgacgagacagtagagaaaaaagaatgcttayacactgttgataggaatgtaaatgagttcagccactgtggaaagcagtttggtgatttctcaaagagcttaaaacagaactactatttgacccagtaatcccattactgcatacaagcccaagggaaatcaaatcattttaccaaaaagacacatgcaattatatgttcatcacaggaccattcacaatagcaaagacatggaatcaatttaggtgcccatcagtggtggactggataaagaaaacatggtacatatacatcatggactactacataaccataaaataatgaaatcatgc

SEQ ID NO: 60142 - DNA, 601 bp, Human
cattgcacaatgccaaacacatagaaggaataaagtaaacgttttctgagtgagtgactgattacacttttgagttacactgaagatgatttaattttttaaattgcaattttaaaaactatcttatatttcctttaaaaaatatcagttattcatcagtgagtttacaagcaatgtcagtatcattataagtgtaatgatctagcactgtgtgtcttctgatattatatgaagcacatggcactactcaagaagtaaactcaccatcaagaaagaaagaaagaaagagagaaaggaaaamaaagaaaagaaagaaaagaaaggacagaaaagaaagaaaagaaaggaaggaaggaaggaagataggaaggaaggaagagaaagagtgagaagttgaacccaaactttaatctagaaacagtggttctcaaaatgtgctggttgcactagcaggatcagcatctcctggaaacctcctagaaatgcaaaggctcagctccctcccaagatcaactttggatgtaggcccagcaatctgtgttttaacatgacctccatgagattctgaggcacagtcaagcttgagaaccacttgtctgga

SEQ ID NO: 60143 - DNA, 601 bp, Human
tcccctgtttagtgagaggtcctcagctcctcggtctacactctcatttttgccagagtcatagctggagtaactatgtgcaggagactgaaaagagaaggtgaaataactgcttttaaattcattgcacaagcttataagttttatgtttcatctttaatttcaactgtttctcaaaaatcttgtttatgagttgataactctagagctgtggtgattttagtttaaataaaaattaattcaaattaaattaaaatttcatttccttggtcacgtcacactagttacattgcaagtactygttagctgcatggaacgtttccttcactgcagaaagttttattgaacttagctatgcaagagcaattagtgtttcctctcaatactcatattccaaataaaaaagcaatctgtaatcgattttgcaagggaatcattgagtcacatattcttagaacttaatatgacctcagagcattgtcaatattagtactagtattacactttatataatattgtattatatcatatcagtattatgctaactttattagtattctttaaacagttatggaaactgagggatgttcaattaacttac

SEQ ID NO: 60144 - DNA, 601 bp, Human
cctctactgtgagctgtgtttgacaaatagaagcaaatgatcgaaaagttaaatcctctaaaaaaacatataatttcctaaacatgaaaggcttgctttctggtgctttcataattagactatttatttatttgtttctaaatttatatctcctcttttccattaaaatttatcaaatccaccaaggaaagttgtctccaccaagataaattaaacagaaagacaatggagagtttggctctgaactccctggcagtaaggcacaaaagtgaacatattaaggttcacagtcccggtgttragaacaggtaaaagcattccatttcctcaggaaaacaattatttttcttgcattaaattctagaagaaacttctgaaatcagattttctgtcatggacatttagcagcctagtaaacaatgaccttgacaatacaaaaacttgcatgagatttatttctacaagggaaaagagtcaattgcataacattaaaagcaactatctaggtaatttttcaatagattgagattattaaatttaaatatctaggctatttggtttaactaggtacagtggcaaaacttgggatacaagaggagca

SEQ ID NO: 60145 - DNA, 601 bp, Human
atagcaagtgtcactgtagctattcccatgcttatgatatcagggaaactatgtattgaaaacaaggtctgatccctctactgtgagctgtgtttgacaaatagaagcaaatgatcgaaaagttaaatcctctaaaaaaacatataatttcctaaacatgaaaggcttgctttctggtgctttcataattagactatttatttatttgtttctaaatttatatctcctcttttccattaaaatttatcaaatccaccaaggaaagttgtctccaccaagataaattaaacagaaagacaayggagagtttggctctgaactccctggcagtaaggcacaaaagtgaacatattaaggttcacagtcccggtgttgagaacaggtaaaagcattccatttcctcaggaaaacaattatttttcttgcattaaattctagaagaaacttctgaaatcagattttctgtcatggacatttagcagcctagtaaacaatgaccttgacaatacaaaaacttgcatgagatttatttctacaagggaaaagagtcaattgcataacattaaaagcaactatctaggtaatttttcaatagattgag

SEQ ID NO: 60146 - DNA, 601 bp, Human
gatagaaaggtaccatattatatgctatacatatacatacatgatcacatatagtaccccaatagccctatcctttagaagagactcagaaacaccacacttgtacaggaattgaactaagcaaggcattgaagctaggtctctcagtttcaaaaggtcatacgctaaaacattatagaaagaaatatgaaatttgttctgccaggtgtggtggctcacgcctgtaatcccagcactttgggaggccaaggcgggtggatcacctgagatcgggagttcaagaccagcctgaccaacatgragaaaccccatctctactaaaaatacaaaagtagccaggtgttttggtgcatgcctgttatcccagctactcaggaggctgaggcaggagaatggcttgaaaccgggaggtggaggttgcggtgagctgaggtcatgccattgcactccagcctgggcaacaagagtgaaactccgtctcaaaaaaacaaaatgttctaacatgacagagtttcacattatcaaagccaaaattgaggaagactactctaggagcaaaggcagatttatcataaagtcaataaaagtgaggcataggatg

SEQ ID NO: 60147 - DNA, 601 bp, Human
ttcaagtctgatgatgaattgggagttataatccctagtgaactattattcacattttacaacaaagtccccactgagtttaaataaatctagaattcttaaatactacacattcctgtgaggaaattcaatcacagctaaccacacattgcatttagcaaagaatatatcaagatctccctagcatccttcagttaaatggttgaagtcctttaatatattttcctataaattctataaattatgaaatttatgatcttcattaaaagcacaaagacaaaaatgtaacttagctaagttrtgccacaaattcttaactgatgtaatctgaattcataagattttaaagtttatacagccagaagtgtcaataaattactatacacgaaccataataaagcttaatttcatgcccaaaatgagaatacaggagccaggcagaaaagttctttccctcctgtgaggcaatcatgctaaaaatctctttgcttctaatattaatgagccaataataaatgccaatactctccaatacacacagggctcaagtgtgcagcatttggttataagatagcaaagacaaaagtttaaaaaaatttct

SEQ ID NO: 60148 - DNA, 601 bp, Human
aaggtcatgtgataacctaatatttaaaaattaacttcaagataaagcaaccatgcacactatcctattgagtggaaaaaataagtagaatcaaagatgcatgattcaatacttcccgtagataaacagtataattttgaaaatagatttgtactgagtttattgtaggatcataagttgacaactctcaatggccatagaagtcatccagtacaagtttcttctctcaactttgaagaactgaaacctaggtagattaagtaattgcaaaaggacaaattgaactagatccagaactcasgtttcgtgtctcccaattttcaactctcactttcctaaattctgttgtatatttagtacttttacatactttgtcattaataaaacaaaaaattctttaaaaaatctgtatatacaaaccattgttttcaactaaaaaaataagcagaacaaaggtagacatgtacatgaatgtgttataatcatcattaactcaagctcattggagaaaaaggcagaataaatcataaaatctgtgttacaatcaaaaaattatattttaaatgtatttttgcagagaatgtactatatctcaataatg

SEQ ID NO: 60149 - DNA, 601 bp, Human
ataaagctatagaattttactaaatgattacattgtatcaataggcacacaagtaacttaaatacataaaagttcgtttaacatggagaacgtaagtaaaataccccttcaattaatattatttcatggcattttctttcaaattcttattaatttttaaaaacaacttttactactcaacttctactaaagcagtaaaagttgttatgcataataatttatgtaatttccttttcagaaaagatgaaagggagagttggatctttcctagatgtgtgaaattagtcttctcataaactagagtaatgtcctggctaattagaactagatatattttaaggtcatgtgataacctaatatttaaaaattaacttcaagataaagcaaccatgcacactatcctattgagtggaaaaaataagtagaatcaaagatgcatgattcaatacttcccgtagataaacagtataattttgaaaatagatttgtactgagtttattgtaggatcataagttgacaactctcaatggccatagaagtcatccagtacaagtttcttctctcaactttgaagaactgaaacctaggtagattaagtaa

SEQ ID NO: 60150 - DNA, 601 bp, Human
gttagcattattcaaataggagtgagagtttatatctttataaagtacattattagatcttttgtttccagggatgaaattaagagaatctaaataaaatatcagcaaccatccttttcttaatccaattattgagagccacatgggattcagagagacatattcagttcttcgttacctcgatttttctctctttttttcagctatcaccattaaaaattaggaatatataaagctatagaattttactaaatgattacattgtatcaataggcacacaagtaacttaaatacataaaarttcgtttaacatggagaacgtaagtaaaataccccttcaattaatattatttcatggcattttctttcaaattcttattaatttttaaaaacaacttttactactcaacttctactaaagcagtaaaagttgttatgcataataatttatgtaatttccttttcagaaaagatgaaagggagagttggatctttcctagatgtgtgaaattagtcttctcataaactagagtaatgtcctggctaattagaactagatatattttaaggtcatgtgataacctaatatttaaaaattaac

SEQ ID NO: 60151 - DNA, 601 bp, Human
aaggaaattagaaagccaggactgggtatttgtaatagaaaagagggtcaaatgaggcaaatctaaaataaattgccataaagatgtaagcataatttcaaaactcatattgcttcttcatttcattctctacttcactaagtataaagaaaatattgtagtccaaagccaaataaattaagctataaaatcagtctcattaaccgatgatcactgcctggctcaaaaatgtagtccaactacatgggaattagatactcattgatatctttcttgattgagctaatttttgaggcaaagrtgttataggaaaaatgggaataagaacattacattatcaaaaaataaaacaaattatttgattgtagttagcattattcaaataggagtgagagtttatatctttataaagtacattattagatcttttgtttccagggatgaaattaagagaatctaaataaaatatcagcaaccatccttttcttaatccaattattgagagccacatgggattcagagagacatattcagttcttcgttacctcgatttttctctctttttttcagctatcaccattaaaaattaggaatatataaa

SEQ ID NO: 60152 - DNA, 601 bp, Human
aagaagaaaagaggtccatgggtggcaggaaaaaaatgcaatataagcattttgagaaggaaattagaaagccaggactgggtatttgtaatagaaaagagggtcaaatgaggcaaatctaaaataaattgccataaagatgtaagcataatttcaaaactcatattgcttcttcatttcattctctacttcactaagtataaagaaaatattgtagtccaaagccaaataaattaagctataaaatcagtctcattaaccgatgatcactgcctggctcaaaaatgtagtccaactacakgggaattagatactcattgatatctttcttgattgagctaatttttgaggcaaagatgttataggaaaaatgggaataagaacattacattatcaaaaaataaaacaaattatttgattgtagttagcattattcaaataggagtgagagtttatatctttataaagtacattattagatcttttgtttccagggatgaaattaagagaatctaaataaaatatcagcaaccatccttttcttaatccaattattgagagccacatgggattcagagagacatattcagttcttcgttac

SEQ ID NO: 60153 - DNA, 601 bp, Human
atctcaaataatattctagaacagctaaattcagaccacaccgttttaacagacactccatagttaaatttgtacagtgtagacagagaccaggctctgaccttgggtgaactaggaagcaatttctgcagctgccttagcagacttcctcactactccccctccaaagtagcctctggaggcaaaaggtaggaaaggtatagggtacatactcttctgctaaccccatgggacatctcaaatgatggttacactactttgacaataaagcagttggatatttggaatgtcatttttgcaraaaagaagaaaagaggtccatgggtggcaggaaaaaaatgcaatataagcattttgagaaggaaattagaaagccaggactgggtatttgtaatagaaaagagggtcaaatgaggcaaatctaaaataaattgccataaagatgtaagcataatttcaaaactcatattgcttcttcatttcattctctacttcactaagtataaagaaaatattgtagtccaaagccaaataaattaagctataaaatcagtctcattaaccgatgatcactgcctggctcaaaaatgtagtccaacta

SEQ ID NO: 60154 - DNA, 601 bp, Human
aaagtcagtcctacaatgatttttatatattaaaggtttagtgctttagatgtgagatatgtttgcctatgtgtacatgcctgttttgttttacttataaaatatgagctgatattttatagggacgtgttgaaatccatcttctatgtagcccacatagaaagaattaattctccaactaagctcatgattaactgtaaattgtttgcagctctcaatatcattcatgataaccataacaaaaattatgattttcattcttttttccataattacatgcaaagtcatccaactgaaagaygaaatacttaataatatagaagttttttttaaattaagataagcaaatgatagatgagaaataacaaaattaaaccaaatgaggtagtaaaataatgtgaaattatgaaataaatgtatcttttgggaatatagcatatacagtatatgccaccttagggttttcaaagcctcaaacgaaaatatgtgtgaatgctatttattagaagcctgaactaattgagaccttttgaatttttttctaaaggaattgaaacaaaccttttttatacatgactcattttaccaactctggcatgta

SEQ ID NO: 60155 - DNA, 601 bp, Human
tcggggagtaggaggctaggggagggatagcatcaggagaaatacctaatgtagatgatgggttgatgggtgaagcaaaccaccatggcacatgtatacctatgtaacctgcacgttctgcacatgtatcccagaacttaaagtacaaaaaacaaaacaaaacaaaacaaaacaaaaacgggggaaaaaaagaaaacagtatttttttgtgtggagatattattggatatcctccattcctagaaacagagccttgcaataaatatatgaggacatataaaaaggagagaatatggagagyagggccaaggaccactggtcctcattcattctagtccctactcctggtgcaggagtaagaagtcccatttttaattatttttagaagtttttcttcagtgggtagaaagtctatgaagtaaatttgagctcaatgtaaagaccttcaaaaacaatgataaatctctgacagtaggaaagtgtgtcagtaaatagcagatctttagtaccagtgtgagatttgagatattaaagcaaataacaaatatatctttaacaacatataaacgtatgaaatacataatgcttttatatgaattga

SEQ ID NO: 60156 - DNA, 601 bp, Human
ttgccattgcttttggtgttttagtcatgaagtctttgtccatgcctatgtcccaaatggtatttcctagattttcttctagggtttttatggttttaggtcttacgtttaagtctctagtccatcttgagctaatttttgtataaggtgtaaggaaaaggtccagtttcagctttctgagtatggctatccagttttcccaacaccgtttattaaatagggaatcctttcctcattgcttgtttttgtcaggtttatcaaagatgagatggttgtagatgtgtggtgttatttctgaggyctctgctctgttccaatggtctatacatctgttttggtatcagtaccatgctcttttggttactgtagccttgtagtatagtttgaagtcaggtagtgtgatgcctctagctttgtcctttttgcttaggattgtcttagctatatgggctcttttttggttccatatgaaatttaacatagctttctctaattctgtgaagaaagtcaatggtagcttgatggggataacaatgaatctataaattactttgggcagtatggccattttcatattgattctttcgatccatgagcaagg

SEQ ID NO: 60157 - DNA, 601 bp, Human
cctaatttcaatattactgtgtttcagggaatcagaaaggctgaagaaagagagagacagggtgatggctggtgggtggggtggtcaaaatacacacatttattaagttctttgtcttaatttggcatggttcacggtgtcccaaaataagtactatagcaacaccaaagattactgatcacagatcactatagcagatataatcatgatgaaaaatttgaaatattgtggagagttaccaatatgtgacatagagacacacagtgaccacatgctgttggaaaaatggtgctgacagacytgctcacaagattgtcacaaaccttcaatttgtaaaaactgcaatatctgtgaagcacaacaaagtgaagttcaataaaatgaggaatgcttgtgcttcatttttcctatatagtatattttcttctgtgaatgaaagtgtcatgttgaagcacattgagaaactcaaagatacagggttttccccctaacatatgtatgtaagagagaaaaatgccaggagtaaagtaaaaagctgaggatgactgagaataagtgtggactggcaggccatagaaataagtttcaagccatatcttgt

SEQ ID NO: 60158 - DNA, 601 bp, Human
agccaggcattaatttcttctctctagctataaaatactaggtggcaccttttcccaatgattcactacgatgatgtagtgatttcatctacattataaatctttattgttttagtgtacccactttcttcaattatcttagctggatcttctggacaacttgctgcattttctacctcagcacttgctgcctccctttccatgtttatgttctggcaatggccactttccttaaatctcatgaactaatctctgctgtaatagcttctgacttttctcctgcagcttcctcacctctctyactcttcatagaattgaagagagttaggatcttgctctggattaggatttggtgtaagggaatgtggctggtttgatcttctataagaccatgaaaactttctccataacagtaataaggccgttttgcttttttatcattcttgtgttcactggagtagcacgttttttttttttttttttttgatacagggtctcactctgttgcctggaggcggtggcacaatcatggctcactgcagcctcaacctcctgggctaaagcaatcctctcacctcagcctcccaagtagctagaacta

SEQ ID NO: 60159 - DNA, 601 bp, Human
ataaattgcacttcaggtcttaaggtagggcatttcaaggtaattcttgtaaaaaataatgccatgttttttaggattaggaattactggctttgcgtcaaagatttcttaaagttaagacaagcttttaataggcatatacctataaaataaactaaaattcatcttttataggaataaaatagaaaataagaacacactacctgtttattaaaacctttaaaaaccttgctgctgtgtgacccagtaattctacttctcataatttatcctaaaaaatagcaaggcatcattttcataygcaaattatgatagaaaaaaagtaaaattagcacttaatatttaaaaaatgaggtggtggaattactagtaaaatttcttatttatgtatttcattatttcctaattataaaaaatcctatgtgattgagaagagtattaaaaatgaaaatatttttaaagtatgattctaaagtcatgaggattggatcaaaatggggccccatcctgagcaattctgtgacctggagaaattttttcaacttttctgagccccaatttctatactcttataaaaagtatggcaattataaaagaaagg

SEQ ID NO: 60160 - DNA, 601 bp, Human
tcaaagtcagtgatactaccctcttgggaacattggggaactctatagcaggtgctactgacattaagtaggtggggtgatggggaaaagtttactacaagccccgacattttccaggcagtctcatgtgaccaagaattgtatctgttcccctgggaattttttaaagtagtgtctgagcacagtggctcatgcctgtcatcctagtactttgggaggccgaagttggagaatcacttgagcccaggagtttgagaccaacctgggcaacacagcaagatcctgtctctaaatttttttkttttttaattagccaggtgtgatgacatgtgtttgtagtcccagttacttgggcggctgattcaggaggattgcttgtgcccaagagtatgaggctacagtgagctctgatcatgccactgtactccagcctgggtgacagagcaagaatctgtttcttaataaaattaaaaagaaaattaataaaaatgaaagttttgcagatatcagttaaaagcctttttagaattttctgagcctaaaacataatcttagtttggtataaatgcaaagtttttatgtttttaaatatatatattta

SEQ ID NO: 60161 - DNA, 601 bp, Human
acactgataacacagcaaagattggggttcttcctgagggtggaaatttgaaaaatgtataaggatttatccatttcaggaaagttgatcttttgtcatgaaatgaagatacattgattatattttggaaagattttaactaaaaatacaagtaaaaaaaagtaaaataaatttaaatcagtaatctccagctctttagaaatcccagttatgtagaaacactaatgccccaaagtgctaaataactgaggtaacaagtatgtgttcctcgaggccacaagtctcaccatatggaccacaygagacatgtcacacatgacacaccgcttcctttaggaagcatagcccaatttccccagctattatattatctaactccataatgaatttgtgactctagttcagtttctctaatacacatatattgttgtttcacagtaactaatgggttttaaagtggacagattgaggagaaaggacagggcaaggaatgaacaaattatgagaaataaattataaaaatgaatccacgtggcataaaccaaatatgtcaggtcttcgtttatccactaagcctaaaaataattggtttaaaaataac

SEQ ID NO: 60162 - DNA, 601 bp, Human
ccctaaaagtaaactttttgtgatgctatgcaagaagttacatatggatatttattacgtacctaccctcatcccagtatgtaaatacacatatttagggctcactgtgataaaaaggcaatgctgttttattcctacaaagtgatataaaattgtcgagtcaaacaattgttgagtgcaaaagacatctggaggccattacaatgttagcggggaatataattaattactaaaatatgtagtgctgatagttgttgctacatagagaactagaaaagggacttaattttgtggactaatrtttgatctagggtgttgttcttaaagcaggtgcactttgagatgggtctacaaataaacataggagtgaaattgaactgagaaactgcctggataaagacaccctggtggaaagagctaggacagctgtgccactctcaaatatatctcaatcccccaagtatcatttatgcagaaagaaaacaggagcaacaaggaggaaacacatttcttacttgtgtaaatttcagtcataaataataatagtgataatgtatacctgagtttttgaaaaaaataaatgagaaaatatgttaataca

SEQ ID NO: 60163 - DNA, 601 bp, Human
cttgtgattttccctatttggtgctaaaactgtgtttaatatgctgttggacaatattttaaactacggcattaatcccagtgagtacctctctattgggccatctattaccattctcaggcaccagcattcctatcgtgtggtgggcttctcactcaaagcctcttcccctccctaaaagtaaactttttgtgatgctatgcaagaagttacatatggatatttattacgtacctaccctcatcccagtatgtaaatacacatatttagggctcactgtgataaaaaggcaatgctgttytattcctacaaagtgatataaaattgtcgagtcaaacaattgttgagtgcaaaagacatctggaggccattacaatgttagcggggaatataattaattactaaaatatgtagtgctgatagttgttgctacatagagaactagaaaagggacttaattttgtggactaatatttgatctagggtgttgttcttaaagcaggtgcactttgagatgggtctacaaataaacataggagtgaaattgaactgagaaactgcctggataaagacaccctggtggaaagagctaggacagctg

SEQ ID NO: 60164 - DNA, 601 bp, Human
atttgcatcttaaactgaataactatgattacaactaagcaaaacatttaggaaaaatgattaagagcatttaaaaatagatggggggctgtgtgtgtatgtgtgaaacattttacctttttaacaataacaacataatagactacgtatattttctacattcatgaaagagcaatcatgtacctattggttcatgtttcaccttattctttttaaatgacaactccaatacttatgctctgcatatctatcattgattttagattactgtaatttcttcatattttgatacaaaatttcmtattgtataagagtttttatatagtatgtatgagggacatagagagagggaaggagagagggaagatgagagagagacgagacagaaggagagagaggtctattacagtctcctgatgttaaaatttgtgcaacttaaaaatacaaaaaaaatgaatatattggttgtaccccaaatctttaaataaataaaactctaaaataatgtgtaagtagttttccctcacttaaagagagttggtggtagttatatattttgcatctgtaaatacactttaaattatgtgccttcaatatttct

SEQ ID NO: 60165 - DNA, 601 bp, Human
gagaggaggtgagagaagggacacaaagtctaagtgcagccttttagagcctagtaaagactttggtgctctctcttaataagatggaaagccactggaagttttcagtcaaataataatgacataaactgaaattttttaacaagattactctggcaacatataaacaacagactaaatgagggataagagcaagaggaagaggatgactggctaggaagtcattgtaataattcagatgagtcatgatggtgagttggaaaaggacaaaaggtaagaacagtgtgggcagattgacttytggacatattttgaaggtagtgccaaaggattgatgtgtaatgtgaaaagaagggggaactcaatggtaaccccaaggattctggtcaggccaactgtaagaatgaaggacattaactgggttggggttgatattgtgaggtctgttttgtacacattatgtttactccatttaacatccatccaagagtacatgctgaggaagtggttggatatatggatctggagttcagggaggagtcctggctgggcatatcaatttgtgagtcatcacattacagatggtattgaaagtggtggg

SEQ ID NO: 60166 - DNA, 601 bp, Human
aattataggagaggaggtgagagaagggacacaaagtctaagtgcagccttttagagcctagtaaagactttggtgctctctcttaataagatggaaagccactggaagttttcagtcaaataataatgacataaactgaaattttttaacaagattactctggcaacatataaacaacagactaaatgagggataagagcaagaggaagaggatgactggctaggaagtcattgtaataattcagatgagtcatgatggtgagttggaaaaggacaaaaggtaagaacagtgtgggcagwttgacttttggacatattttgaaggtagtgccaaaggattgatgtgtaatgtgaaaagaagggggaactcaatggtaaccccaaggattctggtcaggccaactgtaagaatgaaggacattaactgggttggggttgatattgtgaggtctgttttgtacacattatgtttactccatttaacatccatccaagagtacatgctgaggaagtggttggatatatggatctggagttcagggaggagtcctggctgggcatatcaatttgtgagtcatcacattacagatggtattgaaa

SEQ ID NO: 60167 - DNA, 601 bp, Human
atccagtttcctgagttagagactcaggagaatcataatcaaccgtcccctttttattatctcatgtctataacccaggaccaagtcttatacagtctaattttgtttatgaataaaaacttaataatctgttggatgccttctatctactaggctagacggtcatctgggtgctgggaatatatcaacagaaaaaataaacatgatccctgccctcatgggatttccagggctgcgaaggaaggataggcaagaggaaggataaaatatataaaaaaaaaaattatttcatgcagtgatraccattaataatgaaaaaaatgggtgatgtaaactaatgattggggatgggtgttcaagagggaaggtctttctgagaaaaacatgtaaaccgataagccatcaaaagaatgattttaaaaaggcagtcatgtgaagacataggctaagtgcatgtgtgcgtgtacatatgtgtgtgtccacactacacagaaatacatcctacatttgctataaaactttctttgtatccaaagatttctgactatgctcttgaggattttgtttaattgtgccacgtagtattcacatagtttagaac

SEQ ID NO: 60168 - DNA, 601 bp, Human
ttttaggtgttctctactgtaacttctcaaaaatatgcacatatgcacctatcaatgttatttaacactacttggatttggaaagtagtggttttatcttccttaagatattgaaatatattactccacctcatgttaagttttggtagaaaagtatatctaagcttctattttccttccatttttattctctaggagtcttttactttatctgcataatttccctgcaagatctcatctgttgtttatgactttatctaccacttctttaccaatgacttctaaatctaaaattgcaatkaaaaccttttcctaagtccacatttccaagtggctactggacataacaacctacatatcccacgattacttcctaggcattatatccgaaactgtgcactttaacttcccatgcaatcacttctccagccataatttgctgtttcctgaaatcctgatcttaattaatgatgctttcatttatccagtttcctgagttagagactcaggagaatcataatcaaccgtcccctttttattatctcatgtctataacccaggaccaagtcttatacagtctaattttgtttatgaataaaaa

SEQ ID NO: 60169 - DNA, 601 bp, Human
atacaaaaaattagctagacgtggtggttggcacctgtagtcccagctgctcaggagggtgaggcaggagaatggcatgaacctgggaggtggagcttgcagtgagctgagatcgcctccactgcactccagcctgggcgacagagcgagactccatttcaaaaaaaaaaaaaaaaaaaagaccttgaaagaaataataataaacattaaagaagataatctttaccaatgtttatcttcccttgaagataaacaaaatctaaaaagatcatcaacacagttgtgttttaacaataagcawtttctcccaaagcaataatctaaggataatatttatgttacagtctattatctataaaaatattacagctgtaataaaaattcagaacaaatacctttgttgttaaacttttagaagcacaatggaggtacatttttttataggagttaaccgttagctactacacaatcctattaatgtggtgatgttggaagatcaaggctagcatctgcataatagctgtctagagcatgatgttgggcagggtgaagagctgcattattttatctgcaatttaatcaaatttgtgacacataaagg

SEQ ID NO: 60170 - DNA, 601 bp, Human
agcaattcatgaggggtccgcccccatgacccaaacacctcccactaggccccagctccaacactggggatgacaattcaacatgagatatggagtggacaaatatccaaaccatatcactttctattgctctctttcctttctgcctgctttgaatttcccattattaagctactggcgttgagataaaactcactttttatatagcaccaactaatctgaagttacttggaaattctgtttccttatagagttcagcaagttctagctaaaatgtaaacattgaaaattcatttgaaayggaaggaaaaaaagataaaacaggtttttaaaaaaattaaactgccatgaaaactgttttacccataattttggtctacatccttcaccagattatctactggggaaaataaagttttggcatatgttttcagacataatttggatccagctatcttttagaggccagcgaaagtaccaaatgttagccagtagaccacaggggtggcatttacaggccagtgagtttgtgatgccatcttatggctagaattttaaggtaaaaacaattggatcttggcttgtgtgtgtatatatctgt

SEQ ID NO: 60171 - DNA, 601 bp, Human
gtgcagtggtgtcatcacaactcactgcagccttgacttcctgggcaatcctcgcacctcagcctcctgaatagatgggatcacaggtgggcatcaccatacccagacaatatatattttttaatttttgtagagacaaggcctccctatgttggccaggctggtctcaaactcctgagctcaagcaatccttctgccttggcctcccaaagtgctaggattatagatgtgagccactgtgcccaaccaaaaatatttcctaaattatttttttcttaaccccttttgacacaacattctmttttggtaaaatagttgcattgctttagctggtgatcacatggcagatatggtttcagttactacctatatgtaatagtcactctcaaattcttacccctagtctcagttttcccctctgaggcctatgcccaaattgtctatttttcagtttaaattttggtattaaatttatttcctcttccttccacatagcccttgaaaaatttttaattatgaagaaacaacacccgttatatcaccagtgttccttgttctagttaatgcaccatgccattttttcttctcttagtaccacttc

SEQ ID NO: 60172 - DNA, 601 bp, Human
taccacatgttctcacttataagcaggaattaaatgttaagaacttaggaacacaaagaaggaaacagacactgggttctacttgaggaaggtgggaggaggaagaggagcagaaaagataactattgggtactgggcttaatatctgagtgacaaaataatacgtacaacaaactcccatgacacatgtttgactacgtaacaaaccttcacatgtacctccaaacctaaaataaaagttaaaaaataatttcttctaataatatcatcattgtatgtttctttttcttttctttcattraaaaaaactacatttaggacaactctaaccatttttgaaaccattccattgtttataattgggctccatttattttaaaaaatctcctttttaaaataactttttgagacaggatctcactccatcattcagcctggagtgcagtggtgtcatcacaactcactgcagccttgacttcctgggcaatcctcgcacctcagcctcctgaatagatgggatcacaggtgggcatcaccatacccagacaatatatattttttaatttttgtagagacaaggcctccctatgttggccaggct

SEQ ID NO: 60173 - DNA, 601 bp, Human
tttcttctattttacacttataaaatcaccacaaataaagcattatgaaaactaccaaggtgcaaagtattctttctgcaaatacttgtagctatggaaactctgaaagaagacacaatgttctatacttcaaggcaattttggggtccttgggaaaaggtagcctcaaacagtcccaacattcctgtagcagaaataacttgggcaacataaaacttgagtttctggttttggaaaaatggtggctcttctgaaaaatacaagtctacttcttcgtatttggaaaataacaatgaaatgygcttgcagaagagtttcttattgatgagaaaaaggaaaaagggagaaggcattgttgccacagtattttctctttgatctcttgtatggtagaatcaattcaaactatgagatacattttttaaaaattcccttctttcattattaactggtattccaaaccacagtaactgcactaagtagccagataatttattccattaataatcaacactggccttgtagggattcatttgtattcagacatggatttgcattattaatgtttttggcagtccacaatatgttgagaaatacaata

SEQ ID NO: 60174 - DNA, 601 bp, Human
tcataaaggtacagtgaaaaatctcccatcttggagagcaaacctttctgtctggagaaagaaatttatataatataatatatatattatatgattacacatatattcttccatactataataggcatgtcatattcaggttaagcttattaaatgagtaaatcttgccaaaagattaagagatgaacctgtgatgctcacatggattaatttttctcatgcatacaacaatttcctgtaagtagttgatttcaagctgatgtccatagacctgtaaggcttctgggggaaatggctcagwgtcttcctgagtttatgggtgaaggcatataaatatgctttcatgtcctctttaaccagactagcagctctgctttcttctattttacacttataaaatcaccacaaataaagcattatgaaaactaccaaggtgcaaagtattctttctgcaaatacttgtagctatggaaactctgaaagaagacacaatgttctatacttcaaggcaattttggggtccttgggaaaaggtagcctcaaacagtcccaacattcctgtagcagaaataacttgggcaacataaaacttgagtttctg

SEQ ID NO: 60175 - DNA, 601 bp, Human
ttgtgaaattattgccgtgactatcagcataacacagttatggctttgctcttgttcatcaaactgaatcaaatctaactgacccattcaactctgaccattatactcagctgtacacatgagacacataatttataggctttcaaatattttcatttatagtaagactataaaataaacagcaaaatatctcaaagcaaattgaagtaaaaataagaaaaaaattgaaaggaaaacatgggacaatattttaaaaacttgaatgttgatataaatttattttccaagcattacttttttaaaaaaaaatcattcctctgagatatatttaatgcaaacattaattgactgaaattggtgtatgaactagaatgtctaattgtaatttaaactctcgctatttaaatcatagaaatcccaataccccacaagcacaggcaacgaaggcaaaaatggacaaacaggatcacatcaagtgaaaaccttctgcacagcaaaggatacaatcaacaaagtgaagagacaacccacagaatgggagaaaatgtctgcaaactacccatctgaccagggtttaataaccagaatatataaagagctc

SEQ ID NO: 60176 - DNA, 601 bp, Human
ttataacagactgacaaggatgtgaatacatccaaacctttcagttttttatttgtttgctcatttttaagctacgctagtgtttaaaaaattttcttcaatcattctaatcatgtcaaactgtgaggaaataaaacgtttaaattgcaataaactgtatatattttcaatagcaatacagattgaattccccttcagctgtgaatttataagacttaaaatatatacatatatgaattcactttccttctgcattcttcatctttttttttttttactttttgttaataggaaagaattwtaaagagatttctagggaattcttaggagagttttttgtcacaatcagaagtattttgcagcttttaaatgttgagtatgtggttaatggaacaagtaaatttcaaatacattttttgtggccccaaaggggtgaaaacgaggaaatatgaaattagtttgctctattgaaacagtagtactgttgtattgagaatactatgaccatctatattgtgaaattattgccgtgactatcagcataacacagttatggctttgctcttgttcatcaaactgaatcaaatctaactgacccatt

SEQ ID NO: 60177 - DNA, 601 bp, Human
gagtgagatgctctgatatacttctttttttagtatctccctgtcatttttttctttgtgcgtgtgattattagaaactgtatttacacttcagagtgtggtggggcacacggtgggaaggagatacaggaaaaatgcagaatgggaaaattccctcaacctgttgggctgcttactgggaagactaaaatttaacaagtctcagattcttgttaaagacttgctttgaaaagctgtctccttagaacaaacaatgttttaaagataagtaatggtttaaagatatccattaaagtctctwtaaaatgaaaaatgtttctaaaatgccgtgtcattaatattatattgaaaagttgagagtcgtatgagtcaaaaggaaggaaatacatacatgagatggtcaagagaagtgttaatttacccatccggtccgaaattgcaagtgtttgtaaactgacaattgcagatgaaatagtcattttctgtgcactttccggtatttaagtctccagatacagcatttaacctaaactcaacggaattattttaaaaaaaaaaaatcttaaacgagtatgtgctagatcaaagctgaagcttcctc

SEQ ID NO: 60178 - DNA, 601 bp, Human
aggaaaaaacactttttgaggcaatcaaaaacttacaatagtgagtgagatgctctgatatacttctttttttagtatctccctgtcatttttttctttgtgcgtgtgattattagaaactgtatttacacttcagagtgtggtggggcacacggtgggaaggagatacaggaaaaatgcagaatgggaaaattccctcaacctgttgggctgcttactgggaagactaaaatttaacaagtctcagattcttgttaaagacttgctttgaaaagctgtctccttagaacaaacaatgttktaaagataagtaatggtttaaagatatccattaaagtctctataaaatgaaaaatgtttctaaaatgccgtgtcattaatattatattgaaaagttgagagtcgtatgagtcaaaaggaaggaaatacatacatgagatggtcaagagaagtgttaatttacccatccggtccgaaattgcaagtgtttgtaaactgacaattgcagatgaaatagtcattttctgtgcactttccggtatttaagtctccagatacagcatttaacctaaactcaacggaattattttaaaaaaaaaaa

SEQ ID NO: 60179 - DNA, 601 bp, Human
aagaggaaaaaacactttttgaggcaatcaaaaacttacaatagtgagtgagatgctctgatatacttctttttttagtatctccctgtcatttttttctttgtgcgtgtgattattagaaactgtatttacacttcagagtgtggtggggcacacggtgggaaggagatacaggaaaaatgcagaatgggaaaattccctcaacctgttgggctgcttactgggaagactaaaatttaacaagtctcagattcttgttaaagacttgctttgaaaagctgtctccttagaacaaacaatrttttaaagataagtaatggtttaaagatatccattaaagtctctataaaatgaaaaatgtttctaaaatgccgtgtcattaatattatattgaaaagttgagagtcgtatgagtcaaaaggaaggaaatacatacatgagatggtcaagagaagtgttaatttacccatccggtccgaaattgcaagtgtttgtaaactgacaattgcagatgaaatagtcattttctgtgcactttccggtatttaagtctccagatacagcatttaacctaaactcaacggaattattttaaaaaaaa

SEQ ID NO: 60180 - DNA, 601 bp, Human
tcatatactccaaagaggaaaagtacagatttgaggggagttattgcaaacgtttcaactattttagttcctttagaagaggagcccttttaacaaaatgatggattagccgtgtccaagtatgtgccatttataatgtatactagataacataatcttaaagtggatttgataacagtattaacacatatttttaaaagaatcttattatttgtaacaggcagaagacaactgatctcatgtaaattagtttccaccatccctaacaattctggttacattaagaggaaaaaacactttytgaggcaatcaaaaacttacaatagtgagtgagatgctctgatatacttctttttttagtatctccctgtcatttttttctttgtgcgtgtgattattagaaactgtatttacacttcagagtgtggtggggcacacggtgggaaggagatacaggaaaaatgcagaatgggaaaattccctcaacctgttgggctgcttactgggaagactaaaatttaacaagtctcagattcttgttaaagacttgctttgaaaagctgtctccttagaacaaacaatgttttaaagataagtaatg

SEQ ID NO: 60181 - DNA, 601 bp, Human
cttccgtatctagctgtatctcaacaggaacatcaacaatctccttttaataaggtagctgataatgcatcaatctaaatatacgtatactataattttgacttttttaagcttgcagttttaaaactagttttcatctacttcctttatttgccttaatcttcttgtcacaaatgtaaaagcctttagaaattactatactcccttttaatttaaaatgatgaatatatcaaatattaccaagagcaaaaacatcacaagtttttctggtaaggactcacattattcacattaaccctawcaaatataaaaatttggatgcctatttatcaacataggttgcaggcagagttcatatactccaaagaggaaaagtacagatttgaggggagttattgcaaacgtttcaactattttagttcctttagaagaggagcccttttaacaaaatgatggattagccgtgtccaagtatgtgccatttataatgtatactagataacataatcttaaagtggatttgataacagtattaacacatatttttaaaagaatcttattatttgtaacaggcagaagacaactgatctcatgtaaatta

SEQ ID NO: 60182 - DNA, 601 bp, Human
cttcaaaggtaaattgcaagatttactgctctacattctcagtacttaaatgagtctaataaatttgtttccacccaaactcattgtaagatgggaattccagctatcatactttcagcggaaagtatgattaactacaggtcaccacagataccatatatggtacaggactgccatgggaattacaacaggatccaaaaatgtgcatgagcttacatttatttattcagaacgtgcttccgtatctagctgtatctcaacaggaacatcaacaatctccttttaataaggtagctgatawtgcatcaatctaaatatacgtatactataattttgacttttttaagcttgcagttttaaaactagttttcatctacttcctttatttgccttaatcttcttgtcacaaatgtaaaagcctttagaaattactatactcccttttaatttaaaatgatgaatatatcaaatattaccaagagcaaaaacatcacaagtttttctggtaaggactcacattattcacattaaccctaacaaatataaaaatttggatgcctatttatcaacataggttgcaggcagagttcatatactccaa

SEQ ID NO: 60183 - DNA, 601 bp, Human
aattcttaccacttcaaaggtaaattgcaagatttactgctctacattctcagtacttaaatgagtctaataaatttgtttccacccaaactcattgtaagatgggaattccagctatcatactttcagcggaaagtatgattaactacaggtcaccacagataccatatatggtacaggactgccatgggaattacaacaggatccaaaaatgtgcatgagcttacatttatttattcagaacgtgcttccgtatctagctgtatctcaacaggaacatcaacaatctccttttaataargtagctgataatgcatcaatctaaatatacgtatactataattttgacttttttaagcttgcagttttaaaactagttttcatctacttcctttatttgccttaatcttcttgtcacaaatgtaaaagcctttagaaattactatactcccttttaatttaaaatgatgaatatatcaaatattaccaagagcaaaaacatcacaagtttttctggtaaggactcacattattcacattaaccctaacaaatataaaaatttggatgcctatttatcaacataggttgcaggcagagttc

SEQ ID NO: 60184 - DNA, 601 bp, Human
ttttaaaaaatgttcttcataaaatatattataaataccaaagattacatatagcatgtgtgtgttttaataaataataaaatgaacattagggtattcacgttcaaggttaagaaatggaacattactaatattttcaaagttcctaactatatagcagtagctcattcattttctttgctgcataggatattattagaaagaatgtacagttaattcattaatacaacttttgaaagggataatattcaatagacttcagttatagtatgtttcttgaaactatgaagtcatttgataytatgtttttgtgaggtttggatgccttattgaaaacaaaataaagtaaaaaatgtaaagacactagtatattaatgatgaactaatgacctttaaagatattttataataaaaataacttctgtatacaagaatgcccatattttaaattaaaatataacaaactttaaagatgataatataaagtattacctactgcagcctaagcaaaatagttttgttgcattttatagtactaagcaaattgtattaattgcatgatagaaaccttatcagacgaatcattaaatcctgatggaaa

SEQ ID NO: 60185 - DNA, 601 bp, Human
taattctgaaagaaataacttatcacaaacctgggcctggtggatctaaagaagtgtgtgtggagctctctaacttctaattcaatttatttaatggttacaggtctatttagattttgtatacctcctcaagtcaatgttggttatgtgtattttgtaagaagttgtctgttttgtctgtattttcaagttaattggaattatctattcatgttattttactttttaacatctgttctctccaaaactatacttccttttcattcctaatattgttttatgtatgccttttctatttttkacttgctcagagtagggtttgtctatactcaagaggtttagtttagttgataccctctattgctcatttctttcctttttaaaaaatgttcttcataaaatatattataaataccaaagattacatatagcatgtgtgtgttttaataaataataaaatgaacattagggtattcacgttcaaggttaagaaatggaacattactaatattttcaaagttcctaactatatagcagtagctcattcattttctttgctgcataggatattattagaaagaatgtacagttaattcattaa

SEQ ID NO: 60186 - DNA, 601 bp, Human
tacttttattagttctagtatctgttaatagatagtgttggattttctatgtagttaatcctgtcgctggcaaaatgacaactaggtttcttttcttttaatcctacaagtctttcattattgctaatttttatctgatatgcttgttaggacctcttctggaatgctgaacagaaacacctgtactgaccattatggatttgtttctaacttaaagagaatatttttacagttttgccattaattatgagtctttttcttttttccttgtaacattcattcattcattcatttttgttasatatgtttcattacattaagaaagttcattcttggccaggcgcagtggctcatgcctgtaatcccagcactctgggaggccgaggcaggcggatcatgaggtcaggagttcgagacatgccggaccaacatggtgaaacctcgtctctactaaaaatacaaaaattagccggctgtggtggcacaagcctgtaatcccagctactcaggaagctgaggcaggagaatcacttgaatctgggaggcggaggttgcagtgagccaacctccagcctgcactccagcctggggaacagagcaa

SEQ ID NO: 60187 - DNA, 601 bp, Human
tttgagttgtcccttgataatatatagaaatcatttaaaaatattaagcttatatccatgaaacttgcttacttttattagttctagtatctgttaatagatagtgttggattttctatgtagttaatcctgtcgctggcaaaatgacaactaggtttcttttcttttaatcctacaagtctttcattattgctaatttttatctgatatgcttgttaggacctcttctggaatgctgaacagaaacacctgtactgaccattatggatttgtttctaacttaaagagaatatttttacarttttgccattaattatgagtctttttcttttttccttgtaacattcattcattcattcatttttgttagatatgtttcattacattaagaaagttcattcttggccaggcgcagtggctcatgcctgtaatcccagcactctgggaggccgaggcaggcggatcatgaggtcaggagttcgagacatgccggaccaacatggtgaaacctcgtctctactaaaaatacaaaaattagccggctgtggtggcacaagcctgtaatcccagctactcaggaagctgaggcaggagaatcact

SEQ ID NO: 60188 - DNA, 601 bp, Human
catatgcttaatttaatattttccttaagtatatagttgtcaccttgggatgaaaaatggtttccttcaacaaaccacccattggttgaaatatatcataactctgtagttgttatttttgaatccccaaaaaaaagctatgcccaatatatatttactcacatctcttttcaaaatatctcagttaactgtgaaatatttaaatcaattaaatcataaatgctcagtgcccatctagatctttaaaaaaaatgaacattttgcaatttttgttctattttttaattaaaatttacacacrtagctaaagtcttatgctctattatatttccaactcttctccagggaatagagttttcagaagttagaatttatacttcctcagtaggattttatactttcattatatagtatatgcttgtgcccataaaatataagctggttttgggtagtatctgtttatatgcatccttttgcagtttgcttttttcatccaacagtatgtttgagatttttccataaatgtaccacagtttatttttagtcattctcctattgatggttatttagattgcttttcatttcttctattacaaatgac

SEQ ID NO: 60189 - DNA, 601 bp, Human
taaagaaaagttcttaaataatgcttattcaaagtaaaaacttctgctctccacaaaaatgccactttctttacaaaagtgaaaaatacaacaactcatagaatagttttgttttgttttgttttgagacagagtctcgctctgtcgcccagtctggagtgcagtggcacgatctaggctccctgcaagctccgcctcccaggttcacgccattctcctgcctcagcctccggagtagctgggactacaggtgcccgctaccacgatcggctaatttttttgtattttgtagtggagacgrggtttcaccgtgttcgccaggattgtctcgatctcctgacctcgtgatccgcccgcctcggcctcccaaagtgctgggattacaggcgtgagccaccgcgcccggcctgaagaaaattcaaacgaataaaggacttgtatcgaaaatatttaaagaattcctgcaactcaataataaaaagataaataacacagaaaaacgggcagaggatcagaataggtattatcccaaaaaaagatattaaaatggccaaaaagtagatgaaaagatgcccaacatcattaggttttagggaaatgg

SEQ ID NO: 60190 - DNA, 601 bp, Human
tgaatttgaacgcctacctcaaaccatacacaaaaattaactcaaaatgaaccacagacataaatgtaagaaataaattatttagaggtaaacttgagagcaaatctttatgatgttgggttaggaaatgatttattatgtacaacaccaaaaatacagtgataaagaaaagttcttaaataatgcttattcaaagtaaaaacttctgctctccacaaaaatgccactttctttacaaaagtgaaaaatacaacaactcatagaatagttttgttttgttttgttttgagacagagtctcrctctgtcgcccagtctggagtgcagtggcacgatctaggctccctgcaagctccgcctcccaggttcacgccattctcctgcctcagcctccggagtagctgggactacaggtgcccgctaccacgatcggctaatttttttgtattttgtagtggagacgaggtttcaccgtgttcgccaggattgtctcgatctcctgacctcgtgatccgcccgcctcggcctcccaaagtgctgggattacaggcgtgagccaccgcgcccggcctgaagaaaattcaaacgaataaaggacttgt

SEQ ID NO: 60191 - DNA, 601 bp, Human
agatagcccatcttcatggctattccccaaattaatttacagattcaatacaatctgtataaaaatcccagataactttttttgaagaaattgaaaattaatctttctagaaatacaagttacccaaataaaattgaaaatgaaaaaaaactgaaagacctatttaccaatttcaaaacttactacaaagctacaataatcaaaacagagtggtgctggcaatagaataaatatatagatgaatggagtagaacttaaatcccagaaataaggccttacatttatgattagcttccagacatttcaagagaaataaatagtcttttcaacaaatggtgttgggataatttgatatcttcctgaaaaaaaagtgaatttgaacgcctacctcaaaccatacacaaaaattaactcaaaatgaaccacagacataaatgtaagaaataaattatttagaggtaaacttgagagcaaatctttatgatgttgggttaggaaatgatttattatgtacaacaccaaaaatacagtgataaagaaaagttcttaaataatgcttattcaaagtaaaaacttctgctctccacaaaaatgccacttt

SEQ ID NO: 60192 - DNA, 601 bp, Human
aagcactcttccaaattaactgcaagtaaaaatttccaagttgtaaggtaaaaacacatgagaaaaaaaaacgtgttaaaataatttatataatattcttaaaaaccatgaagtgggatgaaataagccaatcactttgcatttaccagatatcttaacctgttttttacattacttaaaaaatgatcattttctttcagttaacaaataattattgagtgtatatttctattaaataaggtgttttaaacctttatatgcttctaatagacttatgaaaatgaccttccaattaaagatgtgggcatgttataatcatgacaaaactgagcaacatgcccccaacacacctgaataaacatatagaagagtttccctaacaatacaatctgagtgtttaagatacacctatattcagtgagaagccatgagccaaagagcaatggagtgtatgagtttggtaaagagtcatgttagaaaaatccaatctccgaaattttcttcccactggcacttttctgtacacaattttccctggaggcccaaaatactctgtgtgttccaagctttccaaggccgcacactgaaactctacatggag

SEQ ID NO: 60193 - DNA, 601 bp, Human
attcatggagaataaacaaatgtctagcactagggtagaataaaaaataaatgtgaatgactgtggaaggatagttaaaaactgaaacaattagtacacaggttacaccattagtattaaatatcaagcacactattagaaatttaaggggaaaaaggcaagcaaaaggccatagccctacttcagtaatggtttcaattgtgcatgttctattaccttaatgagaaaactaaacctgatcatgtcagtaatctgcttaagaatttctccttattattaagataaagttaaacttactagyagaatgcacatagtccatagtggtttgacccctacctccctcttcagcctcatctccctgctccattccatcaaaccttggaagactaagccacccagagctcctctaaggagctctcacttctgtactttcctcttcttctgcaattatttacctgcagaaaaattttccattcttcaggactctactcagatgtctccttctctaagccttctcttgctttttaccaccttacctcagggtttaatgttcatctcatttgttaccaaatcacccaacatctctatactagaatcatag

SEQ ID NO: 60194 - DNA, 601 bp, Human
tcagaatgattgaactctaatccctgctaattgagatgggaggctgtttttaagagaaataacaagcattttatttccataagtttagtttgaaaccctattaaacttccaagtgttaatatcaattagatagtttgggctggaaatacaaagttttaagtattcatgaaaaaaatagtatttagagttatgagatctgatgagatcactgagagagtaaatatcaagaaacaagaggtaagattcattgactgagccctggagctctccgaagtttagagactgggacaggaggctaggrggatggatgaggaagatccagccaaacatacgaaggagtgatcaatgaagtaagtggaaaactagacgaatggtgtcctaggagccaaatgaacaaatacttcaaaaaggagggaaaggtgagctatgtcaaatgtaaatatgtcaaggaaatgaggactaagatggtgactggttttgcaaagcaaaggctaaaactagctatgattggtacagctttggcaattagaaatcatttcttaatatgcttcatcagtgttcaagttataatattcatggagaataaacaaataaagttata

SEQ ID NO: 60195 - DNA, 601 bp, Human
cccattgctgagtaaaggcaatgtaatgtcaaatagaatatattttactgaacatgtgattacaacactgaactgaaaattttctaagcaaatgcaaagcatgtcacatggggtacatcagttatgtttgtttacacagcatctcttccttcttttttgtaggaacagaatctctctttccgaaaatcattccatcagaatcatgggaatgacacatgacctcacagcatttaccatattacactgaaaattatctgagttatttgctattgactataagctcatctatatcagaatactrgcttattagcccttatttgagtttggtctcccactttcactttcttatgtagttctcagatgtgatcaaataatcatctgtgtggaaggaagacaaaaatggaagtaagaacagtatagatacaggattcttccaatcaactgtagacatgtcttgaaatgaggaaaaggtgccagcaaccagtaagaaagagagagagattatctcataagcaaaaccaactttttggaaatttactgacatttacatcgaaatactttgaaatttatgttcaaatattgaacctctttgcttcatttc

SEQ ID NO: 60196 - DNA, 601 bp, Human
cacacataacactttgatgctgaaaattaaggtatacttttgctcacagtttaacacatttgatcataaatcactaaataaattagttaaatggcaatcaaaattaattggaatacatatgtgcacatatttcaataacaaacctagatggaggaataaaccatgtctccttaataatcagattttttaaaaattggacttttgattaatagctaaatcaagactgattaggggtatgcagtaataatatagatgatcaagttgacctttagtagtccagcctctcctttctataatcttyttgctacttcctgatttgatttgttttaataaaccggtttagtatcacagccttaactggtctgaacctactgataaaatgtgcttaaagtaccttgggttaagctgggcatcgaagtgtttgtcctttttttttctctgttactgtaaaagagaacagactcctcaagaaagcctgaaactaattacccctttttgaaaaagggaaagcataccccattgctaattaattaaaggcaatataatgtcaatgtaatgtcatagaattgtgaggctaaaaacattgtaggtcatgtaatgt

SEQ ID NO: 60197 - DNA, 601 bp, Human
aattgtcctacatgaaaattgaaacctttgctgaactggaaccaactagccacacataagaaaaaaaaatttataatgaaattttttcttttctcatcccttctaaatgccaattgatctgcgtttctagtccttatggctactctaacataaggaaatagaaataatataaaaaacagaaaaaattgttaggaattcttattgtcttatgcctaaaataaaattaaactattaatccacaggatagcaagttataataaatgggggagggaagcttaatcctcagcgaaatgaaattctrtggagtgtgtgagctacctctctgtccaaataatgagagactgtggtgattacgcctgtgctgggatgcacagaaaagagcccaggtgaccttggtgtctgctgcaaaatgctgtatttcaggcgcgtatgcattgtgtccggttcatctctgtctgtggcacaaaccacccccactgtagtacctacacattaaaaaataaaacagcctttaatttacagaattgttaaatatactttcaaaagtatctacaatcttaaaatgttaacagtgatgatagaaacctaatctaaaatgtat

SEQ ID NO: 60198 - DNA, 601 bp, Human
tcctgtctccacaaacaataaaaaaatcagccaagcatggtggtgtgtcctgtaatcccagctacacaggaggcggaggtgggaggattgtttgagcccaggaggtacaggttgcagtgcaccatgtctgtgccattgcacttcagcctgggcaagagagcgagaccctctctcaaaaaaagaaaaaaatacaaacagagaaagtaaaccaatattcccaccttaaaatgctcttcccgtatgctttaagaatccctgatattctttttatcttcctctaaattcactgttttttttttttatctcccatcatttttacttctcatgttgttcccctcaacgctccatggttgttgcccacaaaatctggtagatttttttcttcatcaggaaagtagcagacctgggtttgatcctaaaactgtatcttacaagttgtggacccctaaatttaatttttctaaacctcattttaaaaaatttgatgactaaaacctgttaacttgcaaagtttcaattactcacttgattactacatcatccctacaaactccacagatacaaaagcacattcagactttccccttaaaactttcccact

SEQ ID NO: 60199 - DNA, 601 bp, Human
ggaagaccagaagtctaagggaagagagagttttaacaagtgccagcaatagacaaggacttaaggttgctgttagatttgcaaaaaatgaaattttgcagatggtgtggtgatggtgaattgaagtcattaatttgtggtacaatcatctttgtggccttcctcttttattttactgttcgttagtcacgctttcattcttttatttttcttcattttttttgtttccctctatctcttccctcagtctttattttacttgatctcccttccatactgaaagtcaatattctagtcaggygccatggctcatgcctgtaaattccaacactttgggaggctgaggcaggcttattgcttgagtgcaggagtcgagaccagcctaggcagcatggcaaaatcctgtctccacaaacaataaaaaaatcagccaagcatggtggtgtgtcctgtaatcccagctacacaggaggcggaggtgggaggattgtttgagcccaggaggtacaggttgcagtgcaccatgtctgtgccattgcacttcagcctgggcaagagagcgagaccctctctcaaaaaaagaaaaaaatacaaacagaga

SEQ ID NO: 60200 - DNA, 601 bp, Human
aagtaaacactattgaggttggcaaaggggtagaaatactgagttttgctttgcatatgttgaatcttatgtgcctgaaggaaatctaaggagtaaagtccaaaaggcacctggatatatggcctcatatgtacagaagagatcatgactagaaatgtctacccagaaatcatcagtatctagatggtggttgaaattatggcaggaatcagattattcaattcaggagaggctgcaggatgagaagagcctcggatgtaaggacctacagtatttgtagcatggagggaataagaagacyatacaaaggacactaaaaaggaaagatcagagaagcaggaggaagaccagaagtctaagggaagagagagttttaacaagtgccagcaatagacaaggacttaaggttgctgttagatttgcaaaaaatgaaattttgcagatggtgtggtgatggtgaattgaagtcattaatttgtggtacaatcatctttgtggccttcctcttttattttactgttcgttagtcacgctttcattcttttatttttcttcattttttttgtttccctctatctcttccctcagtctttattttact

SEQ ID NO: 60201 - DNA, 601 bp, Human
tgcatcatcaaacaatacaagaaatgcaggagaacaattctcggaggaagtaaacactattgaggttggcaaaggggtagaaatactgagttttgctttgcatatgttgaatcttatgtgcctgaaggaaatctaaggagtaaagtccaaaaggcacctggatatatggcctcatatgtacagaagagatcatgactagaaatgtctacccagaaatcatcagtatctagatggtggttgaaattatggcaggaatcagattattcaattcaggagaggctgcaggatgagaagagcctcrgatgtaaggacctacagtatttgtagcatggagggaataagaagactatacaaaggacactaaaaaggaaagatcagagaagcaggaggaagaccagaagtctaagggaagagagagttttaacaagtgccagcaatagacaaggacttaaggttgctgttagatttgcaaaaaatgaaattttgcagatggtgtggtgatggtgaattgaagtcattaatttgtggtacaatcatctttgtggccttcctcttttattttactgttcgttagtcacgctttcattcttttatttttctt

SEQ ID NO: 60202 - DNA, 601 bp, Human
ggagtaggacttaacagtaaattctatatacaagttaagagagaatgattttcaggtgtcccacttggagagataggaagacaggtgcatcatcaaacaatacaagaaatgcaggagaacaattctcggaggaagtaaacactattgaggttggcaaaggggtagaaatactgagttttgctttgcatatgttgaatcttatgtgcctgaaggaaatctaaggagtaaagtccaaaaggcacctggatatatggcctcatatgtacagaagagatcatgactagaaatgtctacccagaartcatcagtatctagatggtggttgaaattatggcaggaatcagattattcaattcaggagaggctgcaggatgagaagagcctcggatgtaaggacctacagtatttgtagcatggagggaataagaagactatacaaaggacactaaaaaggaaagatcagagaagcaggaggaagaccagaagtctaagggaagagagagttttaacaagtgccagcaatagacaaggacttaaggttgctgttagatttgcaaaaaatgaaattttgcagatggtgtggtgatggtgaattgaagtc

SEQ ID NO: 60203 - DNA, 601 bp, Human
tgggagtttgaggtaacagtgagttatgatcatgccacagcatgcagcctgagcgacagagctagatctcttctctaaacaacaaacaaataaataaatagggcaagtgtcccaaatctgaggcagtagcaatgaggacaaagagaaaggatggcaggaaatttacttgggagttagaatggagtaggacttaacagtaaattctatatacaagttaagagagaatgattttcaggtgtcccacttggagagataggaagacaggtgcatcatcaaacaatacaagaaatgcaggagaacrattctcggaggaagtaaacactattgaggttggcaaaggggtagaaatactgagttttgctttgcatatgttgaatcttatgtgcctgaaggaaatctaaggagtaaagtccaaaaggcacctggatatatggcctcatatgtacagaagagatcatgactagaaatgtctacccagaaatcatcagtatctagatggtggttgaaattatggcaggaatcagattattcaattcaggagaggctgcaggatgagaagagcctcggatgtaaggacctacagtatttgtagcatggaggg

SEQ ID NO: 60204 - DNA, 601 bp, Human
agttttaaaaaaatatatccttaaggaagttttggcataatttggagaaagccaaaaaatcaaagcagttagttgaaactcccctgcagcaatcatctaaaacaggtggcttaggccagcgcagtggctcacgcctgtaatcccagcactttgggaggccaacatagaaggatcgctcaaggccaggagtttgagacagacatgggcaatatagcaagacctcatctctacaaaaaaataaaaatttagctgggcatggtggtatgtgtccgtactcccaagctacttgaggtgctgaggyggatggacccttgagtgggagtttgaggtaacagtgagttatgatcatgccacagcatgcagcctgagcgacagagctagatctcttctctaaacaacaaacaaataaataaatagggcaagtgtcccaaatctgaggcagtagcaatgaggacaaagagaaaggatggcaggaaatttacttgggagttagaatggagtaggacttaacagtaaattctatatacaagttaagagagaatgattttcaggtgtcccacttggagagataggaagacaggtgcatcatcaaacaatacaa

SEQ ID NO: 60205 - DNA, 601 bp, Human
aaaacaaaagcagtcagtggtattttcttatttcctttcctattactctcaactataaagcataatgggtttttttaagtacttggttttagtattcaatttgagcagatcatattatagaaaaataaaatagggaggcttgatgtcaagagtctatatttgactcttcacatctggacagaacttgccaagtcttagtataggagccttggaaatttttacagaggaaataattgcaaatagaggtgtttgtgtaccaaagatgccactttactgtttttggcagataagcctctttcamtcaatgaatgacctctattcttgtccacaggacaatattaatttttgttttgttctgggctagaagtataaaaccaatgatccttttcaaacagatcccttcctaccctcataacctggatcctagaatgtaccagcaccaccaaatatacaacatactgaacaaaaaataagttcattcattgctgtttgagataatactaaatttcattgtgaatatcacctttaaaaggatcagatacaaccaggcatatattatagagaaaatgagaagaatatgggtttgtatgtcacatcatgt

SEQ ID NO: 60206 - DNA, 601 bp, Human
gggataattatgaggcaagttctacatggtttcttgtatggatgaacaccaaagatgactagctcaataatgcagactagattggcttttcctccttccctatcttattttcccattttaacattggcttcctgggacccacttcctaaatacattcccatgttcaggtctttgtcttgcattctactttctggagagtccaaataaagactagattgatttggactaataaaaaacaaaagcagtcagtggtattttcttatttcctttcctattactctcaactataaagcataatggktttttttaagtacttggttttagtattcaatttgagcagatcatattatagaaaaataaaatagggaggcttgatgtcaagagtctatatttgactcttcacatctggacagaacttgccaagtcttagtataggagccttggaaatttttacagaggaaataattgcaaatagaggtgtttgtgtaccaaagatgccactttactgtttttggcagataagcctctttcactcaatgaatgacctctattcttgtccacaggacaatattaatttttgttttgttctgggctagaagta

SEQ ID NO: 60207 - DNA, 601 bp, Human
gcctgggtactgagaagggatgtgaggggtaaataccccaagtatccatttttgaggggataattatgaggcaagttctacatggtttcttgtatggatgaacaccaaagatgactagctcaataatgcagactagattggcttttcctccttccctatcttattttcccattttaacattggcttcctgggacccacttcctaaatacattcccatgttcaggtctttgtcttgcattctactttctggagagtccaaataaagactagattgatttggactaataaaaaacaaaagcartcagtggtattttcttatttcctttcctattactctcaactataaagcataatgggtttttttaagtacttggttttagtattcaatttgagcagatcatattatagaaaaataaaatagggaggcttgatgtcaagagtctatatttgactcttcacatctggacagaacttgccaagtcttagtataggagccttggaaatttttacagaggaaataattgcaaatagaggtgtttgtgtaccaaagatgccactttactgtttttggcagataagcctctttcactcaatgaatgac

SEQ ID NO: 60208 - DNA, 601 bp, Human
cctgactgtggggtacaaatcacctatcctagctgtatggactgcagcatgttatttctctttgattcagtctactcatctggaaatgagaagaattagaataacaaccacatgggcttgttttggaaagataaataaatcttttaattcaatgttttttgggaagttttgtgggacactgtttcagagatggaaaaaaagaaggaaataaattagttttatgaagcaagcataaaattgatagtaaaaacttaatagcaattatagaaaaggaaaaactatggtaaatcctttttgtggmtatggatgtaaatcctagacagaaattagacaaaacagctgaaaaaaatgaaattacaatcttggctatgacttaggagaaaaatgctaattctctcctactctttctatgaaattaatataattgtaaaaacatcaaaagagatatttttaaacttaggagctgatttgaaagttcacatggaagaacaaacaaggaagatattcataagaaaaaaatccacaaaggaagatcactaggtaagagtggcatggaacactgcaaatactaaaatgcatattatacatttgatattcttaa

SEQ ID NO: 60209 - DNA, 601 bp, Human
aggttcaaattctgtctacactacatcctagctgtgtggcattgggaaagttatttagtctctttaactcttctcttctgtgaaattgttgtaagaatgacatttaacactacagcataaaataaggctttacactaaattctgagtaatctctcaagctgtcacagaggcgaatgaagggaataaatgctgtatgtttttgttaacagccaatatattgcaataaaaggagacgctaactagtaagacaatgtttgcaagctttattcagctaaaagtataccagagcaattcttggttyggcctactgattacttaactctttgaggtataaaggaatgaataacatgcactctttccctggatataattctgactagcaaggaagaaccagggcattggaagaggaggattcctttagagttaacaacatagtgatgtcattctttaatcagtactcaaaaggttagtcatcattaggtacatagcctacatgacagaaacatggattttgaacaccatgattatacagtgtttgattttcaaataaaagatgactcactgagattaaaaagtacttaaagatgccaggcacggtggc

SEQ ID NO: 60210 - DNA, 601 bp, Human
atattaatatctgttcgtttgatgctgatgaatactgtttcacacatttcatgtgctggtgtgatcacacagagagtaagagcaactgctggcaatgagaaatggatggaaatttagagaacagctgctgcactggaggaggtgcaactattcaatccagaaacactcgctgaagccttggagtttctttgtcccatttttcgaggcttaagatggatattgttttagtagcttaaaactctccaaaattaaaaatctggtgagatgaaatcctaaagattaatgggattagttaatctcrttaattaataggaaagcctgtaaattctcttccacctcagggtacgtttttgtttcgccacttaaaaaaagtgcttaaaaatatcccacatctgcactgagatgttaacaactccctagaaaatgtatagttgtggaaatggagctgaggactctccatgttgagaaggaccaagaataatactatcctcactcaagcccatatgcgtcactgctgctgctccaatggacagaagccactgaggtggaatgagtttacccagaacacagcaaaagcctgtatcactcatgctttgtggtt

SEQ ID NO: 60211 - DNA, 601 bp, Human
tgtcatcctgaccagtgctgcataaattctatgttcacatgttgttaatactgacttttatcccttgctaaacagagagtggatcccgtgctaagcctctaccaagaatggtccaacaacttctgcaggtagtttcatagagttggacaaacgaaattccggaaatattttcatatttcactcttactaaggaaaattactctgattcaaaaagtaatgcaaacagatgacagtattcttatggtcctgcttggagcactgtctaacaggctgggctaacggtcatctgagtatgggaagktgcctttatttggcttatcagttactactgactatggcccaggcattttataactcttgtaaagtttgatgttgactttcacaaaaccaaaaggtgcaatgatttcattttctgtctcatagaaaagatatctccagtattttattttcttttattttatttttgagacagagtcttgcctcattctgtcacccaggctggagagcagtggcgcaatcttggcttactgcaacctctgcctctttggttcaagcgattctcctgcctcagcctcccatgtagctgggactacaggcacgt

SEQ ID NO: 60212 - DNA, 601 bp, Human
gcagctaatttgaaatgactattgctactgataatatcagatacaactgtcaataaatcttttaccagaattactaccaaataaaaataaatgtctgaatttcaatctctatttttgggggttccaggtgccacatgttagtaagcagtaaagtggttacagataagatttctaatcccagtatatattcaaaccactaggaagatttttttaaaatataagattcctaggctccacaaccggatattctgattcagttagtctaacaaagtatctacagattaatatttttattttaatrtgaagacaaggttgaaaaactctaggttactttaaggaacagaattcaagaaaaggatcattttgacctaatatgcagctgaactatataaaagctcaatttaaagtgacacaaacggatgtggaagagtctgatgagaccattttatctagttttagatttcagttttatttttgtcctctagcatagaaatacataagaatttaaggtcctgccctattggggatataaagataaataaaacacggcttcttgtcaccaaacagtttcaccttgttagataattaagagagacagaaa

SEQ ID NO: 60213 - DNA, 601 bp, Human
agtggcaccatctctcagctcactgcaacttccacctactggtttaagtgattctgctgcctcagcctccccagtagcttggattacaggtgcctgccaccacgcccagctaatttatgtatttttaacagagatggggtttcaccatgttggccaggctggtcttgaactcctgacctcaagtgatccacccacctaggcctcccaaagtgctgggattacaggcatgagtcaccatgcccagccattggcattatttttaaaaacatgcacacacacacacaaagtttgtcttaatgayaagctgcccaacattttaacaaagctttcctttgttgtaaatgtaaatgttgccttcataaaaattacatcttccttcattttatatataacagagcccccatataatatttgtaaaaggttagtttatccttctaaaatatattaatgagactcagttttacttcatgctttgtgtaagtaagcaagtcaatctatcctccagttattctgttatttcagagtttataaatcattattttttattaaataccattaactttggtgaggctccacagtctactgatttctggagaagtat

SEQ ID NO: 60214 - DNA, 601 bp, Human
ccttgctatatcccgccaggttcacttccaggataccctagagtgcttggtctatacacctgagttcctcacttccagagtcagcttacaatacaatttaaactacacatcttctgctctctcctcacctcgctggtattattattattattattattttgagacggagtctccctctgtcccccaggctggagtgcagtggcaccatctctcagctcactgcaacttccacctactggtttaagtgattctgctgcctcagcctccccagtagcttggattacaggtgcctgccaccacrcccagctaatttatgtatttttaacagagatggggtttcaccatgttggccaggctggtcttgaactcctgacctcaagtgatccacccacctaggcctcccaaagtgctgggattacaggcatgagtcaccatgcccagccattggcattatttttaaaaacatgcacacacacacacaaagtttgtcttaatgataagctgcccaacattttaacaaagctttcctttgttgtaaatgtaaatgttgccttcataaaaattacatcttccttcattttatatataacagagcccccat

SEQ ID NO: 60215 - DNA, 601 bp, Human
tgagaaaaacagactgctttcctagaaaagatttatctttattgaaactactttgtatcttgcctattaagaattcttattctaaatcataattgtgggagattgaaaatacatgataattaaactaagaagaacaacaacaattcttccagtctaaaagaccctatagtgcattggcaaaatccccaaacccagagcactacatatttttgtatggcctatgagctaagactttgtattttaaaatggttgaaaaaattcagaagaataagagtttataatgtgaaaattacagccgggwgcagtggctcacgcctgtaatcccagcactttgggaggctgaggcgggtggatcacctgagatcaggagttcgagacaagactgaccaacatggagaaaccccgtctctactaaaaatacaaaattagccgggcacagtggcacatgcctgtaatcccagctactcaggaggctgaggcaggagaatcacttgaatctgggaggcagaggttgcagtgagccaagatcttgccattgccctccagcctgggcaacaagagcaaaactctgcctcaaaaaaaaaaaaaaagaaagaaagaa

SEQ ID NO: 60216 - DNA, 601 bp, Human
tcctatctcccacttgtttcttaatattctcttctctaacaccgaacttgtttcaagcctcttttccaacacatgatttcttctattctaaatcaatttatttattatttgctaaatagcccctaaactttatcatctcctgtcttgtaggctatgctgttttcctcttctttagctattctcaccgtctcttcactttcaaacccttcttattctttaagttaccaagtaagctgtacctcttgtcaccagcctttctggttgatccaaactacatgagtacatttaggtatcataggtrtttttgaactctgacagtgctttatcatattggtttattgtcatgttcctattttgcttttccataaagtaggatctatttctcataaataagttggcatctttttgaggtaagaacatgccttgtaagtacttttgtgtatatatatatattttgtgtacatatatatatactttgtgtgtatatatatatactttgtgtatatgtgtgtgtatatatatactttgtgtttatatatactttgtgtgtgtgtatatatatatatatatatatatactttacacaaaacaagaagcataa

SEQ ID NO: 60217 - DNA, 601 bp, Human
ctctgccactttgactctgctttttactttgttccttaagttcagtcagtcaacaagcttatcctttatacctttgaaatatttcttattcatccctatcttaatataacaattaccatcatcctggtagaattaactcatgcttaaactaagctttcatcttccccaaccctgatgtcttcctattctcactgatccccctactgactcagcttcacgctgcttgattatacctctctcctgtagaaaagccttggctggctctcctttaccatgagaataaatccgaaatccttagtgyagcatttagaagtcctatctcccacttgtttcttaatattctcttctctaacaccgaacttgtttcaagcctcttttccaacacatgatttcttctattctaaatcaatttatttattatttgctaaatagcccctaaactttatcatctcctgtcttgtaggctatgctgttttcctcttctttagctattctcaccgtctcttcactttcaaacccttcttattctttaagttaccaagtaagctgtacctcttgtcaccagcctttctggttgatccaaactacatgagtacattta

SEQ ID NO: 60218 - DNA, 601 bp, Human
ttactttcaggacaagaacctccattacattcaggttcctttgtgccaccttcctatcaatttaaatttttttctacttaaaatgcagtctttaactaaattgaaagatttttcaaatacagatgatttattgaacctgaaatatatctacaaaagtcatacttactgtcgcattgccttagaaaaaaataccagaaaaaaagaattgaaaagtagccatttggtggcagtgctaccctacatttttttatttaagttgccattacaataaaattcaattacaaaaaaggaaaaaaaaaaaccctcctaattattaaatcttcttgatggtataatttcgttgtaataaacacaagttcaaagatcatatttctaagtgaataaaagaggaatttaaaataaactaaaagcaatgctgagcctacagggctagctttcatacttttattctctgctcctttctgtcctcctccatccacatttcccaaagttccttctcacagggtatcaacaactctttatccatgtcaataatttctaggtttacttttccagtcctgattattcacccaactcctaatcccatgtgcatgccttcaag

SEQ ID NO: 60219 - DNA, 601 bp, Human
ctgaaataataaaatgaaataattcatgttgagaggaaatggattctaagttgtcatgagaaggcaaaggagagagaatatttgttcaaccttttattcattcattcattcattcattcaacagacatttatcagtttctaattatgtgcccagatactgtcttcattcattttgtgctgctataacagaatacctgagactggttaatttttaaagaacagagatttatttcttacagttatgaagtctgggaagtccaagatcaaggagttcacatttggcgagggcccatcccatggmagaaggtggaagggcaaaagagcacgagtgagagggagagggagagagggagagaggagcaacagggggctgaacttgcttttacaataagctttcatgataataaacccattctcatgataaggacagtaatccattcatgagagcagagccctcatgacctaatcacctactaaaggtctcacctctcaacactgttgcattggggattaagtttccaacatatcagcttttagggacaaatttcaccatagcaaatgcaaaagcctagggatataaagatagacatagtctctcgat

SEQ ID NO: 60220 - DNA, 601 bp, Human
gtgtgatttaatcattctacattgcagacataaatcataatatcactttgtgccccataaacatatacaattaaattttgtcaatttgcaataagataaaaatatatataaatcatgctatttaatctttatcctaaaactgcatacaaatgttggtgttttcacagagaaatacagatttcatttgaaaagtttgtaattgtgaggaactagaattactttcacgatcttctatatcaaaagggttcatgaggtaaatacacaactaaaaatgagacgttagtgaagaatattaaaaacmtcctatatttatgggattttataaattaaatgaaatatgaaaaatgaaataaaatctcttttaaattaaataatgtaacaaaatcaaagagcacgggaaaatgaacagagcaagcaagagagagcccacagaaaaatacagaaaatatatgttaatttgaattgtctatttttctccattcggaggtttaaattttagactcaaaacacctaaggaaactcacttcaccgagacggggttgagtaaaactgtgccactccgagtaagtgtatctgcagttgtccacctccgtgtgtcctc

SEQ ID NO: 60221 - DNA, 601 bp, Human
ttctttcatattcttgctttccttaaaataaaagcactttacattcgcatggtgctttgtatatttaaaatatgtcctgcaatggtgactatagttaataatagtatatgttatatttcaaaattgcaaagaaagtacatttcaaatgttctcaccacaaaaaataagtatttgaggtgatgcatatgttaagtgtgatttaatcattctacattgcagacataaatcataatatcactttgtgccccataaacatatacaattaaattttgtcaatttgcaataagataaaaatatatayaaatcatgctatttaatctttatcctaaaactgcatacaaatgttggtgttttcacagagaaatacagatttcatttgaaaagtttgtaattgtgaggaactagaattactttcacgatcttctatatcaaaagggttcatgaggtaaatacacaactaaaaatgagacgttagtgaagaatattaaaaacatcctatatttatgggattttataaattaaatgaaatatgaaaaatgaaataaaatctcttttaaattaaataatgtaacaaaatcaaagagcacgggaaaatgaacag

SEQ ID NO: 60222 - DNA, 601 bp, Human
acataacctacagccctataccagagtatcacccatttgcattccattcaaggattaaaggtctactgtttgtcctgcaatggcactggtatcctctgataaaagaggtaaaaatttagtccagaagagtgtctaatccagtggctttctacctagctgcacatttgaatcatctcggaaatgtaaaacaaaaacaaaacaaacaaaaaaccccaaattcattaaattagaatcttttagagtagaacacagccattagttatgttttaaaagcttcatagaggattttgccaagccaagkggctcatgcgtataatcccggcactttgggaggccaaggtgggtggatcacttgagcctgggaattggagaccaacctgggcaacatggcaaaacaccttctccacaaaaaatacaaaatttatccaggtgtggtggtgtatacctgtagtccaagctactcaggaggctgacatagaaggatcacctgagcccaggaggtcaaggctgcagtgagtggagattgcaccactgaactccagcctcagcgacagagcaagaccctgccttaaaaaaaaaaaaaaaaaaaaaaaaaaaggaa

SEQ ID NO: 60223 - DNA, 601 bp, Human
ataaatttgggttccaaattatttaaaaagtcaaggccatcttcttcctgcttttcactgcagcagcccacagaaccagctggagatcctcttccctcatagttataagtgaggacataatcttgggatggcatgcggtcttcattctgattacatcgatgcaatttctgtaaaattttttaaaaaatgaattgcattatagttttaaacaacttaaatatatgaacataaaatttatttttatttaccttttatgtttaatttttaaccagtgtgtcctctaatggattcctacacacaraaaatgcaaatgattggtctatatcacaaccataccataaagtcagtatagtttacatttctagtgctccatataaataaaaaattatgtatacaagttttatatttaagtacattcaagttgtcattaaatgcttatccctaaattttatacacagaggtcagtctagtctaaaaaatagagacaatagtcatactggttaggagtttgagataggatgtcaaacagccttggttgtgagtcaaagctctggctttaccaactagctatatgactttgggcaagtgaccaaatatcctt

SEQ ID NO: 60224 - DNA, 601 bp, Human
catgggctctcgcactctacacagtcctcgttcggggacccgggccactcccggtggaccctcgtgccggccacccctgcactgatataggcctccctcagcccttcctttttgtgcggttccgtctcctacccagctcagcctcttctcccccgctcagacaggggtccccatcacatgccgctctctgagcgacctctccataggccttcgctggcctcagagcccctccctgcgtgtccttcccctggcggactgccttctcccacatcgtcgaattcctttccccgggttctacggscccgccgctcctcccaccatctctcttttcgggtgtagcgccccctccccctcggcgtacacccttcccagctcgcgtcctctcccgaagcccctctgacgggttcttcgcttccctcttggccttgccttcggtgcagactcccattacaggtctttttcttatctgccctctttcccccctcgagcgagcgtctcttctgtatctcccctccacttggacggccgcccctctaagcttctcccatcccgggtccaggaccccgtaaaatctgagcgggccaagggcctccgcccccac

SEQ ID NO: 60225 - DNA, 601 bp, Human
aggctcaggtgaccccccgacctcagcctccctagctactctctagctcctaggagtagctgagactacaggagcgcgccaccacgcccggctagttttttgtttttttgtaaagacagggttttgccatgttgcccaggctggtctcgcactcctggacttaagcaatccaccttcctcagcctccccaagtgctgggattataggcgtgagccactgtgcctggcctttgtcagttttttgaaccttaaatgtaggttcaactacaagagcatttaaatattattaaagaaaataaaastaggaacttcgaatgcattttatgtttccatgggttatggtttcattttgttgtgcattttgctgtttaagatagggtgttaaaaattctgctaaggaggatttctactttttttttttttttttgagatggtatttcgctcttgtttcccaggttggagtgcaatgacgcgatctcggctcattgcaacctctgcttcctgggttcaagcgattttcctgcctcagtctcccgagtagctgggattacaggcatggaccaccacacccggctaattttgtatttctagtagagacgggg

SEQ ID NO: 60226 - DNA, 601 bp, Human
gcactcctggacttaagcaatccaccttcctcagcctccccaagtgctgggattataggcgtgagccactgtgcctggcctttgtcagttttttgaaccttaaatgtaggttcaactacaagagcatttaaatattattaaagaaaataaaactaggaacttcgaatgcattttatgtttccatgggttatggtttcattttgttgtgcattttgctgtttaagatagggtgttaaaaattctgctaaggaggatttctactttttttttttttttttgagatggtatttcgctcttgttkcccaggttggagtgcaatgacgcgatctcggctcattgcaacctctgcttcctgggttcaagcgattttcctgcctcagtctcccgagtagctgggattacaggcatggaccaccacacccggctaattttgtatttctagtagagacggggtttctccatgttggtcaggctggtctcgaactcctgacctcaggtgatccgcccgcctgggcctcccaaagtgctgggattactggtgtgagccaccgtgcctggccagatttctacttttttaaagctcttacaggatatgagtcac

SEQ ID NO: 60227 - DNA, 601 bp, Human
ggattataggcgtgagccactgtgcctggcctttgtcagttttttgaaccttaaatgtaggttcaactacaagagcatttaaatattattaaagaaaataaaactaggaacttcgaatgcattttatgtttccatgggttatggtttcattttgttgtgcattttgctgtttaagatagggtgttaaaaattctgctaaggaggatttctactttttttttttttttttgagatggtatttcgctcttgtttcccaggttggagtgcaatgacgcgatctcggctcattgcaacctctgcytcctgggttcaagcgattttcctgcctcagtctcccgagtagctgggattacaggcatggaccaccacacccggctaattttgtatttctagtagagacggggtttctccatgttggtcaggctggtctcgaactcctgacctcaggtgatccgcccgcctgggcctcccaaagtgctgggattactggtgtgagccaccgtgcctggccagatttctacttttttaaagctcttacaggatatgagtcactttttctttttcttttttaacttcaatgctgattatttagccaatttct

SEQ ID NO: 60228 - DNA, 601 bp, Human
accagttcaaaataaagggatattttgattaataggggatggagtggtctaaataggaatgtaatgtggggcgagcaggacaattattctaaattatgtgtttgttcttgaacagtaacctttatttaagcccaatagtgagacttttggtgggagggaattagttttattttatttaaagttgactttttatttttaaaactttaattccttaagtatttacgaacaatgtggttaaggccctgtgggacataagtaagcatcaatcatgatttctgtttacaaatattgtgtggtagayaccaatccacagttagattttctgaaaatatctggatacatagtctattgcttaagacattttcttttcaatcacattggaggtcagtagtaattaaccatcagctgattgtcagtagaaattatcataggaactttgctgtcttgcatcttggtagtagtttttctttcacaagttttggttgagcaactcagattctgctgaatctggaaaaacttgtctagacttgagccttattgtatgcattatatctatatctatatctatatatatatattttttgaggcagggtctccctct

SEQ ID NO: 60229 - DNA, 601 bp, Human
ggtggctcatacctgtaatcccagtactttgggaggccaaagcgagtggatcttttgagccccggagtttgagacccagcctgggcaacatggcaaaaccccatctctacagaaaatacaaaaaattagctgagcgtgttggcatgtgcctgtagttccagctactagggaggctgaggtgggaggatcctctgagcctgggaggtctaggctgcagtgggctctgcttgtgccgtggcactccagcctgggcgacagtgagaccctgtctcaaaaaaagaaagaaagaaagaaagtgctsgaagttttttttttgagacaagttctggctctactcccccggctagagtacagtggtgcacagtccaggctcaccacaacctctgcctcccaggctcaagccatttgcccacctcagcctcctgagtagttgggactacaggcatgcaccaccgtgcctgtctaatttttttgtttgtatttattcatgtattttttgtgtatttttttgtatttaaatttttttttttgtataagtgattcaaaggccatttccttagcaaacatccagccttttgtactaagaggcaacagtgaatgt

SEQ ID NO: 60230 - DNA, 601 bp, Human
gtgccgtggcactccagcctgggcgacagtgagaccctgtctcaaaaaaagaaagaaagaaagaaagtgctggaagttttttttttgagacaagttctggctctactcccccggctagagtacagtggtgcacagtccaggctcaccacaacctctgcctcccaggctcaagccatttgcccacctcagcctcctgagtagttgggactacaggcatgcaccaccgtgcctgtctaatttttttgtttgtatttattcatgtattttttgtgtatttttttgtatttaaatttttttttttgtataagtgattcaaaggccatttccttagcaaacatccagccttttgtactaagaggcaacagtgaatgtatcctattaataatagactattaactgaaactgagatttgacttcatatccagaatggtggaccttggaaactagtatatcaactaaccatcctataaaattgaaagtgcattgcttttgtacatcactttaataactttgacattttcttctgatatcaaataaaagcatgtatgtgtttgccacagcatctttgacaccctctagttgactctctagttagaaataa

SEQ ID NO: 60231 - DNA, 601 bp, Human
ttttctagtcctgatgtctaaatcaattagctagtttagataagaagaagtcttagtagtcaaaagtaggaacgaatgtaatgtttcctgaaatgctgataccaatttttacaaaggaaaaaatatctagctcagattctataaacgtgtgaactcattttgaactttaaattcagatagaaaatgttttaaaacaacttaactgcctgtttctccattgtttttgaaattcttaagcgtaataccactttgagtgaaaaagaatctccatgtatctagttagtaaataaactgctgcctrtagaaatcacaggaagcaaattcatctaatcaagacctattttcaaaaaaatcatggagtcataagtgaaagtatatgccctccttgctttgttgtattttattttatttatttttttaagacagagtctcagtgtgtcgcccaggctggagtgcagtgacacaatctcggcccactgcaacctctgcttcccgggttcaagctattctcatgcctcaggcccacaagtagttgggattacatgcgcccaccaccacacctggctaatttttgtatttttatagagatggggttttcacc

SEQ ID NO: 60232 - DNA, 601 bp, Human
agtagagtttgcaacaagaagcatccaggttgatggaaaaacaataaaggcacagatatgggacacagcagggcaagagcgatatcgagctataacatcagcgtaagtctcatggtttttaagttctgtgaaatgggttgccatcgagtgaattagctgacttttggtattggaaaaagaactgttgtttttttcttttaagaattctagtattaggaatccttagaaatttatttataagtatgtttttaaaactcatgatccatattttgagttcttcctggtgtttgcttccatcttrtggttttctgatactaaatatgtttctgttttcagatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcaggttagtgataggaattccatgatatttcttaccattgtgtcttgtggttttgataccttccaatgagagta

SEQ ID NO: 60233 - DNA, 601 bp, Human
tgcattgtggctagtgaaagtcttgcggccgggcgtggtggctcatgcctgtaatcccagcactttgggaggctgaggtgagtggatcatgaggtcaggagattgagaccatcttggctaacatggtgaaaccccgtctctactaaaaatacaaaaaaccgggcgcggtggcgggcgcctgtagtcccagctactcgggaggctgaggcaggagaatggcgtgaacccgggagcagagcttgcagtgagccgagatagcgccactgcagtccggcctgggcgaaagagcgagactccgtcycaaaaaaacaaaacaaaacaaacaaaaaaagagagaaagtcttgcctttgcactaatgcttatgctatgaataactttctgtaacagttttttaaatttcccatgcaagaatagctttattgtaaataatatggctacaacatacggaatactatagccaatgtagttgatggagaggatagcaagagatggaaataactgggcacttgatacatttttaccacattttaagtggtgtcattcgtcactagtgagtagtacttagatgtaacaagtatttattttaattaaggagccaat

SEQ ID NO: 60234 - DNA, 601 bp, Human
gagaaagtcttgcctttgcactaatgcttatgctatgaataactttctgtaacagttttttaaatttcccatgcaagaatagctttattgtaaataatatggctacaacatacggaatactatagccaatgtagttgatggagaggatagcaagagatggaaataactgggcacttgatacatttttaccacattttaagtggtgtcattcgtcactagtgagtagtacttagatgtaacaagtatttattttaattaaggagccaattgacaatttctcactttttttttttttttttttgggagccaggatctcactctgtgacccattctggagtggagtggcacagtcaaggctcactgcagcctcgacctcctgggctctagtgatcttccacctcagcctcctaagtagctgagactgctggtgtgtgtcaccacgctcagctaatttttagtattctttatatagagagagcaaaacctctctccagtgttttgccatgttgcccaggctggtcttgaactcctgggctcaagcaatccgcctgccttggcctgccaaagtcctgggattacaggagtgagccaccatgcccag

SEQ ID NO: 60235 - DNA, 601 bp, Human
atctataaaattcatatatattttgaggagttttgttatttcttttttgagagaaggcttatatttataaaatcttgtgataggatttgacttgacttttgtgacctaaaggttttttgtctcagtaacccttagcaaagaatggtctgtcactgccctagacttcaaaaatgagtacctgtaaagtacccattttgaatactgtaaattacttatctatccctggtatatagagaacagttggcaaattagtagctgaacggcaattaaggcatgagaaaattggagatttatgtacctwttttattataattcttttctgttatcagaagaatagtgctggggttggataagcagtctttggaacacagtagctttcctttagaatgttctctgtcaaagtttcactgcagattgttttaagcaagcaagatttgattaaatatgtagtatgtctgcaagtccttgttttctttatagccatttgtgtacattttattaagtcaacatgtagagtactagattgagacccaggagttctagggcattacatttttatcactttgcttctactccccgtttaactaaagtcactgaacct

SEQ ID NO: 60236 - DNA, 601 bp, Human
cactgcagattgttttaagcaagcaagatttgattaaatatgtagtatgtctgcaagtccttgttttctttatagccatttgtgtacattttattaagtcaacatgtagagtactagattgagacccaggagttctagggcattacatttttatcactttgcttctactccccgtttaactaaagtcactgaacctccctgctcctcagagtcatagtcttaaaacatgtgaattaaattaccttaaagatgtgtgagcattttaaggcctcagaaagtctcatctgaaaaaactttttaracagtcctcattgttggaatattttttatgttccatcaaatctcctctgctgtaattctggcccatttattctgatattaagtgaagatgagcccaagtcttccatctgcagttaactattttatgcatcattttgtaacattgagcttctgatccactcaaacatgaactagtcggtacttaaaattgagccctttaagagctgggcatgttgatgcacgcctgtaatcccagcattttgggaggctgaggcaggcggatcgcttgagctcaaacatcctaacacctgtagaacaacac

SEQ ID NO: 60237 - DNA, 601 bp, Human
attacaggtgtgagccaccgcccctggccttattctgcttttggtatgtcagaaaatttccataaaaaaaaagttagagatgtattaactgaattactacattttccaaaattaagaactaatttctcagaagttgaaaaacagtaagctgtagtcaactgaatatgtaaactaacaaaaacagacagcaagtgtatcttttcttagattcttttgtgggggaaggggagtggctaaaatttatgtctgagaaggttgacagtggttcaaatgtgaagaggcattaaggaaagacaactargattcaataaagacaggctactaaaattaaaattaaaaaaaaaaaggatatggaatctttatttagattttgtttcaatgaaaaaggatgggatgggagggtgccaaggctaaagaaaaggatttacctttcagtcattcaatcagatgagtggctaaggaataaagataattaacttgcatctttaagctttccctctagtctcaaactgggaggctcttctttttcaagtgtaaattatgtgtgtaaattaagatgaaatatgtaacccactgtaagttttaacttccttataaattg

SEQ ID NO: 60238 - DNA, 601 bp, Human
gtccaagagattttgaaaccgtgcagaacgagggagaggggcaggctgcagccgggcagataacaaaacacaccccaaagtgggcctcgcatcggccctcgcattcctgtagagccttccttcccaaagcgcgctgccatctgtctggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctrtctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgctcctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcgga

SEQ ID NO: 60239 - DNA, 601 bp, Human
tggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctatctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgcycctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaactgggtggatccagtcaataaagggggagggaaggcggtgtgctgtctggggaagtctctgggcgtgtgatcgggagccagaattgacttcagaggaggtggtgtgatgtgatggtcagagagacctgg

SEQ ID NO: 60240 - DNA, 601 bp, Human
ttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacatcttggggaggtggctggtttggccctgtgctggtgatatcaatgtgtctgctaagccccatagattgcagtgttgcttgtcaaattgtctgctttcaccacaactgccttttagtttggaaagcagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacat

SEQ ID NO: 60241 - DNA, 601 bp, Human
aaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagyagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaagg

SEQ ID NO: 60242 - DNA, 601 bp, Human
acccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagcagagaaaggaaaatgtttaacttagtcattccccctgtgtgkggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcattta

SEQ ID NO: 60243 - DNA, 601 bp, Human
agaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccrctgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtct

SEQ ID NO: 60244 - DNA, 601 bp, Human
gaatggaatcaaagcatttgccactgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtcttgccttgttgcccaggctggagcgcagtggcatgatcttagctcactgcaacctctgcctcccggttcaagcgattcttgtgcctcagcctcccgagtagctgggattacaggcgcccgccaccacgcccagctaatttttgtatttttagtagagacggggtttcaccatgttggtcaggctggtgttgaactcctgaccttgtgatctgcccgccttggcctgccaaagtgctgggattacaggcgtgagccaccgcgcctcaccgaatctgatct

SEQ ID NO: 60245 - DNA, 601 bp, Human
gttacgtttatacttcattctgcatcattcattcattattgaattattcagtccttcgttgagaacatactacaatgaccacagcagggtccctgtactcaaagagctccctgtctagagcgggagacagacttgcccaaaggtatgaggcatgagctgcagctgaggaatgtgctaagtgcccagcaatgtggaaacacagttaattctgtgggaggaggtgtagagaggaggagaacccatgagaggtggaaaactaagaaggggacaagggttatccaaaggaagctttttggactgyagtatgatgttgggaactttttggtacatggggatagttccctataagaatgaggacgtctttatcctcttttactaaactgagtgctgctataaatatgttaccttgtaactggcactgaacagctagtgacttgggtgctatattttactccactgtaaagcattttctctttgaagtaaaaagtaagttagtactgcaaactgaaattcaggtttccttggtgggaacagggactttagatgtatcagctcagaatatgacagggagtgttaataaaaagtggacaacttggctggg

SEQ ID NO: 60246 - DNA, 601 bp, Human
ggcgcctgtagtcccagctactcgggaggctgaggcaagagaatggcgtgaacccaggaggcggagcttgcagtgagccgagatcgcgccactgcactccagcctgggcgacagagcgagactctgtctcaaaataaataaataaataaatgaaaagtggacaacttgcagatggttgttttgaaattcaaagcttcggtgtgacctagcttctcatttctctagttaacacttgctgagaataaatcctagacgcctgagtttctgaatgaacataggtgcttttagtggtatatttttwaaaaagtctttgcaagggtgaagttttaaatgacaattttaataacagaaaaatatgaatacagtcgcatttaattctgatgagaaatgcaagaagttgatgaaattgaaagaatttgtttcaagcttatcacatcaggaatccaactaaatgagttaaaaaataaatattggtttaataatgtaaacatgtgattgctgtattattataatggaataaaattaacacgatttaatgaactgagcgaccattaatttttacttgttaatttattaggagattttaatgccatttgatgca

SEQ ID NO: 60247 - DNA, 601 bp, Human
tttgatgcacagtacagccattattctgcgtgagctccttaatgaaataaataagaccaagcagggcttgcttcaaattggaatcagctttcattcctgttaaccttattctcccacctttattcacctctccttcagcttcctgtaattgcaattaagttctctaagattggaatgcagttttcttaatcagcaagtctcatcaatagtcctaattgacttttgcccttttctcctttgccatattgactgattaaaacaaaagcaaaacttaaagactccattccctcccccaaatccmcatctcatagtgttggttggctggcaagagaactgcccaagaaggctgctcatgatggcagcctgctgaatgtgcagggggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactg

SEQ ID NO: 60248 - DNA, 601 bp, Human
ggaatcagctttcattcctgttaaccttattctcccacctttattcacctctccttcagcttcctgtaattgcaattaagttctctaagattggaatgcagttttcttaatcagcaagtctcatcaatagtcctaattgacttttgcccttttctcctttgccatattgactgattaaaacaaaagcaaaacttaaagactccattccctcccccaaatccccatctcatagtgttggttggctggcaagagaactgcccaagaaggctgctcatgatggcagcctgctgaatgtgcaggrggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactgtgttctaagctttagaaccgagacaattccaagagaacttgtccagttcatttttatgccttcctttaatgccgtacca

SEQ ID NO: 60249 - DNA, 601 bp, Human
ccatcctaagcccaccctacagaagtttggtttctaattttactgtgttctaagctttagaaccgagacaattccaagagaacttgtccagttcatttttatgccttcctttaatgccgtaccaggtgctaatttctgtgccagataatgcggacaaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaaggcccttcctataaacagcagcctgccacagtggcaactgctgtagaatgttttggcagagactcagtttaaaatgaaaacacagtagaagcctattaattaagaagtttggctaattctggactaggcaaaagtttgtttagcaggc

SEQ ID NO: 60250 - DNA, 601 bp, Human
caaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaagrcccttcctataaacagcagcctgccacagtggcaactgctgtagaatgttttggcagagactcagtttaaaatgaaaacacagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcct

SEQ ID NO: 60251 - DNA, 601 bp, Human
cagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcctcgaatgttctcaactggaaaataggctagataaactctattggagggcctttctaacttggaattggtattcatacaagctttttattttattttattttttgagatggagtttcgctcttgttgcccaggctaaagtgcaatggcgcggtcttgcctcactgcaacctccgcttcccaggttcaagtgattgtcctgcctcagccttctgagtagctgggattacaggcatgtgccaccacacccggctaattttgtatttttatcagagaccagtttcgccatgttggccaggctggtctccaactcctggcctcaagtgatctgcccgcctcggcctcccaaagtgctgggattccaggcctgagccaccgcgcccgg

SEQ ID NO: 60252 - DNA, 601 bp, Human
ttttatcagagaccagtttcgccatgttggccaggctggtctccaactcctggcctcaagtgatctgcccgcctcggcctcccaaagtgctgggattccaggcctgagccaccgcgcccggccacatacaaacattttaaaagctcccagttgcacgcatctagttgatcagtgaatgacagatctttcttaattattgatgttccaagactctatcagcctggtgtcaattaatttacataagtaaaaataataaaattgtaattcagcctttaattttggtgatttccctccctcttcsttgcctcttccttactctgtgagtctaaatcagtgaaatttaactacaaaggaatatgaaaataatgctaggatgaagatgtggaggctgtgcctcttgagatgcagtgaacagtttttcttcttttgttgctatttttgactattctaagaacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatcta

SEQ ID NO: 60253 - DNA, 601 bp, Human
tacaaaggaatatgaaaataatgctaggatgaagatgtggaggctgtgcctcttgagatgcagtgaacagtttttcttcttttgttgctatttttgactattctaagaacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatctatataaagaaaggctgcacttgattgcgtaagcatgagccttttgwtaggcagcgtggatgttgcaagtttaaaccccaactaggaaatgaaaagtgagtttcctcctaaatagttctttttcagtatcacatggctctcccagcttacatctggcaagtttttctcttgagtgctttgccggtagtttaggactccagtattgtattgtattgtttgtttgtttctttatctctgtctctctctttttttgttttttgagacggagtcttgctgtgtcgcccaggctggagtgcagtggcgtgatctcagctcactgcaacctccgcctcccaggttcaagcagt

SEQ ID NO: 60254 - DNA, 601 bp, Human
gagtttcctcctaaatagttctttttcagtatcacatggctctcccagcttacatctggcaagtttttctcttgagtgctttgccggtagtttaggactccagtattgtattgtattgtttgtttgtttctttatctctgtctctctctttttttgttttttgagacggagtcttgctgtgtcgcccaggctggagtgcagtggcgtgatctcagctcactgcaacctccgcctcccaggttcaagcagttctcctgcctcagcctcccatgtagctgggactacaggcgcccgccaccaygcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttcttttcaactggacatttgaaaatagtaatgctttttgggtgtgtgttttttaaaggtctgtttttacgctgtcactgctcaaaaatgccaaaaggcattttttccttaaaaaatcacct

SEQ ID NO: 60255 - DNA, 601 bp, Human
tcgcccaggctggagtgcagtggcgtgatctcagctcactgcaacctccgcctcccaggttcaagcagttctcctgcctcagcctcccatgtagctgggactacaggcgcccgccaccatgcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttyttttcaactggacatttgaaaatagtaatgctttttgggtgtgtgttttttaaaggtctgtttttacgctgtcactgctcaaaaatgccaaaaggcattttttccttaaaaaatcacctctgggctaagcccaaatgtggagtaatgaatccagaaaggactttttgagtagttacaagtggctgaaagcaggcactggtgatggaaattgggtttttccttttgcttcaaatcttcctggttgtaaactttttcttacccttattgaagtcagactcaaggtgggtctaatttctccca

SEQ ID NO: 60256 - DNA, 601 bp, Human
atagaaatcaacccaagtggccgggcacggtggctcatgcctataatcccagcactttgggaggccaaggtggatggatcacctgaggtcaagagtttgagaccagcctgaccaatatggtgaaacctcggctctactaaaaatataaaaattagccgggcatggtagcgggcgcctgtaatttcagctactcaggaggctgagacaggagaattgcttgaacctgggagccagagcttgccgtgagccaagatcgcaccattgtactccagcctgggcaacagagtgagactctgtctcaaaaaaaaaaaaaatcaacgcaagtgagataagatgtatcaagtactttgccagtatcgatcataatacatagtagatgcttagtaaacgctcatttttcctttccaaggggaaatttggcagatgatgtccgtcgactccaataggtgatccccttcccatcccgacacacttgctcacagagcattctcctttggagagtctcagttgatataggaaaaggatctacttcaacacacacagagaacatacagacatgccacttgttgatgtaaggcttggcaggctattgaaagagaaa

SEQ ID NO: 60257 - DNA, 601 bp, Human
aaggggaaatttggcagatgatgtccgtcgactccaataggtgatccccttcccatcccgacacacttgctcacagagcattctcctttggagagtctcagttgatataggaaaaggatctacttcaacacacacagagaacatacagacatgccacttgttgatgtaaggcttggcaggctattgaaagagaaacaattcatattcttaggcggttctgccctcccccatcaccttctctatcattattcttaaaaatttgtttggtcgactaaaaataatagtactaaaaacaaacttygatgaatcaggtctcctggggcgggggatgggtaagatcctgaagcagaaacgcagtgactcacgcgcctgtcactgatagctgcccgtaagtgcatggaagtgcatgatgtttattgttgctggtgtttttttgaggcccaagttggaatgcacttccggctccccctcaagtactagcttactggttaggtgggctgttgagtgagaatggtcaggtccagaaactcatggctctgaaatgacccagacgtggtggctatacccttgactgccctcagatacgtgcaagagggagctc

SEQ ID NO: 60258 - DNA, 601 bp, Human
tttgctggaaatctttattaagtaccagagatatagagatgaagttgtgtctctgaactgctcagaggcaaaaaagggacaccagtaaccacagttatggtgggcctgtggaagagacactatagtgaaggtcaaacaaaatatttgggagcctagaggaagaacaggtctatttctggaggtatcagaaggcttcacagaggaggcaatactcaattggggccttgaaggatggataggagtgtaggagtggagtgggaggcagcacagagcacagaccagactgcggaagggcctgacrtctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgccggagttatccaggtcagagtcgtaatcccttacagtaccatgtggacagcttta

SEQ ID NO: 60259 - DNA, 601 bp, Human
gagtggagtgggaggcagcacagagcacagaccagactgcggaagggcctgacgtctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgccsgagttatccaggtcagagtcgtaatcccttacagtaccatgtggacagctttaggctatgtctggagcaggttgaagatagtgttttgttcactgtcaggagagaagacatgttgttcagccaggagggctcagggagcccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcct

SEQ ID NO: 60260 - DNA, 601 bp, Human
agagcacagaccagactgcggaagggcctgacgtctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgccggagttatccaggtcagagtcrtaatcccttacagtaccatgtggacagctttaggctatgtctggagcaggttgaagatagtgttttgttcactgtcaggagagaagacatgttgttcagccaggagggctcagggagcccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatgga

SEQ ID NO: 60261 - DNA, 601 bp, Human
gggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgccggagttatccaggtcagagtcgtaatcccttacagtaccatgtggacagctttaggctatgtctggagcaggttgaaratagtgttttgttcactgtcaggagagaagacatgttgttcagccaggagggctcagggagcccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatggaccgtctctggtcagtgttttcaatttctttgttgatgatcatcaatcaaggccagg

SEQ ID NO: 60262 - DNA, 601 bp, Human
ggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgccggagttatccaggtcagagtcgtaatcccttacagtaccatgtggacagctttaggctatgtctggagcaggttgaagatagtgttttgttcactgtcaggagagaagacatgttgttcagccaggagggctcagggascccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatggaccgtctctggtcagtgttttcaatttctttgttgatgatcatcaatcaaggccaggctttccaattccagaccacactgcaatcagtggaaactacctaaattcagtactgcagacc

SEQ ID NO: 60263 - DNA, 601 bp, Human
ccccaacttactgcggtggtgactgtggacatgttgtttaacttatttgagcttccttttcctcatcagtaaaatgggaaaaacaatgacctccctcaaggagggatgttattgaagttatttacttaaatcagattagatttattttagattaaaagcttcttgcaagctgtgaaatgttttgcaatgtcacatattattattttttttttttgagacggagtttcgctcttgttgcccaggctggagtgcaaaggcgtgatcttggctcacggcaacctctgcttcccggattcaggckattctcctgcctcagcctcccgagtagctgggattacaggcatgcaccaccatgcctggctaattttgtatttttagtaaagacggggtttttctatgttggtcaggctggtctcgaactcccgacctcaggtgatctgcccgcgtcagcctcccaaattgctgggattgcaggtgtaagccaccgcacctcgccccccgcatattatttctttatggtgtagaactcactaatactgctaaaaaccctttctgacagagatgggagttaaggcttctaagttcacacccagatttccac

SEQ ID NO: 60264 - DNA, 601 bp, Human
gattaaaagcttcttgcaagctgtgaaatgttttgcaatgtcacatattattattttttttttttgagacggagtttcgctcttgttgcccaggctggagtgcaaaggcgtgatcttggctcacggcaacctctgcttcccggattcaggctattctcctgcctcagcctcccgagtagctgggattacaggcatgcaccaccatgcctggctaattttgtatttttagtaaagacggggtttttctatgttggtcaggctggtctcgaactcccgacctcaggtgatctgcccgcgtcarcctcccaaattgctgggattgcaggtgtaagccaccgcacctcgccccccgcatattatttctttatggtgtagaactcactaatactgctaaaaaccctttctgacagagatgggagttaaggcttctaagttcacacccagatttccacagagaccttagagacaatcataaatattgcacaaaattatattggaatatgagctcggggcacataggctctggtgccttgtactagaagcttaggtgagctgttactcttggccatgtccaagcatttgactcagaagatggtcgagt

SEQ ID NO: 60265 - DNA, 601 bp, Human
aggcttctaagttcacacccagatttccacagagaccttagagacaatcataaatattgcacaaaattatattggaatatgagctcggggcacataggctctggtgccttgtactagaagcttaggtgagctgttactcttggccatgtccaagcatttgactcagaagatggtcgagtcagcagtgttgactgttagcaaatcacctaagcccactcacatggggtgatcctggtacgtgttgcatggactgagtgtcaactgcatgctgagtgtatgccagagggggtgatctccttgmtcttatttacttacctacagtactctgggtacttatgtatttatgtttacagaggaggaggctgaagcattgaggggtcagtggcagaacaggaatcttaactctggtctctggttcctagttctctgagctctaccccatagcccctcaagaaaggatggccattgttgtcctcatacaaaaagctatgacactgctatcattattctcatttggtaaatgacagaaacaaggttcagattacttaggtaagttgctttaagtctcaggctaagggctggagctggatttgccactgaa

SEQ ID NO: 60266 - DNA, 601 bp, Human
ttattttcctgttgacaaaatgataacaacttgccctagggtttgaagtgggggcagggcacagcgctgagagcctcctccctcaggggaaattttctaaagtttctcactgtgttctagcttcaaaaccatatgcagtttaattgcatgtttagtatctttgtgcatctctcttgttttgaatctgctggaaactttctctgaaagcatatatataggaagacataaaaattctataaatgtttagtggttaaaaacaaagtcctgtccaaattatataaagttttgccgtcgtcggacrgaactttctgcagatagggaatacccttgagtcttcagtcgcaaagagctaatcactaacttcaagtgtgcaagtgccctttcattccaattcagagaaaacagagcctgtcccaaggcctcgtgttttgttttcctattgatctaggagctgggataacttggaaccccagggaacatctcagagttaattagttttttgaggtcttcttgtttttcttgcttgattaaaagagttacagtttttgctctgattgtttaaaaaaagaatctatcactgctactgatccaagaggtgagg

SEQ ID NO: 60267 - DNA, 601 bp, Human
tggtggagatgggctttatgactttggggaagtcaacttgacttcctgggtgttggtcttctcttctacaaaatgacaagcttgaagggagaatctgaaagaatctgtgtatccgttctcagattttctttttttttctttttttttttttttttttttttgagatggagtctcgctctgtcgcccaggctggagtgcagtgatgcgatctcggctcactgcaagctctgcctccggggttcatgctattctcctgcctcagcctcccgagtagctggcactacaggcgtctgccaccacrcctggctaattttttttttttgtatttttagtagagacggggtttctttgtgttagccaggatggtctccatctcctgacctcgtgatctgcctgcctcggcctcccaaagtgctgggattacaggcatgagccaccgtgcctggccagtctcagattttcatgatagccctctgaactctccttggcttcttgcctttggctgttttctcaatgcatatattttcctgggggacaaatctaagttttcatctgatgctctgccttcagaggggaaccattccttaatgacctatttaat

SEQ ID NO: 60268 - DNA, 601 bp, Human
ctgtgagggctaggattcttgattcctcatgatttgcaattggttgttggtgttaccatggaaggttctcaaccatggctgcttttaaaaattttgatgctcagaccacccctggagaccagtgaatttcgaatttctacaggccggcctggggaaatccatgttttttaactttcctaggtgattccggtatgtggccgggattgagaatcacagccatagatgcttatgtaaagctgtgttcagtgttacaggcatctgttctgggtggaaagtgatagtggttggtcaaaaaaaaagygtgcgcacacacacacacacacacacagagaacagctctaggttctggaagtgtgttgatttggtcaccacaagtgctggtggtgagtagttgccctgaggtttggagttccagttccctcctatctctgggtcagtggtttctcaacatctttgaagtagtgaaaccatctgtagttggttatttctggtcagaaactcacagtacaaagtggggggtggtgcaggggggtggagctggaatggattaaacaggcccttacaaatgcccacacttttttcatgaaactaagttagaggc

SEQ ID NO: 60269 - DNA, 601 bp, Human
atggtatgagaagctttacaaataacaaggtttgagatgcagttgtagacacatgccagatgtaggttgctattttctcagctcaatgaggaatctgtcaaggcactcttagaaatggaaaatatagttcctgccctcaggaactatagtgtcacgtgatagcagtgaagaccttctatgtcctggccacacagtgaggatcagaagacagagcatggagagtggaatgggacacatggatcaaggaacgtggacctgagcaagcaaaagcaagtcactcgggtcccactatcacattgcrtatcttctccttttttttttttttttctgagacggagtttcgctcttgttgcccaggctggagttcagtggtgcgatctcagctcactacaacctccacctcccaggttcaagcgattctcgtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccag

SEQ ID NO: 60270 - DNA, 601 bp, Human
agctttacaaataacaaggtttgagatgcagttgtagacacatgccagatgtaggttgctattttctcagctcaatgaggaatctgtcaaggcactcttagaaatggaaaatatagttcctgccctcaggaactatagtgtcacgtgatagcagtgaagaccttctatgtcctggccacacagtgaggatcagaagacagagcatggagagtggaatgggacacatggatcaaggaacgtggacctgagcaagcaaaagcaagtcactcgggtcccactatcacattgcatatcttctccttttttttttttttttctgagacggagtttcgctcttgttgcccaggctggagttcagtggtgcgatctcagctcactacaacctccacctcccaggttcaagcgattctcgtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccagcctcttctcct

SEQ ID NO: 60271 - DNA, 601 bp, Human
gtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccagcctcttctcctttctaacgtgatgtcagtgtctctgggaagcagccttagttggcacctcactggcagcaagaatgacttcatgttcttgctcccatgaaaattctctgctttcaggaatayactttcctctaggttttttctttgtctgcaagtgggggggtgttctttgccagatccctgctttgatgattaccatctgcccacctgagtttcctgcatagtttcagttggaaactcttttctctttggaccctaagataccgtgtaataggattgttcttggtttcagtaggcacctggcaccctctcagctgtggctgcatttcaggtatggatgggagtgattatctgtgcatcagaaaactcaagattgtcatgtgagcaagttgtgtgatcatcagtaaatgcagagctggcttt

SEQ ID NO: 60272 - DNA, 601 bp, Human
atttcaggtatggatgggagtgattatctgtgcatcagaaaactcaagattgtcatgtgagcaagttgtgtgatcatcagtaaatgcagagctggctttgttaggccctggttgtggccaaggctttcctttcctggcgggtgattattccagatttcatggtcactagctgagtgtaatcaggagcagataagaaagccctgtatagagcaaagtatgcatttcttaaggtggtgggggaggtggcagaggcattatatagacgtgtgtgtttgtgcatgtgtttaaaaaaagacttatrttttctgggcagcagaacttaagtttccagtaaacatctcctccctttttactttaccttttaattttgtgtttatggtctctgtgctttgaaattgtttttgctgtgatgccagccctgcctgaaatgggtggagcaagccaagccctttggaagccatggtttagatcagagttcttgtactgacatggcccagctgattgacagctcagatgtgatcactccgtctcaactagaagaataaaaataaaaaccttgagctggagcggagaggggtcacacatttgttagtttatcccc

SEQ ID NO: 60273 - DNA, 601 bp, Human
tttagatcagagttcttgtactgacatggcccagctgattgacagctcagatgtgatcactccgtctcaactagaagaataaaaataaaaaccttgagctggagcggagaggggtcacacatttgttagtttatcccctactctcacctttatcgcaggaggagtgataaagtgctgctgtgtgtaattctggtctggggttggttttctgtagtcccaaacctgggactaattctccctggagcccgtggcccagaagatgggtgcacagtagggttacttgatgctaaacggctttccygatagacttgggatctcactgttcttgtcttagctttacttgttgggttggaggaggtgaggtgggtgggcaggggcctagggaagcccactatagaaacactgggacagagaatccagcccaggctaggtgagagcatctgccagtgtgaaaacacgtggaagcgggggaggcaggcgagaaaagctgtgggagaaaacctcacaaatgcagcaaagctgcccagggcccaagcggtggggcggtagcgagggaaacacagtggtgtttggctgctgcttcacaccacttttaattcag

SEQ ID NO: 60274 - DNA, 601 bp, Human
tgctaggaaggctatttcagaatgctcccgagtgggagggggcagctgctctagggtgggaaggggatgctaaggccgggtgcggtggctcacgcctgtaatcccagcactttgggagccaaggtgggcgaatcacgaggtcaggagttcgagaccagcccgaccaatatggtgaaaccctgcctctactaaaaatacaaaaatgagccaggtgtggtggcgggtgcctgtagtcccagctactcaggaggctgaggcaggagaatcacttgaacccaggaggcagaggttgcagtgagcygagatcacgccactgcacttgagcctgggcaacagagccagactctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaaga

SEQ ID NO: 60275 - DNA, 601 bp, Human
ctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaagaggccaggctaggagaccccagagggacacccagaaatcccagatrtacctcctccatctgctctgcctgccagatgacccttgctactttactgttttttctttgagcctcttggtgatcttgaatagcagaaaaatgagccaaatttccttcaatctatgccagtcttcgtcctcagcctcccggtggggtgatgaatcacaccagtgggaaagtgcactgtatacttggtcatgtgcagagcaccttcccattggtttatctttacaactgccctgggtggagacacggcaaggtggtcctatccctattttgcaggtgatcaggcacaacttacagttagcg

SEQ ID NO: 60276 - DNA, 601 bp, Human
ttagaggctgagctgttgtcccctgggattttggaaggtagactcacatttcactgaaagccctagatgcttctccttactgcagttcccctccccagcactcccatctccctgttttctggggatttaaatcagctttgacttgggtctgaaagtaacccgtgacagcagtaagcctctcgatctgttgtttgcagtgtttcagctaaaatattataaacagaccaccaaactgtgtttggtccaaggccaagcccctccctccctacttgaacacttgattacctgctgcagggttgcrtcttgagctccgaggaggaaactgtttatttcagggctgttagagtgcagtgcaggaatccaggagaatttattgtattgttaccatctggtttcatggagtctgtttcttttgattttaattgtgccctctggagagaaagatcctcgaaatggtggaaaaagaagataccaccttcctccctgccctgcccatgccctggcacacacattgctatggtgcatggtgggcatggctgaaccaagtccccttattctttgaacatctttgcgtattattcctgctcccccagccgtctcc

SEQ ID NO: 60277 - DNA, 601 bp, Human
ttctccaaaataaggtgtttttagaaatgaaagtacagggattggtttccttagattcattgtcatggattcatagttccccaacctttttcacgtaaagactcacctctgtttcctcttaaattgtacatttggtgtctgttttatatattaataataactgacactcttctaaagttttttggggaaagaaaacataagtttaccaagctctcaattctagaaggtaatagccttctagaattgtccatttgcataagcatttttatgcttattgctgtaatcagtgtgtcagtcaaaygggaaggaggaactacatcaggtatttagcacaaagggaatttaatacgggaccttggttacacaggtgataaagcagctgagaagccacaatgggaaggtgaggtgatccagaacttggaggaagccgctgcctttaggctggagggacaaagggaacaggtggtgttcccagagcccagggttggggtcaccagtgggcctgtctagagcagttgcagctgcttctaaaattgccgacccaaggtagaaaaggagagaggggagaaacactgtggcctctccctccctcctacccact

SEQ ID NO: 60278 - DNA, 601 bp, Human
atggaacccagggcctgctggagcaggccctgatgagtgtaaataactgtgttagaggcaggacctgagcttttcactccataaatatatattacttctaatgtggccagggccgagctgaagatcataattatgtgagatctgctttacaggcatttagggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttctctgagcctcagtttctccagcagtaaaatgttacctgtctgttagggttgtaagattgagtcaacatatgtacaaggcattgcttagtgtttaccaccttgctgtgagctggtaaatggttggttggtcccttcctctcccc

SEQ ID NO: 60279 - DNA, 601 bp, Human
agggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttcyctgagcctcagtttctccagcagtaaaatgttacctgtctgttagggttgtaagattgagtcaacatatgtacaaggcattgcttagtgtttaccaccttgctgtgagctggtaaatggttggttggtcccttcctctccccttggtgttaagcatatcaaaagatggctgcgtgctcacctcccctgctttactgggtggacaaaggagctgtcacacagtgtggcagccttagaaaggttaaagaaggccagtgaagtcttctggctcatctggtcctgaggtgggtgagcattaaac

SEQ ID NO: 60280 - DNA, 601 bp, Human
tcctgaggtgggtgagcattaaacccagatcctttttgtgtttcagtattggatcctttggccgtcatatctgagacccagggcctcagagtgtggggtcctaacctaatttggctttgggtgaactggccagcaaatggaaggatggctgtggaagtgtgtcttgagcctgtccttacacaggtgtggctgtcatcaaggccatcttcatgggcacgtgacgagtacagtcacatagagttcatgctcaggagggccctatgcttggtttaatgctctgctgtcaccagcttgaaatccttttttttttgttattgttgcccaagctggagtgcaatggctcaatatcggctctctgtaacctctgcctgcgggttcaagtgattctcctgcttcagcctcccgagtagctgggattacaggcacccgccaccacacccagctaatttttgtatttcttttagtagacgtggggtttcaccatgttggcgaggctggtctcgaactcctgacctcaggtgatccagccttgggctcccaaagtgctgggattacaggtgtaaaccactgcatccggcccatcttgaaattcttaataatt

SEQ ID NO: 60281 - DNA, 601 bp, Human
cccattgagccttctgccccattcacatgtagcatttgagcacagacttctgccggacctacaatgtgggggagttgagtgagagtcaaagtgagtgtgagatgtcacatctgcgactgagtagcaggggccctgacagtcctgatgctttccatctaactggaacttgtcttggttgtagaaagaaggcgatgacattctaagaaacatcaacgaccaaagaaccccatcatatcctttattactcacgtcacttccctgacaccaaccacttatattgaaaatgatgacggaagaaggraaaggaaagatagggcacccatattgccttttcctttcagatcttccttactcctcaggcagcataaagagtgaggtagaatggacacatagcgagaagtgaagtaaaaacgattgagttagctttatggatgtttctctggttctggtacatcacaaaatgcacatccaagtcctaaaatacaattcatgtaatgttggtgattccacatactagttaaaggctttttatatttgcagttaaaactggcatcacacaatataaataggagtggtaaaattcatgctaattcatgtaatt

SEQ ID NO: 60282 - DNA, 601 bp, Human
ttaatgttgctttacttagaataatattaaatagcaaattaaaaataccatgacacatcaagagagagactgtggaggaaagagaaaaagctttctattttagtaccatgattgatactttttttttttttgccttttgcacaaagggttccatattttcattttgcactgggccccacaaattatgcagccaaccctgactggcatcctggggctggaggtctcaggctggtcttgcacgtgcagcctctagatccctggtctgctcacattgtctcctgggttgcggagctaagaagcrtcatataggcaagtgagcatgtgtgcttgctctgaagattccaagcttccaggtggtggtggctctgttgatagagataaaaagttgaggaatttcagaggctacaaacatactcttgttgaaggtgctttgggggtctcctgagcatttacttttgtgaatttttgggcagcctagtatagaggtgatccagcagtaagctgagagagaggccctagtttgactcttaactcaggcatggtctccttggatgagtcatttcttcatcaggcagtcctcagtcttttggttgcagtgtag

SEQ ID NO: 60283 - DNA, 601 bp, Human
cttgtgagctcaggctatctgcctgcctcagcctcccaaagtgccgggattacaggtgtgagccactgcgcccggccttatctccatctcttaactagttgtttgatgttgggcaggttgttcaagcctcctggagccttggtttacccatctataaaatgggtataatggtaattatcttatagcatggtcatgagcgtgaaatgagagcagggggaggagtaatcattgtgtctggtccatgggactgaatcaatgctagcaatggtcatgatggtgaagaatgaggggaggaggaagmaacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgtccattccctactaagccttggtttacgcatctgtcaaatggagcattcgtgggtgtgcct

SEQ ID NO: 60284 - DNA, 601 bp, Human
gggctggaaagtgggataaggactaaggacttctgtctctggattcagcatgctgattatggggaaaagcagacatcaattcctcatgtcttgtaagcatcactgtcctccaaagttggagcccagctcagacagctgcatagtattttatagagaaggtgtgttgttgaaatgttgattgtgcaaattgaattgtgttttaagactactgggaaaaccatttaaaggaatcctattgtaagtcattttgaaaaatggagaattacaccacctccccaaggattttctgttttggtaaatwtcatgtggcaagattacttgaagaagggttccagtgttttgctagcttataatggttactgcataaggaaggtttactcgccagaggtccgcacacattggagaactgggggaatatgtaatacttgtgcagaaatgttttgattcatgtactcagaagatgggatctggatgacacctccagcctattgattcccaagtaaggtgtgatgacaccaccaccagcgaggtgtgctatgaggaatttttgttgatgatgaaaagtgaatgctaactgattgcacaccacgtgccccatacc

SEQ ID NO: 60285 - DNA, 601 bp, Human
tccttgaggggtgttctggaacaaaatagttgtggtggttgtacaatattgtgaatgaactcaatgccaccaaattatacacattaaaatggctaacatggtagatttttgctgcatgtattaatatattaatgtattaataaatgtattaattacaatattaatatattgtgatatactgtgatatattgtgataaatatatcaatatattgtgataaacatataaattgattttaatatatattaaaatcaaatgtattcctctaatggtgtccatgtcactgacttagtttctgatakgtttgtattgggtaggaaagaaaggaatgggacatttacgtgtacactgaggcagaagaaagaatgggactttccaatccaggctctacctttatgaggaaccagagacccagagagtgctagtgacttgctcaagggcacagagcagcgtaccagagttgagctttggcttctagcctcctcactttctattggggaagtcacagtggaaaagggggttttggctcctttatgtctttgggtatgttctgggtcactgaggatcagctctattccacctggcattttgtgctttccttg

SEQ ID NO: 60286 - DNA, 601 bp, Human
tgttcacattcagagtcctcatctttgaatgtgaacgatatttctggcctctcctatcttatggagttggtgtaagcatctgcatgagatgatggacgttaaagtgctttgttagctgttgagactcttactgaaatgaaacccaaggatgggtgccactgaaagaaacaagaatgaatgcaaactggtttgtgttgggagttgtacttggcacagctgaatttgcctttgtctttaggagagccttagctgtgggaagcagggcttggaatgcgctgatatttatttcttccatcaaatyggattatgaggcacctgatctgtttaaggctgtgtgagtagaaccaggtcctgccttccagaagttcatggttaaattgtgttttcatgggtcacctggaaggcgagcttgttgagaatgaggataattgacccagtgaatccttcctgcctcgaggcccaccatgttattcagatcagtcttgggggaaatgctgtgaaagtgtgtgtgtgtgtgtgtgtgtgtgtgtgcggtgtgtgtgtgcatgctcgcgtgcatgagtttgtgttgagagaaagaaaaaagccaggagagtaggat

SEQ ID NO: 60287 - DNA, 601 bp, Human
ttccgtgtggtttcacacaaggcacatggcctccttgggactcacttcacatcactcgacaaggggatagcaggacccaccttgactgtattgaagactgcatgatgatcaggagagagtgagggatgagaaagagtttggaaaacagcagaacacgatgcaaacatgagttattcatggttttgtgtccaggctaactgtgccctgacattaaggctgggtgggtctggcccagggcttctggggtaggcgctgtgctggtgtgtgctactgacctggagtccaggatccctgagtcccrctcaccctccctgggctgcagtttcctcagcccagctaccctttccagctgtgactgctggttgtggagctgaatgtgtgtggggtgtgggcctgtgtgtggactccccacccctgtgcggttttcctaagcacacagcacaacaaggagctggaacagagctgcaacaatgaggagggtttcctccaactgtcagtgcttctggatccaccgtttcggctttgacattaccgtgagtgaccaccctggacctctttctttgtgccaaactcgttgctggattgccataaacacttactt

SEQ ID NO: 60288 - DNA, 601 bp, Human
ccttccctgccccatactgttgccctcacccaccccaaagcctcacccttcccttccatagggatatggcctgatagaggaggagccatttgattttgactattgttgaaattgagtggggaattttgggtttgttttaggttttggaagggaggattatctgaggcttgaggcttctgtgatactgacatctggtgtggaaagtcatcctccctcacctaggtgactgggcctccaggtcatctccccgagcagcctccctggatctgctctcctctcccccccacccccccaccacctsccgcgctgtgcccagggtgatctttctaaaggacagatcttgcttcagcacctccctggttagaacccttccgtccagtggttcctagtgcttcggggataactcgccttgtcccttggggtctgcacagtgtcctccatctcctctcacttggccttgccctcgggggctccggtaagaagctttccaacctggcagctgcagactctgtgcggttgtattattgctgtaaatgggcagggattacgcatttgtggagtgactgatttcaagtacaactgccaccatgggagaggtctg

SEQ ID NO: 60289 - DNA, 601 bp, Human
ggcttgaggcttctgtgatactgacatctggtgtggaaagtcatcctccctcacctaggtgactgggcctccaggtcatctccccgagcagcctccctggatctgctctcctctcccccccacccccccaccacctcccgcgctgtgcccagggtgatctttctaaaggacagatcttgcttcagcacctccctggttagaacccttccgtccagtggttcctagtgcttcggggataactcgccttgtcccttggggtctgcacagtgtcctccatctcctctcacttggccttgccctygggggctccggtaagaagctttccaacctggcagctgcagactctgtgcggttgtattattgctgtaaatgggcagggattacgcatttgtggagtgactgatttcaagtacaactgccaccatgggagaggtctgtgaaaatcactggaattgaaaatgaccatgctttgcccaaaaaggttgagaatccccactctgatgatactagaagcctgcttgcctccccaccctgtgccaagccatttcttgcctccttgctttgcccataccagcctggaatgtcccaagcctattcaact

SEQ ID NO: 60290 - DNA, 601 bp, Human
cacaaatacttgtcgaagaacgcatgggatgaatatgcatttgggtatttttaatgcttgatgattagaacattctcatggcttgttaacttgtaagacataattttcattgtaagttctttgtgtgtgcaaatgctttttgcgtggaatgcttgccatgcactgaaaaatgctttgtgatagcagttttgaaaaattgagtcattttgccctgattgaagctgggtgaccttgtgcaagtcactttaaccctctgggacttgtggccctcatctgtaaaatgggtagaaggtcagagtgsacctcgtggcctgagaggctagtaccccatgctgcatgtaagtcttacatcctcctctttggtgattggatactgaccctctccccaggggttcctgcacagagctggaattctctctggtgtctttgcattccagtgggtggaatgccttgtttctcagtagcaatgagaaatgttaatgtgaggttatgaaagcaagccaagagccatggaataattaaaacacacacgcacacaaagaaggaaaagcgagagggggaaacacacttaatggacaagggatgagtaaaacccaatgga

SEQ ID NO: 60291 - DNA, 601 bp, Human
ttgtgcaagtcactttaaccctctgggacttgtggccctcatctgtaaaatgggtagaaggtcagagtggacctcgtggcctgagaggctagtaccccatgctgcatgtaagtcttacatcctcctctttggtgattggatactgaccctctccccaggggttcctgcacagagctggaattctctctggtgtctttgcattccagtgggtggaatgccttgtttctcagtagcaatgagaaatgttaatgtgaggttatgaaagcaagccaagagccatggaataattaaaacacacacrcacacaaagaaggaaaagcgagagggggaaacacacttaatggacaagggatgagtaaaacccaatggactgagaaaaccccagagctgaacttcacatgaccccgcgtgctgcctgcagttgcgacacccgcgtgccccttacgctccgccggcctctcagtgatgtcagtgggccatgggccccacaggaagcaggggctgccatcagcctggtggagcgtgccagcccgctcctcctccacggcccacttcccacccacccgggtctccagataacatgaagccatagctcccaggc

SEQ ID NO: 60292 - DNA, 601 bp, Human
ttacgggcatagccaccgcacctggccttccatttgtatatcttgtttggaggaacatctacaaatcctttagccatttctttttttttctttccttttttttttttttttttttttgagacagagttttgctcttgttgcccaggctggagtgcaatggcgccatctcagctcactgcaacctccgccacctaggttcaagcaattctcctgccttagcctcccaagtagctgggattacaggcgcccgccaccactcctggctaattttttgtattttttttttttttttagtagagaygaggtttcaccgtgttagccaggatggtctcgatctcttgacctcgtgatccacccatgtgggcctcccaaagtgctgggattacaggcataagccactgcgcccggccttaaaatatatttttcaaaatctacattgttcaaaaaaagaatctgtggtaactctcagaaatccaataattacaatagtaaatacaagtaaagatagacaaggaaattaggggagaagacaagaaaataggaaaataagatgacataagagttaatgttagtacaacaactaatatgttgtaaggtttgt

SEQ ID NO: 60293 - DNA, 601 bp, Human
agtaactgtgtcttatttccctcacatctccctgtagtgcttaggacaaagcatgggagatgcttacaaaatcttgattgaattctttttcaaattgggaatgtttattacattctttggcagcatttctgccaccaggttgaggttagttgggaccaatttggcggtggagaagtggcaggggctgccctcctggatgcattttagaagtgttttcttgcatcatgcttcctgagtgctggctaagcagtggaaacattgggcaggtggggttgtgtgcccttgccctgagagatggccrtcactttggagtgaaggtaagcagcattgcttcactcatgtggaacccacccgccttcccacctcctcagcgctggagggtcctctctctcgcccactccctctgacatgcctctgagactgcctgcccgatggaaatatccagcatgtatgagggaggtcctggccaaaactgaacagcttctcatggaattgggcccctcatcacctacggttatgtgtggcgcacagatggccactctgcaaagaggcccacccagatagctccctcaccgggggcaaggaacaagccaccttcaac

SEQ ID NO: 60294 - DNA, 601 bp, Human
ctcctgtctcaaatattggagcttttttggctacagccctgtgatgaaggcagtgtgggtgctgttgaccctatcttacccatatggacactacatcatctagggtcaccctgttggttgggatctggagtaagcccagaggccaggattctgacttctggtccagtgctctgccctaggccttgagcaaatgtgtatcaagttgcactgacaatctttgaattcctggaactcatgccatgagcacttccaggagcaccttagtgcttcattacaaagatgatgagacgtaggaaagtcttttttttttcccacggaagcagaatctcacccacacccgcagattttgttgtgtcccttcagcactgagctgtgttctcagaacagaacaggtagaatagagtcaaaatgcaaacagaatggcctccctccacagtctgctttgatggaaatgtgatgccaagcaaacagaaaagttgttttggctccatctctgaggtcatttagttgctatttccatctactttgaatccacatctgctgtgtgctcagagccgtgctggttgccaaagaatccaacaagaaaaaggcatggccccct

SEQ ID NO: 60295 - DNA, 601 bp, Human
ttcccacggaagcagaatctcacccacacccgcagattttgttgtgtcccttcagcactgagctgtgttctcagaacagaacaggtagaatagagtcaaaatgcaaacagaatggcctccctccacagtctgctttgatggaaatgtgatgccaagcaaacagaaaagttgttttggctccatctctgaggtcatttagttgctatttccatctactttgaatccacatctgctgtgtgctcagagccgtgctggttgccaaagaatccaacaagaaaaaggcatggccccctttggggcrcttgggtcctctcgcagtgccccaagcccaggtgagagacatgccctctgggccgtgattccctcatcagtaaagcaaggaagataatgtctggttaaccaccctcctggagtcatggcaaggctgatacagattcagtggcattaactcatttgttcattcagcacattttactggcaacttatgctgtgctgggctctggatatagtagtgagcaaagaggaagcactcacaagggtaacactgcaaatgctaggagtcatgcatgagaagtccagggagcctgattccatttgagca

SEQ ID NO: 60296 - DNA, 601 bp, Human
ttcccaccttgtgggcctcactcaaatgatgaccccaggttctgcctgtgatgaatgagcaggcatggttttgttctgttaggatatgacggtagaagagagctgtttgtcagaaccagcagtggcttcagatcttgaaagtccaactccttcattttacagaggaggaaacctgtgccccaaagcaggtccccccaagttccagcccagtgccaccccactgcacagagcagctgtctccttttgatcatgaggaagccaccaggtccctggtggagttcagcagatgtgccgggtgggygactctggtgggtgtgaggatgtttcctttcctgctgggaagtcctccaagctcttgtgaaagagatgtggtttgtcgagcatggattttcaaactttctttatagagagctgttgttagcttaaaaatgcctggaaacatgatcaagtgtaatgttttaatgataacatagaagcacatagtactaagcacatgtaatgagaatgtacagaactctctagtaagagtctgaaatttggccgggtgcagtggctcatgcctgtaatcccagcactttgggaggccgaggcgggtggatca

SEQ ID NO: 60297 - DNA, 601 bp, Human
aattgcttgaaccttggaggtggaggttgcagtgggctgagatcgcaccgttgcattccagcctgggcaacagagtgagacaatgtctcaaaaaataaaaaagagagagtctgaaattcattctttcaacatgcttgtgttgggtgctgcctggcacagcaattggtgcccactaactcacagcgtcggggaagataggcacggaacaagtcatctggtgtggtccctgcagtgggggagcccagtgagggcctgtccagcccagctgagaggagactgagagaaggctaggtggcataagtaaagatatggatagcgctttcctcttcagagtgtttattaccagggttagataaagcagatctcatgtattttctgctactaagtagaagttcttgttttgtttgatttctggtgggctttgatattttccaaaaagataataactcattgtagagtaagatcaggactggggccagcagacttgggtccaaaggtgtgtcatttttataccagactagaatcgggtgaggggagatgtaaagagatcactattgtcacggaaggcgctggaaggagctctgcttagaaaaaatgcctt

SEQ ID NO: 60298 - DNA, 601 bp, Human
tcacggaaggcgctggaaggagctctgcttagaaaaaatgcctttctctaggaggttttcatccagcatgggaacacaaaacaccagtttaaaatagctaggtaaggcttcacagtctctcaatgtgatgtgggtgtcctgagtcgtgaacatcccattgtgcaggataaaatgctggtttctgagctgtctttcaagacacaacccaaatgctgtctttgccatggtgccttccttgggaacccaagccaggtgaggtctgccttttctctgatgttgcctaacttttcctctttgtgtyccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtatggatgaggccgggctggggaggatatgagcgtagaatgagaaggtccagacctgcacctgaagaacagccccatttagggaatgcagggagagacag

SEQ ID NO: 60299 - DNA, 601 bp, Human
acccaaatgctgtctttgccatggtgccttccttgggaacccaagccaggtgaggtctgccttttctctgatgttgcctaacttttcctctttgtgtcccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtayggatgaggccgggctggggaggatatgagcgtagaatgagaaggtccagacctgcacctgaagaacagccccatttagggaatgcagggagagacagaggaaaagcaagatggtgcacagtgacattgaaggtgagtgacgagaccctgcagcaagaggaaaggagcagcagtgctagatgttgcagagaacccagaatggtaaggcctgaaaaccatgtgttttagattctgtaacctggaggccactaggtgaccttagcaagggcagtcatgatggagtgttggggctgaagcccat

SEQ ID NO: 60300 - DNA, 601 bp, Human
ggaaaggagcagcagtgctagatgttgcagagaacccagaatggtaaggcctgaaaaccatgtgttttagattctgtaacctggaggccactaggtgaccttagcaagggcagtcatgatggagtgttggggctgaagcccattgcagggaggcccatagtcaatgggaggtgggcagtagacacagagagctgggttattcttgccacacagctgtgctggggccatggcgggggtgggggtgccacagagtgggagccagagagggacctgggtaagggctgaccgtgggtggggagcccatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgcccaagagagcttctgaaaggaaaaagtcatagcaagttgatatttttaaagtgaaataacataggttggatttttctagtaacttcaaggggtaaagactttgaattttttttttggagacag

SEQ ID NO: 60301 - DNA, 601 bp, Human
agacacagagagctgggttattcttgccacacagctgtgctggggccatggcgggggtgggggtgccacagagtgggagccagagagggacctgggtaagggctgaccgtgggtggggagcgcatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgccsaagagagcttctgaaaggaaaaagtcatagcaagttgatatttttaaagtgaaataacataggttggatttttctagtaacttcaaggggtaaagactttgaattttttttttggagacagagtctcgctttgtcacccaagctggagtgcagtggtgcgatcacagctcactgcagccttgacctcccaggctcaagcaatcctcctgcctcagcccctcaggtagctgggattataggcacacgctaccacgcctggctattttttgtatattttgtggaggtggggtttcaccgtgt

SEQ ID NO: 60302 - DNA, 601 bp, Human
gctgggttattcttgccacacagctgtgctggggccatggcgggggtgggggtgccacagagtgggagccagagagggacctgggtaagggctgaccgtgggtggggagcgcatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgcccaagagagcttytgaaaggaaaaagtcatagcaagttgatatttttaaagtgaaataacataggttggatttttctagtaacttcaaggggtaaagactttgaattttttttttggagacagagtctcgctttgtcacccaagctggagtgcagtggtgcgatcacagctcactgcagccttgacctcccaggctcaagcaatcctcctgcctcagcccctcaggtagctgggattataggcacacgctaccacgcctggctattttttgtatattttgtggaggtggggtttcaccgtgttgcccaggctg

SEQ ID NO: 60303 - DNA, 601 bp, Human
gctgagtcaccctccggcgtggagcccggtggggatttccacgcggccccagtgttctcttctcctcgtttcctgttgggctgtgacgcaggctggctgccagcgggtgccggtgggcactcctgacacaggccactgccagccggccttgtgggtcctgagggcatcgtgggtggctctccccccacgagtgactgtgcctggcagggtgtgccccacatgtcagttgcactccgttctgggtgggcagctcccagaggccccggggagggctgcagatgggcggggggtggctgcctgrgaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacatccatgtatgtgcttgtcagcttctagtgcctccatttcttgatatgaggaaattttgcttaaaaaaaaatctctactgata

SEQ ID NO: 60304 - DNA, 601 bp, Human
catgtcagttgcactccgttctgggtgggcagctcccagaggccccggggagggctgcagatgggcggggggtggctgcctgagaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacrtccatgtatgtgcttgtcagcttctagtgcctccatttcttgatatgaggaaattttgcttaaaaaaaaatctctactgataggacctctgcatattcatgcatgtttttcctccagaactttgtgtcccaccactgtgctaggcagtttacaaatgccatctgatttcattcctgccacttcagtctaaggctatattgtccgatacctatccaccaccctcatgtggctatttaaatgttgggtcattaaaattaaatacaattacaaatgctgtccctcagtcacaccagccgcatt

SEQ ID NO: 60305 - DNA, 601 bp, Human
ctgtaggcttcagggactcttcagttagcctgggggtactgtgcgggtcagctcttttgctgttccccccagaccctgtcagctgtgggtggtggctggtttctcttggtttcctcaccagagtttgggaatgagcaagtcaggactgctttccgtacggtaatcctttggcccatttcctatcgggggatttatggagctggtgatctcttgggttttttggccatttgttagagccaaaagaggtcacaggaaatgatatactagtttcattgcccaaaatactgaggtccagagaggkgaggggatgctgagggtcttgcatctagctaagagctgagctggctcttaaacttgttttcaagccaggacttacctgactttcttaggaaagtaatcactccatagacaaggataggtttttttcacagagcaatgatgttccctgtggtccctatgtagggtggtaaggaatagggctttgggatcctacagaccagggttcaaatcctggccccaccacttgtaagttatgggacttcagacaaggacttaaacattctaagtcctcagtttcttcatctgtaaaacagggataaaa

SEQ ID NO: 60306 - DNA, 601 bp, Human
tcatgcctgtaatcccagtactttgggaggctgaggtgggaggatcgcttgaggccagaagtttgagaccagactggccagcataacaagaacataacaagatctcatctctacaaaaaattaaaaatattagctgggcatggtggtgtgagcctgtggtctcagctactcgggaggctgcagtgtaaggttgcttgagccaggagttaaagtctgcagtgaactcgccactgtactctagcctgggcaacagagtgagaccctgtctcaaaaaaaaaaaaaaaaaaaaaatcagccaggygcagtggctcacacctgtaatcccagcactttgggaggccgaggcgggtggatcacctgaggtcaggagtttgagaccagcctagctaaaacatggtgaaattccgtttctactgaaaatacaaaaaattagtcaggtgtggtggcacacgcccgtaatcccagctactcgggaggctaaggcaggagaatcgcttgaacccaggaggaggagtttgcagtgagccaagattgcgccatcgcactccagcttgggcaacaagagcaaaactccgtctcaaaaaaaaggaaaaaagaattc

SEQ ID NO: 60307 - DNA, 601 bp, Human
ggttcaactgctaacctgaaaagctataataaaacatcccagagtatccaaaaagcctggaaacaaagggaaaatagtgtgtcctgctttccaactttcggatatgctgtagaatagactgaaacaaatcactggaaaataggttgttgtcgattttatttagaagcttttgttcctttggattttcgtctcttatttttagacagagtctccctctgtcacccaggctggagtgccgtggtgcaatgatagcttactgcagcctcaaactcctgggctcaaatgatcctctagccttgayctcctgattagctgggactacagaagcaggccaccacgtctggctaatttttgtatttttctgttgagaagaggtcttgctatgatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaact

SEQ ID NO: 60308 - DNA, 601 bp, Human
ttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccaccckcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattggg

SEQ ID NO: 60309 - DNA, 601 bp, Human
ccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcrctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtg

SEQ ID NO: 60310 - DNA, 601 bp, Human
ccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagaygtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgct

SEQ ID NO: 60311 - DNA, 601 bp, Human
agtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctragttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacaca

SEQ ID NO: 60312 - DNA, 601 bp, Human
tgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccrccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttc

SEQ ID NO: 60313 - DNA, 601 bp, Human
ggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtrtgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccag

SEQ ID NO: 60314 - DNA, 601 bp, Human
cctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcrtttaaggcccatcttcaccccataaatgccagctccccaaggacagagccctttcctgtcttgtccacaccatgtcccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggag

SEQ ID NO: 60315 - DNA, 601 bp, Human
cagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcatttaaggcccatcttcaccccataaatgccagctccccaaggacagagccctttcctgtcttgtccacaccatgtyccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacaaggtgggcactcattagagggcagctctt

SEQ ID NO: 60316 - DNA, 601 bp, Human
actcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccmggtgttttgtttttctgtctcctccctctgtttctgcagtgcctccccctgtaaaaaaggaaaccaagaggctgacaggttaagtgacgggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcaccc

SEQ ID NO: 60317 - DNA, 601 bp, Human
ttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtstcctccctctgtttctgcagtgcctccccctgtaaaaaaggaaaccaagaggctgacaggttaagtgacgggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactca

SEQ ID NO: 60318 - DNA, 601 bp, Human
atcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacrggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctgg

SEQ ID NO: 60319 - DNA, 601 bp, Human
tgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttyctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctct

SEQ ID NO: 60320 - DNA, 601 bp, Human
catatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagcyggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttg

SEQ ID NO: 60321 - DNA, 601 bp, Human
aaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctrggttcagatccctgcttttactcctgaccacttagtagccttggccgagtccctcaacctttttgcctcagtttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatag

SEQ ID NO: 60322 - DNA, 601 bp, Human
aatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtarccttggccgagtccctcaacctttttgcctcagtttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgt

SEQ ID NO: 60323 - DNA, 601 bp, Human
ccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttayagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggttggtttagccttc

SEQ ID NO: 60324 - DNA, 601 bp, Human
tttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggttkgtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgt

SEQ ID NO: 60325 - DNA, 601 bp, Human
atataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtrtatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagct

SEQ ID NO: 60326 - DNA, 601 bp, Human
catcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccrttaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcctacaccaggggtccccaaccccggggccgtg

SEQ ID NO: 60327 - DNA, 601 bp, Human
gagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttscactcacctgacctccttctcctacaccaggggtccccaaccccggggccgtggactgataccggtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccc

SEQ ID NO: 60328 - DNA, 601 bp, Human
acttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccaygctgggaatgctaagtacttctcaagcctccaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtccct

SEQ ID NO: 60329 - DNA, 601 bp, Human
atcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagccsaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattggga

SEQ ID NO: 60330 - DNA, 601 bp, Human
tatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggwgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttaca

SEQ ID NO: 60331 - DNA, 601 bp, Human
gggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattgrcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacag

SEQ ID NO: 60332 - DNA, 601 bp, Human
taaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattagcgtgcaactctgtgccaggtcctgctctgggagctttatgtgtgctgttgcccctcacactcayggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttc

SEQ ID NO: 60333 - DNA, 601 bp, Human
tctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaaytggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcgagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttca

SEQ ID NO: 60334 - DNA, 601 bp, Human
gtgtattatttgtaaagccaaataaccccactgcaatgtgtttgaaccaccaaagcaaatgatcaccttttgggaaaagaaggctgaatatccaaggccagatcagtgattcgagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggc

SEQ ID NO: 60335 - DNA, 601 bp, Human
gtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctcccsactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcct

SEQ ID NO: 60336 - DNA, 601 bp, Human
ttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctcygggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatctgcggaagagggttccagagtgtggggagagcgtgctggggaggggagctatttgttcctttccagtcatcgctgtactgagcggttccctgggacagttgaacccaggggaactgaat

SEQ ID NO: 60337 - DNA, 601 bp, Human
gggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcaccctagcctgggcaacaagagtgaaactctgtctcaaaaaaaaaaagagaaagaaaagtgaatgtgtttgctggaagctgtgcttgattragtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcagccaagagaaatggtacccaggaggtagagttgagtagagactcctttagctctcttcttttttctaacttctctttattccaccgttctctctttacttctgcctaccttagcagcatgctgcagaataaactctgctag

SEQ ID NO: 60338 - DNA, 601 bp, Human
cttgaatctgggaggcagaggttgcagtaaaccgagatggcaccattgcaccctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcagscaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaata

SEQ ID NO: 60339 - DNA, 601 bp, Human
tttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggcwgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggt

SEQ ID NO: 60340 - DNA, 601 bp, Human
agagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatayaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttcc

SEQ ID NO: 60341 - DNA, 601 bp, Human
tctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcmcaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaac

SEQ ID NO: 60342 - DNA, 601 bp, Human
tttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaartaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtga

SEQ ID NO: 60343 - DNA, 601 bp, Human
tattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagccsaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcac

SEQ ID NO: 60344 - DNA, 601 bp, Human
gaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgrcctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccat

SEQ ID NO: 60345 - DNA, 601 bp, Human
tgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttygattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaa

SEQ ID NO: 60346 - DNA, 601 bp, Human
ttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctakagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggaca

SEQ ID NO: 60347 - DNA, 601 bp, Human
taattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctagktttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacatt

SEQ ID NO: 60348 - DNA, 601 bp, Human
tgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaascctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtc

SEQ ID NO: 60349 - DNA, 601 bp, Human
tggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccstgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaa

SEQ ID NO: 60350 - DNA, 601 bp, Human
tatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagrgactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaa

SEQ ID NO: 60351 - DNA, 601 bp, Human
aaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatrcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaag

SEQ ID NO: 60352 - DNA, 601 bp, Human
atttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcaccsaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgta

SEQ ID NO: 60353 - DNA, 601 bp, Human
gacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagygagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccct

SEQ ID NO: 60354 - DNA, 601 bp, Human
atcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagcccccyagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctcc

SEQ ID NO: 60355 - DNA, 601 bp, Human
cctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggkggaaatgttttagtgactggtatcaagggttatgaaatcctgttttcagctcttcatgtccaatctaaactggaacattcaaaaacatgcttagcacacttacagaacttgttgagaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaa

SEQ ID NO: 60356 - DNA, 601 bp, Human
attatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcasagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcag

SEQ ID NO: 60357 - DNA, 601 bp, Human
tttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgcyctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagtt

SEQ ID NO: 60358 - DNA, 601 bp, Human
gtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttt

SEQ ID NO: 60359 - DNA, 601 bp, Human
ctgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacragcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgc

SEQ ID NO: 60360 - DNA, 601 bp, Human
aatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagtt

SEQ ID NO: 60361 - DNA, 601 bp, Human
tatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctscctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgtt

SEQ ID NO: 60362 - DNA, 601 bp, Human
agccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagyatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttggga

SEQ ID NO: 60363 - DNA, 601 bp, Human
attcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgrcagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttacttt

SEQ ID NO: 60364 - DNA, 601 bp, Human
ggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaasaccctgtatcaaaagtaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatg

SEQ ID NO: 60365 - DNA, 601 bp, Human
aaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgcca

SEQ ID NO: 60366 - DNA, 601 bp, Human; identical to SEQ ID NO: 33514

SEQ ID NO: 60367 - DNA, 601 bp, Human; identical to SEQ ID NO: 33515

SEQ ID NO: 60368 - DNA, 601 bp, Human; identical to SEQ ID NO: 33516

SEQ ID NO: 60369 - DNA, 601 bp, Human; identical to SEQ ID NO: 33517

SEQ ID NO: 60370 - DNA, 601 bp, Human; identical to SEQ ID NO: 33518

SEQ ID NO: 60371 - DNA, 601 bp, Human; identical to SEQ ID NO: 33519

SEQ ID NO: 60372 - DNA, 601 bp, Human; identical to SEQ ID NO: 33520

SEQ ID NO: 60373 - DNA, 601 bp, Human
atgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatayacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttcca

SEQ ID NO: 60374 - DNA, 601 bp, Human
acattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgcckttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtc

SEQ ID NO: 60375 - DNA, 601 bp, Human
tgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattrcccatccatagatctgactctggaaacaccgatgaagtttggctgaagtcatgccagtggatggatttagtggagaggccgacccagctcaagatggaaagacagccagagatgcgctcgggcggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcaggggttcaagggggagcttttagggag

SEQ ID NO: 60376 - DNA, 601 bp, Human
tacttctgtcttaccgccccattacccatccatagatctgactctggaaacaccgatgaagtttggctgaagtcatgccagtggatggatttagtggagaggccgacccagctcaagatggaaagacagccagagatgcgctcgggcggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggkttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaataaagcagaggacatctggtttctcctttcatttcct

SEQ ID NO: 60377 - DNA, 601 bp, Human
gagatttaagaagaggccttggatttggcatcaggggttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaakaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcttgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggg

SEQ ID NO: 60378 - DNA, 601 bp, Human
tgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaataaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcytgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgaggga

SEQ ID NO: 60379 - DNA, 601 bp, Human
ttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgktgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgag

SEQ ID NO: 60380 - DNA, 601 bp, Human
tcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggrgactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttg

SEQ ID NO: 60381 - DNA, 601 bp, Human
catgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaaygtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctag

SEQ ID NO: 60382 - DNA, 601 bp, Human
ccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccrtgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattc

SEQ ID NO: 60383 - DNA, 601 bp, Human
ccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatrtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctc

SEQ ID NO: 60384 - DNA, 601 bp, Human
tatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggatttttttttttttaagtttccaaagcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaaga

SEQ ID NO: 60385 - DNA, 601 bp, Human
gccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcrccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctcaggaggaaccctcagcccc

SEQ ID NO: 60386 - DNA, 601 bp, Human
agaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggagsccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctg

SEQ ID NO: 60387 - DNA, 601 bp, Human; identical to SEQ ID NO: 33521

SEQ ID NO: 60388 - DNA, 601 bp, Human; identical to SEQ ID NO: 33522

SEQ ID NO: 60389 - DNA, 601 bp, Human; identical to SEQ ID NO: 33523

SEQ ID NO: 60390 - DNA, 601 bp, Human; identical to SEQ ID NO: 33524

SEQ ID NO: 60391 - DNA, 601 bp, Human; identical to SEQ ID NO: 33525

SEQ ID NO: 60392 - DNA, 601 bp, Human; identical to SEQ ID NO: 33526

SEQ ID NO: 60393 - DNA, 601 bp, Human; identical to SEQ ID NO: 33527

SEQ ID NO: 60394 - DNA, 601 bp, Human; identical to SEQ ID NO: 33528

SEQ ID NO: 60395 - DNA, 601 bp, Human; identical to SEQ ID NO: 33529

SEQ ID NO: 60396 - DNA, 601 bp, Human; identical to SEQ ID NO: 33530

SEQ ID NO: 60397 - DNA, 601 bp, Human; identical to SEQ ID NO: 33531

SEQ ID NO: 60398 - DNA, 601 bp, Human; identical to SEQ ID NO: 33532

SEQ ID NO: 60399 - DNA, 601 bp, Human; identical to SEQ ID NO: 33533

SEQ ID NO: 60400 - DNA, 601 bp, Human; identical to SEQ ID NO: 33534

SEQ ID NO: 60401 - DNA, 601 bp, Human; identical to SEQ ID NO: 33535

SEQ ID NO: 60402 - DNA, 601 bp, Human; identical to SEQ ID NO: 33536

SEQ ID NO: 60403 - DNA, 601 bp, Human
aattcagattccaagccaggtctgtgggttccaagttgaacatctttccacaacaggacagctgtgttagtgttagagctgtcttttattcacatacacatacacacacacacacacacacacacacacacgcgcgcgcgcgcacacacacacacacacacgcgcgcacacacacacacacacacatttttttcccaacctttctttccagaaaatcagtggaaagcccaaagaaggaagcgaggaaaatcagcgaattcctcagatggcctctggtcccttattcatacaagtcccacarcccctgaggcgaagccgacaccctccatttagctacacttcccttgacagcttctctttggagttttaaccgttacaggcatacacccagagctaccaatcagaatcaaccatggaaacacacctcagtaagaacttcatcagtctccacaatgcatttcttaaggaaaactggcacatttcagagtttgcttttaacaccaatcctctcctcgatgttgtcgctcaactctcgggatcagccaagcattttatgtgcctgttttactactggaagccagcatgctagccaaattcacct

SEQ ID NO: 60404 - DNA, 601 bp, Human
gcagcccgcgggatctcacctggaccttaaaagtcagcctgtcaggtagttattgtgagacatctcttctgcaggtggggaaactgaggtcaggagttgggaaatgacctctctctggtctttacactatggccgaattcagattccaagccaggtctgtgggttccaagttgaacatctttccacaacaggacagctgtgttagtgttagagctgtcttttattcacatacacatacacacacacacacacacacacacacacacgcgcgcgcgcgcacacacacacacacacacgcgcrcacacacacacacacacacatttttttcccaacctttctttccagaaaatcagtggaaagcccaaagaaggaagcgaggaaaatcagcgaattcctcagatggcctctggtcccttattcatacaagtcccacagcccctgaggcgaagccgacaccctccatttagctacacttcccttgacagcttctctttggagttttaaccgttacaggcatacacccagagctaccaatcagaatcaaccatggaaacacacctcagtaagaacttcatcagtctccacaatgcatttcttaag

SEQ ID NO: 60405 - DNA, 601 bp, Human
ccggccacactgtgcctggcagctgcagcccgcgggatctcacctggaccttaaaagtcagcctgtcaggtagttattgtgagacatctcttctgcaggtggggaaactgaggtcaggagttgggaaatgacctctctctggtctttacactatggccgaattcagattccaagccaggtctgtgggttccaagttgaacatctttccacaacaggacagctgtgttagtgttagagctgtcttttattcacatacacatacacacacacacacacacacacacacacacgcgcgcgcgcrcacacacacacacacacacgcgcgcacacacacacacacacacatttttttcccaacctttctttccagaaaatcagtggaaagcccaaagaaggaagcgaggaaaatcagcgaattcctcagatggcctctggtcccttattcatacaagtcccacagcccctgaggcgaagccgacaccctccatttagctacacttcccttgacagcttctctttggagttttaaccgttacaggcatacacccagagctaccaatcagaatcaaccatggaaacacacctcagtaagaacttcatc

SEQ ID NO: 60406 - DNA, 601 bp, Human
catacgttttaaaaatccatttcacagggcaagctaatagctgcatctgagaagaagccttcattcgtggccgcccagcaccagcggctcctgtcccagccttggagatttgggcaaaaagttaaagcatgctcaagaaatagctcaaggttagattaaaaatcaaaacgccaatgaagattaacctgactcattaatatcactgcccaataggagacaaatccttggagggcgaggcttggggccgggttttgttctaggcctaggagcatcttaatttgcatttatattaaaaaaagaraaaaaaacaaacagaattaactggaaaggtgctttgtttcctgtaaatttgaactcttgtgctaaacagcttcttagggcagagagcggaggctcgatcaggcttcgtccaagagcgtggattccgttcctactaagtgccggccacactgtgcctggcagctgcagcccgcgggatctcacctggaccttaaaagtcagcctgtcaggtagttattgtgagacatctcttctgcaggtggggaaactgaggtcaggagttgggaaatgacctctctctggtctttacactatggccgaa

SEQ ID NO: 60407 - DNA, 601 bp, Human
cttccctggttatgacaatggtcactgtgccccgggatccccagagagctggggtgagactcagggtaatatccctccaaagccttttaggaaggctcggccacagattcaacgcaaagtggtaattacatacgttttaaaaatccatttcacagggcaagctaatagctgcatctgagaagaagccttcattcgtggccgcccagcaccagcggctcctgtcccagccttggagatttgggcaaaaagttaaagcatgctcaagaaatagctcaaggttagattaaaaatcaaaacgccmatgaagattaacctgactcattaatatcactgcccaataggagacaaatccttggagggcgaggcttggggccgggttttgttctaggcctaggagcatcttaatttgcatttatattaaaaaaagaaaaaaaaacaaacagaattaactggaaaggtgctttgtttcctgtaaatttgaactcttgtgctaaacagcttcttagggcagagagcggaggctcgatcaggcttcgtccaagagcgtggattccgttcctactaagtgccggccacactgtgcctggcagctgcagcccgc

SEQ ID NO: 60408 - DNA, 601 bp, Human
tccatgacatctacaaagaggcagtgcttcctagagggcccagagcagagcgagcccaggtccgagaagggtgtggggaagaggagctgcccacaggcatctcctggctccccagcatggccagctaccctgctggacattaccaaggaggccccactcctctgggcccaccccatggcgccctagtaggcccttcatctgggtctgctgggcagttctactgaagggtggagctaaagggagaaggaaaaacgcgatggactactccaggagcccagccctggtcccagggaaaacaccrcagttggagccttcagtaaggagatcccaactgcatgacagagttcaaggccctctgccttggtgtgtgtggccttatctgcgtcaggttcctcatctgtaaagtgggggaggtgagtgcatgcgtgtggaggctccgtgctcctctggcaccagcctgtggggtctgcttggtgctgtattctgcagcccttccaagaggcccactctggcccaggaattgtgctggccctgcaggtgcacgggaaaacacacacaggtagggcctggagcagaaaacatagtatttattaaagaaaaa

SEQ ID NO: 60409 - DNA, 601 bp, Human
gggatagacagatggatggatgtgtagatgggtggattgatgggtggcagatgcacggtggatagctgggtgggtgggtggatggatgtgtgaataagcaggtgcatggaggactaagtgagtacattgtgaatggagagatggaggtgtgaataaccgctgcatggaggaagaggtgtatactggggcctgtttcacctactgctctgacctcattagactccactgatgaaagtgacccaggaaagagtaggtgagggcaatgggtatctccaactcctgggtctcacctgattcccayccctcctcagagcaccatgctgggtgtctccgcattccgaggtgtctctttgatgtaccccagaatcagaagaaaccccacttctgccccatttcttggctgtgtccatgacatctacaaagaggcagtgcttcctagagggcccagagcagagcgagcccaggtccgagaagggtgtggggaagaggagctgcccacaggcatctcctggctccccagcatggccagctaccctgctggacattaccaaggaggccccactcctctgggcccaccccatggcgccctagtaggcccttc

SEQ ID NO: 60410 - DNA, 601 bp, Human
ttaatgcaggaaggggctacccagaaaagctagtgcaccaactgaggacattaacagaagtatattgtgtagacaaggggaggtgatggtcagctctccctgaatgctcagactggactgggaaagcacatacaggctaaaatttctcagaggagaggaactggctacaaagggcattattgggagaaactcaggagcccagggctatccccaaatccctacaggctgttacagaacaggagggaggccaagctccactcagccctccctttggaggatcataagctacacggtgagtgcmctgacctaaaaagggagagctttctacaggtggaggtccccaggtggggatgggcaggaaaagagaccctcaaaacaaaaatcccttgaggaaagggacctcagactccaggctccttcaggctggccatagcagggtgctccacctggaggtgggaaggaccctcctccaattctcaggccccagaatttctctgcccatgggactctctcaagaatgcccactgcctttcctttatcagcccagcctacctgggctggttgcctcctagttcctggggctctactgagaacaagcatt

SEQ ID NO: 60411 - DNA, 601 bp, Human
cagtccatagcaatccaacacagagacaccttgaatgcagcctgtggcccccaaagcccccggcttgacaccatcccaacccccatccattggatggtaggagcttttccatctctgaggagcatttctcagtcagggcggcctcaggtgcccccttgctaagattggggccatgagattagatcaggggttcggcggcagcagaaagggggtggtggggaagtggcaaggggaagctgaaagtgaatttgccaagagtggacagagcacaaccagacccaggtgactgtcccctaatgarcacgcccaaatgaccaccatcacaacaaagctgccactcaccagctgcctcctgggtggaggaggcgaggaaacctttcacacacatttcctcccatccttacaaggacacaaattctgagctctaagtctccgtttcatagatgagggagcccaggcttaaggggtgtgcctgggattgggcctctgggatggggcatgagccagatgtgagccgccctgcagggcactggcatcccaggtctgcctgcttcccagctgtgtgccttcataagagaggccacagaggagcccctgaaat

SEQ ID NO: 60412 - DNA, 601 bp, Human
acactggcttccccctcactagtgtttgaatacctatggcctgaacattgtcccagacagacaccagaccaatttccccaactgccagagctcctcagcacttgggtgctgtcaaagaagttctctctgggaaaccgcacagggagagcctctcatcatgaccagactcactggggaacgttctcccacaccccgtggcatccctgggctgggcccttccctgcagcccggataagctcagcctaggtccacctggcatcagtggcaatcagctcccccccacgtccaactgaatgcccaygccctggcacccatgagtggcctggcactgcctgtttccagaccacatgggaccatgcacccaagctgccctgacacaaaatgctgcctagagcttctgcttcaaatgtgggaaccaagtgtccaccccacagttctcaataccacccagctcaccctgctcacctgagaggctcacctcaggcccacctgagagattcaccccaacctcacctgagttttcaccccagccccacctgacaagctcatcccagatgtatgcccaccttccacacctctgacaaacaccacatgtgcgctg

SEQ ID NO: 60413 - DNA, 601 bp, Human
acgaaacactctgccgttgcttgccaactttccctttcccatagtatgagagctatttggggattcaacacacactggcttccccctcactagtgtttgaatacctatggcctgaacattgtcccagacagacaccagaccaatttccccaactgccagagctcctcagcacttgggtgctgtcaaagaagttctctctgggaaaccgcacagggagagcctctcatcatgaccagactcactggggaacgttctcccacaccccgtggcatccctgggctgggcccttccctgcagcccrgataagctcagcctaggtccacctggcatcagtggcaatcagctcccccccacgtccaactgaatgcccatgccctggcacccatgagtggcctggcactgcctgtttccagaccacatgggaccatgcacccaagctgccctgacacaaaatgctgcctagagcttctgcttcaaatgtgggaaccaagtgtccaccccacagttctcaataccacccagctcaccctgctcacctgagaggctcacctcaggcccacctgagagattcaccccaacctcacctgagttttcaccccag

SEQ ID NO: 60414 - DNA, 601 bp, Human
ggcaatgacaagaaggtgaacatggaatgctgaagccattcttggatgtgatcatggggtctcaggagagtcgtagggaatttcctccctttcacgaaacactctgccgttgcttgccaactttccctttcccatagtatgagagctatttggggattcaacacacactggcttccccctcactagtgtttgaatacctatggcctgaacattgtcccagacagacaccagaccaatttccccaactgccagagctcctcagcacttgggtgctgtcaaagaagttctctctgggaaaccrcacagggagagcctctcatcatgaccagactcactggggaacgttctcccacaccccgtggcatccctgggctgggcccttccctgcagcccggataagctcagcctaggtccacctggcatcagtggcaatcagctcccccccacgtccaactgaatgcccatgccctggcacccatgagtggcctggcactgcctgtttccagaccacatgggaccatgcacccaagctgccctgacacaaaatgctgcctagagcttctgcttcaaatgtgggaaccaagtgtccaccccacagttc

SEQ ID NO: 60415 - DNA, 601 bp, Human
acagatagtgaacacttgaaacacattagctattttatttttatttatttatttttattttttattattatactttaagttctagggtacatgtgcgcaacgtgcaggtttgttacataggtatacatgtgccatgttggtttgctgcacccatcaactcgtcgtttacattaggtatttctcctaacgctatctctcccacagcccccaatgcctcaacaggccccagtgtgtaatgttcccttccctgtgtccatgtgttctcattgttcaactcccacctatgagtgagaacatgcgrtgtttggttttctgtccttgtgatagtttgctgagaatgatggtttccatcttcatccatgtccctgcaaaggacacgaactcatagttttttatggctgcatagtattccatggtgtatatgtgctacattttcgttatttattctattattgatggacatttgggttggttccaagtctttgctattgtgaatagtgccacaataaacatacatgtgcatatgtctttacagtagcatgatttataaccctttgggtatatacccagtaatggcattgctgggtcaaatggtatttct

SEQ ID NO: 60416 - DNA, 601 bp, Human
tcaaggagataagagcaatgacccaccagctccagatttctcccctgccagacgagggtgaagagcaggtgccctggaagccaggcagagaaggaagcagccagagagaagagcacccgccccacccctgctggcagcttcctccttctccctccctcctcccctctgctgttctcactctgaggtgctctcctgccaaaagcattccccatttcagctccatctcctcctcttctgattcttttataggggactcttgggacatccccagatgccaaatgaagcagctggtggcctctgycttcagcagcaggtctgagagtttccatcaccagccactagacttcaaagccaaccttgtccatgggcttactcacgcatggggagactaaagcccagacggggaagccaggtctgcccgaggggttggagttgaccacgggttaccaggtcacatccaggacacgtggtagctgaacacagctgagggctcagagggctgtccctgtcacaggaggtatgtgagcagagtgtgaagggccactgaacaggccaccagaaggtccattactttccaggagaccagactggatgtccccta

SEQ ID NO: 60417 - DNA, 601 bp, Human
aggcacttcaaccagaggcagtaggggccagggaagagggcatctacaattcccttctaaattttaaaaagcaagatcccagcttacagcaaatgtccacctgataggaagaaggaaaagggtcacagcactgacaccctgcctgtacgggaagattctggtcccagaacgaaaggctcaaggagataagagcaatgacccaccagctccagatttctcccctgccagacgagggtgaagagcaggtgccctggaagccaggcagagaaggaagcagccagagagaagagcacccgccccrcccctgctggcagcttcctccttctccctccctcctcccctctgctgttctcactctgaggtgctctcctgccaaaagcattccccatttcagctccatctcctcctcttctgattcttttataggggactcttgggacatccccagatgccaaatgaagcagctggtggcctctgtcttcagcagcaggtctgagagtttccatcaccagccactagacttcaaagccaaccttgtccatgggcttactcacgcatggggagactaaagcccagacggggaagccaggtctgcccgagg

SEQ ID NO: 60418 - DNA, 601 bp, Human
agctggctgctccctctgccataaggaacaagagtctctgaggcctctggggccagctccctggggaggctggcagtggccaatctcacatcatggtgtggggctccaggcaacctatagtggacacctggcctcagcaccctacttggaaagaagacgtcagtgcgtggacactgctatttaaccaaccggcatcttatgcggcctggacagtcacagccatgcctggagctcagggagacaccaggaaagatggcccagacccaggtggggcacaaagggttaccttcctgtggcccarcccatggaagcttccggtggcaccacgggaaccagaccaggccctgcaggtaccctgggatttggaggaagaacggcaagttcagcaggcacctcgggctgagtggggagcacgaggggtgcagggagaagcccggctccgaaagaagccctccgaatgggaccacccacctcttctcacaaacacctgccattcagattcgtgggctgctgtttttcaaggatttgcttttctgaaagacctagagaatattctagaacagttaaatatagctcttgtgaaagctgtcccatttccatg

SEQ ID NO: 60419 - DNA, 601 bp, Human
tgggagctggaacaagggtcgctggctttaggaggtcaccctgtgctgaggggctgcaggtggcacagcagcacagcgggcagcaagctggctgctccctctgccataaggaacaagagtctctgaggcctctggggccagctccctggggaggctggcagtggccaatctcacatcatggtgtggggctccaggcaacctatagtggacacctggcctcagcaccctacttggaaagaagacgtcagtgcgtggacactgctatttaaccaaccggcatcttatgcggcctggacagtcmcagccatgcctggagctcagggagacaccaggaaagatggcccagacccaggtggggcacaaagggttaccttcctgtggcccagcccatggaagcttccggtggcaccacgggaaccagaccaggccctgcaggtaccctgggatttggaggaagaacggcaagttcagcaggcacctcgggctgagtggggagcacgaggggtgcagggagaagcccggctccgaaagaagccctccgaatgggaccacccacctcttctcacaaacacctgccattcagattcgtgggctgctgttt

SEQ ID NO: 60420 - DNA, 601 bp, Human
ttttacatctacacagtggcaagaccagacagctgtgcagaggcttgggcctgccctggctgaaagaacactggctgaaaagatgcatttgcgggtctcgttttggggagttagggtttgctttgttttttttaacagcccacttcatagtcgtaagcatcagaggcagggtgggctgtcccctcagccccttcccttcttcctcactaagagaaccccagttttatttaaaacaacaacgggcccagctaaaaataccaggagtggccacgtgacccacttccagccaatgacagcctayggaagtgatgccaggtgggttcccggagagcgcctgtgtccctgacgcacaggtgcaggcccagctggcacctgcctctgctctcccctcctcttgccgagaaggcaggatgcggaatggcaggtgaaaggcactccctgagcacgggggtgtgggaactgcacaggcccaggtctgcgatgacttcccccaggagccctgccagccgggcctgctgacacccacttcttgttacaagggaaacccagactggtcagatttttctaacaagaagtcaacacagtctagcgatcattcagc

SEQ ID NO: 60421 - DNA, 601 bp, Human
cacctcccttctgggtgagagccctgaggtcactgtccctctaggaccacagccccgtgtccaccctaggctcttaggaagccccactcctgctcagggcaaggtgcatctggctcttggtcagcacccagctcggcccgtctccactcatgctctgagctccggggccttcacagggcccttctgttcttccaggatgaggctcaggaagccagatcctcatgcagctggaatgttctctcaacacccccgagggcctcaggcccatccctggagaaagtcctggatgcagcctcatagygctgatagaaactccacagccagttccaaggtccacaggtaccttcctctttgggggtcaaggcctgtgggcttgggtgggctgttctggcccccagacctcacctggccagggctgaaggccatcactgggcccctgatgccacgtgggctcccattctcagaccaaggtcctaggtctacagacaacacagcagtaaatggcctctctccccaggttttaaacgggtaagaaaaatgcaaccttcatccacagggcacagctaaatccagcttttacatctacacagtggcaagacca

SEQ ID NO: 60422 - DNA, 601 bp, Human
ttgttgtctcctgctctggtctgtgggctctttgaggacagaactacaacttgtgagttacttatttctgtttcccagctggggctggtacagtgcaggcactcataaatgttgcctgatgaacacaccaggatgtctcagaatagggctacctggaaaatgagaagtttgtcctcaaagggccttctagacccagcctgcccctgattctgagaggaggcactccctatgtgtaagtcacatgccaggcaccattctaagctcttctcaaatatttgctcactttgaccttcacgacacrgaggcacaaaatacgtgaatcatggccgagcacggtggctcacacctgtaatcccagcactttggaaggtcaaggcaggtggatcacatgaggccaggagctcaagaccagcctggccaacatagtgaaacccgtctctattaaaaatacaaaaaaattagctgagtgtggtggtgcatgcctgtaatcccagctatttgggaggctgaggcacgagaatcatttgaacccaggaggtggaggttgcagtgggctaagattgtgccactacactccagcctgggtgacagagtgagactg

SEQ ID NO: 60423 - DNA, 601 bp, Human
atctatacatccttccctcttctcccaacaatgaagtgtccagtggtggattcccccaacccacttctagcccttggtcttctgggccatcattagctggctacttgttgtctcctgctctggtctgtgggctctttgaggacagaactacaacttgtgagttacttatttctgtttcccagctggggctggtacagtgcaggcactcataaatgttgcctgatgaacacaccaggatgtctcagaatagggctacctggaaaatgagaagtttgtcctcaaagggccttctagacccagsctgcccctgattctgagaggaggcactccctatgtgtaagtcacatgccaggcaccattctaagctcttctcaaatatttgctcactttgaccttcacgacacggaggcacaaaatacgtgaatcatggccgagcacggtggctcacacctgtaatcccagcactttggaaggtcaaggcaggtggatcacatgaggccaggagctcaagaccagcctggccaacatagtgaaacccgtctctattaaaaatacaaaaaaattagctgagtgtggtggtgcatgcctgtaatcccagcta

SEQ ID NO: 60424 - DNA, 601 bp, Human
tggccaatggaatgtgggcagaaataatacactgcttttccaggcctgaggcatgagaaatgtcccatagctgcccatgggctctccttttctattggctagttgaatgaaagaatgccaaagccctagaggagggcagggccacaagatggaaggagcctggggccctgaatgaccaagtggagcagagcctcaactctgacctgcattaatgtgaaagccaaataaatttgtattgtgttaagccactgagaagtgagggcagtttgttacagcagttagcctgtgctgactactgctrcatatctatacatccttccctcttctcccaacaatgaagtgtccagtggtggattcccccaacccacttctagcccttggtcttctgggccatcattagctggctacttgttgtctcctgctctggtctgtgggctctttgaggacagaactacaacttgtgagttacttatttctgtttcccagctggggctggtacagtgcaggcactcataaatgttgcctgatgaacacaccaggatgtctcagaatagggctacctggaaaatgagaagtttgtcctcaaagggccttctagacc

SEQ ID NO: 60425 - DNA, 601 bp, Human
catttttcacaacccaagtcaaccttaaggtctcctagaagcctcctgtgacagaacctgttggtgttcaccaaacctcataaacctggtgcaatttcctcttgggcacacagataaactacatttcccagactcctttgcacttaggtaggatcatgtgaccaagtgctggccaatggaatgtgggcagaaataatacactgcttttccaggcctgaggcatgagaaatgtcccatagctgcccatgggctctccttttctattggctagttgaatgaaagaatgccaaagccctagagragggcagggccacaagatggaaggagcctggggccctgaatgaccaagtggagcagagcctcaactctgacctgcattaatgtgaaagccaaataaatttgtattgtgttaagccactgagaagtgagggcagtttgttacagcagttagcctgtgctgactactgctgcatatctatacatccttccctcttctcccaacaatgaagtgtccagtggtggattcccccaacccacttctagcccttggtcttctgggccatcattagctggctacttgttgtctcctgctctggtctgt

SEQ ID NO: 60426 - DNA, 601 bp, Human
aataagacactctcagtccttgctttgcccaagctgaccccccgcctagagagcttagagagcttatgtgtcccccaccctcacttcccattcatttttcacaacccaagtcaaccttaaggtctcctagaagcctcctgtgacagaacctgttggtgttcaccaaacctcataaacctggtgcaatttcctcttgggcacacagataaactacatttcccagactcctttgcacttaggtaggatcatgtgaccaagtgctggccaatggaatgtgggcagaaataatacactgcttttmcaggcctgaggcatgagaaatgtcccatagctgcccatgggctctccttttctattggctagttgaatgaaagaatgccaaagccctagaggagggcagggccacaagatggaaggagcctggggccctgaatgaccaagtggagcagagcctcaactctgacctgcattaatgtgaaagccaaataaatttgtattgtgttaagccactgagaagtgagggcagtttgttacagcagttagcctgtgctgactactgctgcatatctatacatccttccctcttctcccaacaatgaag

SEQ ID NO: 60427 - DNA, 601 bp, Human
ctgggcatcttgtccttcccaaaacgtattccacgctctgcagtggactcagtgtgtcccctaaaatccatatgttaaaattttaatcccaatgtgacagcattaggtggggctggtaggaggcaattaggtcctgggggtagagccctcaagaaagggattagtgcccttataaggacagaccccagaaagccagctcactctttctccaccacatgaggacacaggagaagtcagccatctgtaaccgaaagagggcccccaccagaacccagccaagctgccaccctgatctcagctytccagcctccagaaccatgagaaatcaaatgctgttgtttctgagctccccagcctgtgacatcttgttatagcagcccgaaataagacactctcagtccttgctttgcccaagctgaccccccgcctagagagcttagagagcttatgtgtcccccaccctcacttcccattcatttttcacaacccaagtcaaccttaaggtctcctagaagcctcctgtgacagaacctgttggtgttcaccaaacctcataaacctggtgcaatttcctcttgggcacacagataaactacatttc

SEQ ID NO: 60428 - DNA, 601 bp, Human
actccaggcagtgcctgacctggcaacattcgggacatggggccgcatgaaaagggtgggaggggaggaggggagacatcccagcacctctttgctcacccttccacctgccccactgcctgggcatcttgtccttcccaaaacgtattccacgctctgcagtggactcagtgtgtcccctaaaatccatatgttaaaattttaatcccaatgtgacagcattaggtggggctggtaggaggcaattaggtcctgggggtagagccctcaagaaagggattagtgcccttataaggacagrccccagaaagccagctcactctttctccaccacatgaggacacaggagaagtcagccatctgtaaccgaaagagggcccccaccagaacccagccaagctgccaccctgatctcagctttccagcctccagaaccatgagaaatcaaatgctgttgtttctgagctccccagcctgtgacatcttgttatagcagcccgaaataagacactctcagtccttgctttgcccaagctgaccccccgcctagagagcttagagagcttatgtgtcccccaccctcacttcccattcatttttc

SEQ ID NO: 60429 - DNA, 601 bp, Human
tggaggagcaaatgacgtaataaggtccacagcaggccctactccaggcagtgcctgacctggcaacattcgggacatggggccgcatgaaaagggtgggaggggaggaggggagacatcccagcacctctttgctcacccttccacctgccccactgcctgggcatcttgtccttcccaaaacgtattccacgctctgcagtggactcagtgtgtcccctaaaatccatatgttaaaattttaatcccaatgtgacagcattaggtggggctggtaggaggcaattaggtcctgggggtrgagccctcaagaaagggattagtgcccttataaggacagaccccagaaagccagctcactctttctccaccacatgaggacacaggagaagtcagccatctgtaaccgaaagagggcccccaccagaacccagccaagctgccaccctgatctcagctttccagcctccagaaccatgagaaatcaaatgctgttgtttctgagctccccagcctgtgacatcttgttatagcagcccgaaataagacactctcagtccttgctttgcccaagctgaccccccgcctagagagcttagag

SEQ ID NO: 60430 - DNA, 601 bp, Human
caccaaccccaaaaggagcagcggtggaggagcaaatgacgtaataaggtccacagcaggccctactccaggcagtgcctgacctggcaacattcgggacatggggccgcatgaaaagggtgggaggggaggaggggagacatcccagcacctctttgctcacccttccacctgccccactgcctgggcatcttgtccttcccaaaacgtattccacgctctgcagtggactcagtgtgtcccctaaaatccatatgttaaaattttaatcccaatgtgacagcattaggtggggctggtrggaggcaattaggtcctgggggtagagccctcaagaaagggattagtgcccttataaggacagaccccagaaagccagctcactctttctccaccacatgaggacacaggagaagtcagccatctgtaaccgaaagagggcccccaccagaacccagccaagctgccaccctgatctcagctttccagcctccagaaccatgagaaatcaaatgctgttgtttctgagctccccagcctgtgacatcttgttatagcagcccgaaataagacactctcagtccttgctttgcccaagctg

SEQ ID NO: 60431 - DNA, 601 bp, Human
ggctgcatgtacagccggaagctggctccccagaaccgggccctgccagcactctgctctcaggcttccagcctctactctgtgagaagtcaacatctgttgtctgagccgctccgagggcagcctgagctgatgagtatagggggccagggccaggtgggagggccccagtgtctcctacagcctgtgtctcctgcaacctctgtgaggggcagggacccggttctccaatttcacagctcaggagcctggggctccctcatgcctaggccacacagcaaaagggaggagccgggactcmaacccaagacctcaggaccccagcccccagttctgccctcatgcctctgcagtgcctcacggggccagacggtctctcccctcttccgtgctgcctacacgtttgtgagagccactggtgctgtgacagggcccaggctgtcagtcactaaagccaagcaccccagtgaccctggggcctagcagcaagacagggactcagcccggggtggggcctgcgaggcccacacccagcaagcacttccctgaaagccacacctagaggccaagttcccctggcctggcaccccagggacatggc

SEQ ID NO: 60432 - DNA, 601 bp, Human
actccaatacacaattcccatggcaacggcccctcgcctgaggctgcccccaggggagcctgtagcagagggacatggttgtgggacagggtcggcccaccctgtccagacacagcccccgtgggggagcctctctgtctacagcaggcttggggccaagaactgggtctccagtcctgtttcctctccagagacaggagccgcatgggaaggagcttgaggagtggagtgtttgggggtcacttacatcctagggtgtgcgggcggggaagggccacaggcagaaggggtcccaagccccggggcacctgcgtgggttccaccctgcccggatcttccctggcatcacagtgcagaaggcactgcgccaggcgggagagggcaggctcatgttggggagcagccagtggtggggaaggacaagaaggcgagaggaacaaataaatgaataaccagaggctcaacccacctaccacgtgcagaacgggattcgggcaaggagaacgagaggcaagaaggtcctcaatccttggatctggggagctaattgcccccttagttgacaaatgagtgcccagcggaactgggctcaaaaccttgt

SEQ ID NO: 60433 - DNA, 601 bp, Human
ctcgagaccaggttcctcactccaatccctcgcttaactccctgcagcttggaggtggctttctgggttcctcctctctaggacaggacacacaccacccacctgacttcatccagctgcccagaggcaggagcaggaccaggggagggcctcggggctggcacaacgattccttccttggactgtgtctagttgcctcccatccacacttcgtggtggcaggctaagcccagtctttaagagggtgctctggggcccctgtcacctgtaattaactgctcagacaatgttctgggtaacwccacatctgaagacaaaatcagctcaacccttctggtcagtcaaaatccattcacttgggcaaatgtagaaaaaccaacagccaacaccaggccatattaaaaatcacactacaagatggtctcaaaatagactccaatacacaattcccatggcaacggcccctcgcctgaggctgcccccaggggagcctgtagcagagggacatggttgtgggacagggtcggcccaccctgtccagacacagcccccgtgggggagcctctctgtctacagcaggcttggggccaagaactgggtc

SEQ ID NO: 60434 - DNA, 601 bp, Human
ctcccaaagtgctgggattacaggtgtgagccaccgcacccggccaattcttctattcataagtatttattcaaggctcccctgagcgtggcaggagcaccaccggcccccacctgtcctcatggggtctgcagtgcagtgggagaggcagatgtgaaaatgttaacacactcgcagttcccgccctgatgaacatgatgcagcatcggcttgaggctaggagaacaagggcgggggtgagatccttcctcaggccgggcaggtgggactgaccccagcagccactcacggcaggggctcrccaaggctcgagaccaggttcctcactccaatccctcgcttaactccctgcagcttggaggtggctttctgggttcctcctctctaggacaggacacacaccacccacctgacttcatccagctgcccagaggcaggagcaggaccaggggagggcctcggggctggcacaacgattccttccttggactgtgtctagttgcctcccatccacacttcgtggtggcaggctaagcccagtctttaagagggtgctctggggcccctgtcacctgtaattaactgctcagacaatgttctg

SEQ ID NO: 60435 - DNA, 601 bp, Human
atcctaaggagaaaattggacaagtgtgcaaatgaatgtgcataaaaacggtccccacagccgggcgcagtggctcatgcttgcaatcctagcactttgggaggccgaggtgggcagatcacgaggtcagaagttcaagaccagcctggccaacacggtgaaaccccacctctactaaaaacacaaaaattagccgggcatggtggtgcatgcctgtaatcccagctactcgggagactgaggcaggagaatcacctgatcctgggaggcggaggctgcagtgagccaagatcgtgccacygcactccaacctgggcaacagggtgatactccatctcagaaaaaaaaatggtcctcacaacattccttataacggcaaaaaatgaaataacctacacctccaacataggagaacaattcctaatggctgattaagattccattgcacgggaggcagagcttgcagtgagctgagatcgtgccactgcactccagcctgggcgacagagcaagactccgtcttaataaaaaaaaaaaaaagattccattgcatagttgggccatgcacagtgctgcacatccgcatcactccaaagccaca

SEQ ID NO: 60436 - DNA, 601 bp, Human
gtgagctgggaggctggggtccttcctgcccagggctctgcaagtgaagccacagcagggactcagatgggccaaaggcctggcttgctaggggctgggtgtggccaggatgggggacgaggggacacgcaggtggccagggcagtgtgaggcgaagggggactgggtgagttctttatgctgagctgtacatggcatcgaccctgctctctagtggcagctgtattcataagacagggacatgcaaaaaaggaggctcaagttctgtgccaccaccagccgctggcctgaccccatgcamcaggtcctaccaggtccaggcttggccccttctgctggcctggactggacaggcctaggctgccaggttaaggcctcagtcagccataccccaccccctgctcttccagctgctcctggccttgagggagggtctagccagggtgggcagccacagccattttcaacccaactccatatttcatgagcacccaccctgaacagacactgtgccagcccagaggatttagcagagaatcaaggagacacagtctggccctcctagtgaggtgcgggggacaggggaggggggtcagggaaa

SEQ ID NO: 60437 - DNA, 601 bp, Human
actgtggtcaggggcccacctctcccccaccacttggggaggatcctgtagccgccccattccctgtgggcctctgggcctccccatcctcctgaggccccacatcccactctactgcaggcagagatggcaggagcaggctatggggtgagctgggaggctggggtccttcctgcccagggctctgcaagtgaagccacagcagggactcagatgggccaaaggcctggcttgctaggggctgggtgtggccaggatgggggacgaggggacacgcaggtggccagggcagtgtgaggcraagggggactgggtgagttctttatgctgagctgtacatggcatcgaccctgctctctagtggcagctgtattcataagacagggacatgcaaaaaaggaggctcaagttctgtgccaccaccagccgctggcctgaccccatgcaccaggtcctaccaggtccaggcttggccccttctgctggcctggactggacaggcctaggctgccaggttaaggcctcagtcagccataccccaccccctgctcttccagctgctcctggccttgagggagggtctagccagggtgggcagcca

SEQ ID NO: 60438 - DNA, 601 bp, Human
ggaaaccagatgcgggcctcaggctacacgggtcacgcctgacttccctgctgcccagcaagcccctagccactggtacccttttccttttccgcagctccccctcaatccaagcctcactacctccactgtacaaaagataccacggaggggagagcacaacccctgccttctggaattcagccacacccaccaagaaacaagaactgggtcctggatgctattctcacaaaccagatgtgtcctcagggactagctctgtgaaactggcagactccagagccccagctttgcagctgasaggcctggacttccccacggtcacactgcctccaagtgcagggccagtgtccaggaagcgaggtggctctccttctgggctgttccctgcccatgtcctgagtctgccactgcccttggacctggcctctactccagagtccacctgcctcaggcactgtccgaggtgctgaccactgctgtggatgagggtacacgggaaggactaaggtttgctgaggcagttgtggaaggggcagcccaggaaagctcccagaaggtctgtgattagaggtgagtgtgaagcaaaaattcaagtttt

SEQ ID NO: 60439 - DNA, 601 bp, Human
cccccagctctttcctccagaacaccccacaatgttgctgaacacaaggaaaccagatgcgggcctcaggctacacgggtcacgcctgacttccctgctgcccagcaagcccctagccactggtacccttttccttttccgcagctccccctcaatccaagcctcactacctccactgtacaaaagataccacggaggggagagcacaacccctgccttctggaattcagccacacccaccaagaaacaagaactgggtcctggatgctattctcacaaaccagatgtgtcctcagggackagctctgtgaaactggcagactccagagccccagctttgcagctgagaggcctggacttccccacggtcacactgcctccaagtgcagggccagtgtccaggaagcgaggtggctctccttctgggctgttccctgcccatgtcctgagtctgccactgcccttggacctggcctctactccagagtccacctgcctcaggcactgtccgaggtgctgaccactgctgtggatgagggtacacgggaaggactaaggtttgctgaggcagttgtggaaggggcagcccaggaaagctccc

SEQ ID NO: 60440 - DNA, 601 bp, Human
gcccccagctctttcctccagaacaccccacaatgttgctgaacacaaggaaaccagatgcgggcctcaggctacacgggtcacgcctgacttccctgctgcccagcaagcccctagccactggtacccttttccttttccgcagctccccctcaatccaagcctcactacctccactgtacaaaagataccacggaggggagagcacaacccctgccttctggaattcagccacacccaccaagaaacaagaactgggtcctggatgctattctcacaaaccagatgtgtcctcagggaytagctctgtgaaactggcagactccagagccccagctttgcagctgagaggcctggacttccccacggtcacactgcctccaagtgcagggccagtgtccaggaagcgaggtggctctccttctgggctgttccctgcccatgtcctgagtctgccactgcccttggacctggcctctactccagagtccacctgcctcaggcactgtccgaggtgctgaccactgctgtggatgagggtacacgggaaggactaaggtttgctgaggcagttgtggaaggggcagcccaggaaagctcc

SEQ ID NO: 60441 - DNA, 601 bp, Human
caaccactgctggaaaagctgagcagggaaggcacacccatcccaaagccccatggctggacccacctggaggccagcccccagctctttcctccagaacaccccacaatgttgctgaacacaaggaaaccagatgcgggcctcaggctacacgggtcacgcctgacttccctgctgcccagcaagcccctagccactggtacccttttccttttccgcagctccccctcaatccaagcctcactacctccactgtacaaaagataccacggaggggagagcacaacccctgccttctggrattcagccacacccaccaagaaacaagaactgggtcctggatgctattctcacaaaccagatgtgtcctcagggactagctctgtgaaactggcagactccagagccccagctttgcagctgagaggcctggacttccccacggtcacactgcctccaagtgcagggccagtgtccaggaagcgaggtggctctccttctgggctgttccctgcccatgtcctgagtctgccactgcccttggacctggcctctactccagagtccacctgcctcaggcactgtccgaggtgctgaccac

SEQ ID NO: 60442 - DNA, 601 bp, Human
cagacaggacccgccaggtgcagacagatgagtgagcagctgggaatgctgaagcttgtcagatgacacctgccccgggaagccatccattcaccccaaccttccctaactgcttccctggaaatgactgatgattttcttctttatgccaaattttggaggagctcaaccccacacagtgccctatctataccacaaatgcttcttcaatgaccatggttgtctcctagacctgcagtttctcctagtttccatgcagaagcctagcccaggccaccgtgatctctcacccggacagagrccacagcctctcagggcctccctggagccactcttggccccataggccacaccatccacaaccagaaccatcttctccaacacaaatcagatcctgcccaggccctgctcaccctcccaagatggggctctcccttgcaggctcagccctccccagtgcagcctcacccccctgcagccccttggcctcagtacccattccaaacccaccatttgccccctccacacctttgcaggtgctatgtcctccaacaggaaccaccctgtctcctgcctggtccacctggctgaatccaactct

SEQ ID NO: 60443 - DNA, 601 bp, Human
ccaggttggggtacaggctgatgcccccaggtgcaggtaaatataccccacctagtgcccagatccaagtggcagctgtcaggccctccctgcaagcagcttggtcttcaggagtactaggaagaaaaaaatataaaaagccaggagcagcccgagcagagagcccatccagctggggctcagcctgggccactaactctttggcccctccagcccacatgcacctgaggtcctgtgctctcggacgcccctgctgtccagatgcagcaagctcttaccacctctgggtcttccccacgcygctccctcggcctggagtgcccttccccactgtcctgggcgcgcttgcctctccctcacaatctgcagacaggacccgccaggtgcagacagatgagtgagcagctgggaatgctgaagcttgtcagatgacacctgccccgggaagccatccattcaccccaaccttccctaactgcttccctggaaatgactgatgattttcttctttatgccaaattttggaggagctcaaccccacacagtgccctatctataccacaaatgcttcttcaatgaccatggttgtctcctagacctg

SEQ ID NO: 60444 - DNA, 601 bp, Human
gcggccctctaatctacactcagccatgaagctccgggacattcaaacaattcagtactccctctgtgtcacccctcctcatgggcacagcaaaggaggtatgtatgagccaggttggggtacaggctgatgcccccaggtgcaggtaaatataccccacctagtgcccagatccaagtggcagctgtcaggccctccctgcaagcagcttggtcttcaggagtactaggaagaaaaaaatataaaaagccaggagcagcccgagcagagagcccatccagctggggctcagcctgggccrctaactctttggcccctccagcccacatgcacctgaggtcctgtgctctcggacgcccctgctgtccagatgcagcaagctcttaccacctctgggtcttccccacgccgctccctcggcctggagtgcccttccccactgtcctgggcgcgcttgcctctccctcacaatctgcagacaggacccgccaggtgcagacagatgagtgagcagctgggaatgctgaagcttgtcagatgacacctgccccgggaagccatccattcaccccaaccttccctaactgcttccctggaaatg

SEQ ID NO: 60445 - DNA, 601 bp, Human
ccggacgccaatgacacgtgccgtgggcagatgagggctggagtgaagcctctgggctggatggggtgtcattcccatccccccactgcctttcctggattttaacctgcagcttacattttccctgtgacaggtaatcatcttagcatacaaaggggaagaaagccactggacgcctaagaaattacttctgttgattttcataattcatttctatgaacactctttcaaaaccaaactaaacccaacccaagaatgcagagctaatatttatcctccgaggagctttctccccatcccygacgccgtggcctcccctcccacaccttttattccatatctcaggaacttcaactacagacgggccagaattgctcactttcactgaagatggatggactccggttaaattatcctttttcactgtaactcagctggtggaaaatgacaggattttcaagtagatgagatctggaaaattggcctgagtggcgcgtcagaagcgtgtatttaattatgtaagccctgaagcctggggcaccggttggctccagagatgagcttggacccgttgatttgggggctggctgcaagtggacac

SEQ ID NO: 60446 - DNA, 601 bp, Human
gttctggccatctttccaggcttttgaaatcttttaaaatcctgaatctagcaagatgaaataagtcataacaaacatgaattcctacaaatggattcaaaatacccatagcagaaacatagagagcaccaaccagtacctctcagtttaacacaataagcagccagctgtggctccccaaaaggaatgactgtgtgaagctctatcatctctaatggggccccctggctccctgtcctaacactggccgccagcccaaactcgtgcacaaggcggggtgtgcagtgcacacaaaggtggkctgggtccatctgggcactgggctcccagaccctacacaagggacctctcccgccctctgttggcggcagggggctctgcaggtctgaggctggaaggcaggagcagagaggctcaggctgggctccgtgagcatgggcttttaggggagcactccacagggtggaacaggcccaggatggcaactgggaagaaggcatggaggagccagggtagagaagctctgaaggtcccaggctccccattgccaggagcctgggggtggttggttggaggtctatggcagaagctactccatcca

SEQ ID NO: 60447 - DNA, 601 bp, Human
gcaccaggtgcgaggcggctgcagaagccctaggctggtgtcagacccacgcacgggatggcttccctcccgcaccgtgtaggcttttgttgtcccagaattaacaaagagagtgcaagccatagaccacagccccttgtggcaggggcacccaccaagtgctccagagtccagagtggagcactgggaggcattctccaggtgctgtgggcccgaggaagacccagggcacctcatcatctcggggccccagcagccccacctgcaagaaggggtcaggatcccttcaccttctaaaggytcagaccggcccagggagcccaaggcccactagactcaaggattcagttctagacggcagaggctgcccacccatgcctgcccatgcccacctgccctcagcatggcccagggaggggccttcagggtccaggtagggaggagaggaagttggcatagtcaggcagtggaagaactgggaccttctccagcccacggcttccctgtctgtacattgaggccggtgccacctccccacagggctgcagaaaggtctacaagacaaggtgctcttgaaaaccctgagcctgacacagggccc

SEQ ID NO: 60448 - DNA, 601 bp, Human
ctgctacaatcccagcatgccttgcagcagtgcccactcaggcactgaccgggcttcagggccacctccgctgggccccggcactgccagcgcacctctgccaagagccctgcctcccccgcggagctgtccaccccctgttccagaggctgctgccatctctgatctatttgtgcctccccccacatccccgcccacagtgcagacagacatgggctagccaaccaagcccccaggaggttagcaccaggtgcgaggcggctgcagaagccctaggctggtgtcagacccacgcacgggrtggcttccctcccgcaccgtgtaggcttttgttgtcccagaattaacaaagagagtgcaagccatagaccacagccccttgtggcaggggcacccaccaagtgctccagagtccagagtggagcactgggaggcattctccaggtgctgtgggcccgaggaagacccagggcacctcatcatctcggggccccagcagccccacctgcaagaaggggtcaggatcccttcaccttctaaaggttcagaccggcccagggagcccaaggcccactagactcaaggattcagttctagacgg

SEQ ID NO: 60449 - DNA, 601 bp, Human
acccattaatggatcacagcccacggctgaaaccatattccagggtagggtttttcagccagaggtggttcagggtgggctcccgctgcataggctgggaacactgagtgggttctgaggctcagattcacaccctaaggtgggtgtcacttcttccaattcagagatgaggaaagtgaggttctaggagcccacgcggtggacctgggtagcacaggtggttttgcaaccagggccactcaggagcatgggaccagaccagacagcctgctccctggggtgctcctgccctgtccccccyccccagagcctcccactgccctctggctgctacaatcccagcatgccttgcagcagtgcccactcaggcactgaccgggcttcagggccacctccgctgggccccggcactgccagcgcacctctgccaagagccctgcctcccccgcggagctgtccaccccctgttccagaggctgctgccatctctgatctatttgtgcctccccccacatccccgcccacagtgcagacagacatgggctagccaaccaagcccccaggaggttagcaccaggtgcgaggcggctgcagaagccct

SEQ ID NO: 60450 - DNA, 601 bp, Human
cacaaagcaggggctgcacaccagcaccaggctcagtcacagcctaaaacccaaaaggccagtgagccaggtcccctctgaacagcccccaccattggtctccaccctctgctggccgcgacccccgcctgtctggatctccaagccatttctattccccaacgtccttcacccggactggggggttccaggtggctccccggaggaaatgacatcaaacctccctctcccttcaggactcagctgcagcaagaccaaccccaggggtcccaggactcactggggaaggggctgcagggamtgagggacacaggagcgttccggatcctgaagatttccctcctgggccaaggtcaccgtgcacaggccaaggggcgggcctagggcttggcactgggtcaacagctacagccatgatgccggccctcagcagggcacaggtgtcccctggcggctgtcacctggacaagcccatggcttcccatcctatggctcaagtctaaccacgctgctggcagcccccaccccacccctgagatgcatgggggtctcaggggcctctgcttactccagtctgtgcctgaaattcctccccaggacc

SEQ ID NO: 60451 - DNA, 601 bp, Human
agcaaaggtgtggcacacggtgggcctctccagaagctggtggcctcccgctctgccccagcgctctggcctgccccccccgcactttctgctacacacccaatttccaggatacctcgctgccacctcttcactgactgcgctgagcctcctctccctaggagcccttgtccctgccgtgcccgctacatggctgccctcctgggggaggaccagctgactttccctggtgagtccaatgcaactgccctgacactgcagcagtgtggctgaggactgggccacactggtgtccagcagragacagagtgagcactcagggagtagtcactggaagggctgcctggctggcagagctcagcttctgtgatgcacaggcctcctctcaggctctgccatacagatgtccacctcagctcaggaagaggagccagccagccatagcccggtgaggtagggagctccccatgactgggagtatgcaagctagggacagatgcatactcatccaagatagtctagaacagatttctgcatcagagaagggactttgaagtgtcctcctgttagccacttcagccactcctataatcccaagtta

SEQ ID NO: 60452 - DNA, 601 bp, Human
ccagcgctctcccgcctgcagccaagagcccaccctggcaggacatagggctcagcccagacaatcaagccagcacagatgactagagggacctggggccctgggtcctggcactccttagcagtcctgagccccctgaaatgggcatcatgaccattgctgttttggaggtggaacagggtggacagcgtcgatgaccggagcctgctgtcacatgcccagcaaaggtgtggcacacggtgggcctctccagaagctggtggcctcccgctctgccccagcgctctggcctgccccccccgcactttctgctacacacccaatttccaggatacctcgctgccacctcttcactgactgcgctgagcctcctctccctaggagcccttgtccctgccgtgcccgctacatggctgccctcctgggggaggaccagctgactttccctggtgagtccaatgcaactgccctgacactgcagcagtgtggctgaggactgggccacactggtgtccagcagaagacagagtgagcactcagggagtagtcactggaagggctgcctggctggcagagctcagcttctgtgatgcacaggcct

SEQ ID NO: 60453 - DNA, 601 bp, Human
ccctctggctgaaatttagcatttcttgttgctgcgtcatccacagaaacaagctgtattttcatgccacgttctgcggttgcagacgtcttgagcattgcagacgtgcaccgtcactcggagctcactggaggtgccaggcccaccggtagctctcattattgaatgcatcagtcaggaagcatatttatcgctgaatcacaggtttttaagaattattttcatatgtgtgtttcagttttattggtttcttaggaccaaatgagatcaccagggaatcgccctgcccagggcctggcakcaagaagcggtctggcacgaggaggtgaggcaggttcactatcctctccatccctgaggctctgaccagggtgccttccagtgggtccagacgcccagggacctgtacttttgggggtagcggtgtgtgctgtggtgagaaccctgggcccggaccctgcaggaacagctcattcataccttgcagctgcacccagcacccactctcagggtgccctcaccgcatggggctgctgtctgtggggctcccatcctgccctcctaaaagtcatcccagcgctctcccgcctgcagccaagag

SEQ ID NO: 60454 - DNA, 601 bp, Human
tggggaaaatcccaccatcttcatttctaccgccctctggctgaaatttagcatttcttgttgctgcgtcatccacagaaacaagctgtattttcatgccacgttctgcggttgcagacgtcttgagcattgcagacgtgcaccgtcactcggagctcactggaggtgccaggcccaccggtagctctcattattgaatgcatcagtcaggaagcatatttatcgctgaatcacaggtttttaagaattattttcatatgtgtgtttcagttttattggtttcttaggaccaaatgagatsaccagggaatcgccctgcccagggcctggcatcaagaagcggtctggcacgaggaggtgaggcaggttcactatcctctccatccctgaggctctgaccagggtgccttccagtgggtccagacgcccagggacctgtacttttgggggtagcggtgtgtgctgtggtgagaaccctgggcccggaccctgcaggaacagctcattcataccttgcagctgcacccagcacccactctcagggtgccctcaccgcatggggctgctgtctgtggggctcccatcctgccctcctaaaagt

SEQ ID NO: 60455 - DNA, 601 bp, Human
catccatgtcatccactgtgaaggccagggcccagtgacagtgggggcctgcctggttcccatactagcctccatccacttcctgccaagcagccctggcgagccaatacctgcttcataccacacccaaccctggctcatccctgacctcccaggccaggctcggatagatcttgggcctcctgggctcagggccctctccatccccagccaaaatgccctgtctctaccccaggcaccatgctaagctctgtgaggttctgaggccgtgatgcatgcgaccttcccatctgtaaagcawcccagctctggcacatcagcggcagggcttgtgactagaatcctggtctgccaccagacttacctgcctctcatcctaccccaaaatacctcctgagcccctgacgcactgtacatctcccattccaaggatgaaccaagttgagtaaggctgctgggatgtggatgtgctggtcccacagcctgcgacaccccacactactttcttcaagagaacagccctggggtcctcccctagccaccctagattgggttggggtcctcgctgggctccacagcccccctgctcattagcatcaga

SEQ ID NO: 60456 - DNA, 601 bp, Human
tcatatttacagacatgaaaacaaacagctgcagatgatgagaccacacaggtcatgaattaccaagcctatgtcaatcagaattcccaatgaccagcaaaggatctggcacccagcaggtgccaaatacaggtgactatatgaatgaacaggagctacggaagacttggtgggggagccattcttccagaatatttgtctggccatgattaggccatgccttcactgttcaacaccttccatggttgcattcaactcaaaccagagcaggaaacagggctggtgaggagaggggcacacrggctactgcaggaccagaagcagggagcttcgctgggtccctttgactttccctgagccaagtgccagctgctttgtctggggatagtccctaccagcctccctgggtgcctctaatctagggcacctgcacccacctcaggctctggggccgggcaaagtcccagctgggagagcagttttccttacaaatcagctggctcagcacccgctgtgggatggcttccctgggagtccccaggttccccggcccaaacacatgatacatagaggcatcatccgctctgcctgtttaattagc

SEQ ID NO: 60457 - DNA, 601 bp, Human
acctggaacacccatagcacagcaatcacaatagctgtgaaaacagcatcctggtggccatggaagggtcactcctgtctggaagctctgtccccagagctcattcagtgagagggcagtatttgttgaaaacaatcaaaggcaatgttttaacacagcagctgtccaaagtacatgaccacttaggtctaacaagaggctgaccaaaagacaaaaaggaaaaatgggaataggagattcaaaggaggctttggaaagctacaacatactcccgggagcctaaaaggctgtgtgcatgtamaaggcatgtgcacttgacatggccccaacatctcacctccagctgaccttgagactgtgcccaagcaggaagggaaggtgaagacagaatcatgacctgcatgtcggagtgctgaccgcataccccaacacacataggcttccttggcagagaccgcaaggcatttaaggacatctgtccagtcatcagccaactactaaggtgaccaagtgccataaggatgttcaaagcactaaaagaaccatgtctgatgaattaaaggaaagtgtgagaccaatggctcaccaaagagtaagtgta

SEQ ID NO: 60458 - DNA, 601 bp, Human
catcaaatcaacttttttgaattctggaagttagctgaagtcttgtaacaactggaaaagtgtttacgtaagaaaaatgactaaatttcaggaagaaaagaaaggtttatggcatttgaacctgcccttgtcctatctccctgcctcagctccaaggtgacctggaacacccatagcacagcaatcacaatagctgtgaaaacagcatcctggtggccatggaagggtcactcctgtctggaagctctgtccccagagctcattcagtgagagggcagtatttgttgaaaacaatcaaagrcaatgttttaacacagcagctgtccaaagtacatgaccacttaggtctaacaagaggctgaccaaaagacaaaaaggaaaaatgggaataggagattcaaaggaggctttggaaagctacaacatactcccgggagcctaaaaggctgtgtgcatgtacaaggcatgtgcacttgacatggccccaacatctcacctccagctgaccttgagactgtgcccaagcaggaagggaaggtgaagacagaatcatgacctgcatgtcggagtgctgaccgcataccccaacacacataggctt

SEQ ID NO: 60459 - DNA, 601 bp, Human
ctaaaggcgggggcctctccctggagcctgcagcctttcaatctgccctttggttccccagaagccctgtaactattcgcatcgagcctgtcccaagcatccacttattgtttcttctgctctccgccccagggcatttgtgcctgccgcatacaggccttatatataccagcagtcctcctggcataccacacctcgcctgctggttcactcccatgtccctcaacccagggctgggacagcttagcacggtggactcatgggcctgagtcaaggagcccctactacttggtttccttargctgttgggtctcaagtttaaatggcttcagggaccaggtaagtgccactcatggggaaggtgattccctgatgaagaggagatcctgtgcccacctaagggggcagccaacaagcagctccagttactggcttgagggaatatggctcagggaggcctaacctacccctcatgggaaaggcaggcatccagatgcacctgtgggtgggccatggtgccccacagcctccctagcctcttgtctgccctcccaatccacctttcctggagcccccactgccctcaatccgcaggtccact

SEQ ID NO: 60460 - DNA, 601 bp, Human
tacataacagcaacctgaggtgtctccaagtctgcagagcagagtggaaaaacccaggctgcgcgaggctcaccagctcagcccagctgctctcggtctgtgcagcctcagtaccttgtgtcctggtctcccatcctagacaaccaacaccacacagggccttcccccgaggcctgctgcgagcgtgaagacgacgacacacaaagcaaggggaatggcctccctaaaggcgggggcctctccctggagcctgcagcctttcaatctgccctttggttccccagaagccctgtaactattsgcatcgagcctgtcccaagcatccacttattgtttcttctgctctccgccccagggcatttgtgcctgccgcatacaggccttatatataccagcagtcctcctggcataccacacctcgcctgctggttcactcccatgtccctcaacccagggctgggacagcttagcacggtggactcatgggcctgagtcaaggagcccctactacttggtttccttaggctgttgggtctcaagtttaaatggcttcagggaccaggtaagtgccactcatggggaaggtgattccctgatgaag

SEQ ID NO: 60461 - DNA, 601 bp, Human
aggcacactcagacatgtacatacgcagcccagaggcccggctctcccaggccctcccttacataacagcaacctgaggtgtctccaagtctgcagagcagagtggaaaaacccaggctgcgcgaggctcaccagctcagcccagctgctctcggtctgtgcagcctcagtaccttgtgtcctggtctcccatcctagacaaccaacaccacacagggccttcccccgaggcctgctgcgagcgtgaagacgacgacacacaaagcaaggggaatggcctccctaaaggcgggggcctctscctggagcctgcagcctttcaatctgccctttggttccccagaagccctgtaactattcgcatcgagcctgtcccaagcatccacttattgtttcttctgctctccgccccagggcatttgtgcctgccgcatacaggccttatatataccagcagtcctcctggcataccacacctcgcctgctggttcactcccatgtccctcaacccagggctgggacagcttagcacggtggactcatgggcctgagtcaaggagcccctactacttggtttccttaggctgttgggtctcaagtt

SEQ ID NO: 60462 - DNA, 601 bp, Human
tgagaaccataaaacccgatgcctcttgggaggtttgacagtggaaatgaaggtaagacatgttgcatgtgtgacttctaaagcattgcttcctaataatgggatcacctgggatttgccgcaacgcccattctgcatgggaggtagggggctggggcctctgcatttctagcaagtgcctcattgacacgagtcaccacagaccccacatcatgcaaaaaaagggcctcaaaaaagcaggagcaggcaagatctgtggggtgccccaggccttgttcacagcatgttttcactgttaacrctgaactcagtgcacactgatgacggagtcagcccacgctggagtctgatggcagcaaactggcttccaccagggcctcccgcgtggaaggatgctcattttctcaggaagcaacagaagcaggtgggttctagcagagacagacagtgtctacccacatatgtgacctcctcctgctcctgggcacacagctgggccacagagtccctcgcaagtagacatggccatgtgactcagtgctggccagcagggttccaggcctggcccactaaaacctgccgtatgattttctctctctga

SEQ ID NO: 60463 - DNA, 601 bp, Human
ccggagaggcaacggcgccctctggcgggcactcgggcgactgcagggacacggccccgggtgcggggtcggccgcccacgttttccggtgactgcgtccagaacgcaggaatcatctgggaaaagtcgctaatctttctttctcatagatgagatgtcatgcgatgaatgttttctcagaagctgccatccatcagtggcctttcagcattgacaaaagataaataatggtaacaataacgactaccagatactgtgggctggcgctgggccggggactgcgctaagatattttcccttyctcaacccactggttctggggaaggggataccctttgcggggtcagtggtattctctctgtggcacgggtgagaaaacgccccctagccctgcgcaaagcacgttgcctttgtaagcccccaagccagcctgatgtggtcttcagcctctgcactcagagcctggccctggctgcaggctgggcgcccacacctggtcaggcactggagagaaacctgcattttcctgctggccgcctccacccctttccagcaaaattctcctcactcccttccgttctactctttcttcccaccacta

SEQ ID NO: 60464 - DNA, 601 bp, Human
ttgggcctgcccagagacacagaggggaagacaggtgcgtagaaggccttctcctatgaaagggccacacaagcgcactgcacatcgtgtgtcctgagcaggaggccgacagcagggtgggtggagaaggctgcggtcaaggcacacccccttctcagtcccccagaatatcaaaggctgggaaacacagaagcctgcaatcacactcttgcgagacgctggaggtcatccatcccccaagtaagtctgcttttgaaagaggctcctagaaagtgttgccaggaaggagccgaatggtccrctaggacggagagcctgtgcctcaggggctccgctccctgcaagaggggctctgcgcagcgccggccaccggagaggcaacggcgccctctggcgggcactcgggcgactgcagggacacggccccgggtgcggggtcggccgcccacgttttccggtgactgcgtccagaacgcaggaatcatctgggaaaagtcgctaatctttctttctcatagatgagatgtcatgcgatgaatgttttctcagaagctgccatccatcagtggcctttcagcattgacaaaagataaataatggt

SEQ ID NO: 60465 - DNA, 601 bp, Human
agtatttgtacccatgtattcacagcctagcttaacagtccaaacgtccatcagtggatagacgcctaaacaaacgtggtccatgtgtacaacggaatgtgttcagccttaaagagagatgcagtcctgacgggcattacagtgcagataaaccttagtcagctcaagctgggctgccataacaaaatattataccacagccctgggaagcgtcagcaaaagacactgatttctccacagttctggagcctagaactccacaatgaaagggggggaagatgcagtttctggtgggggctcyccggggctttgagggggccaccttcctgctgtgtccccagatggtgcagagagagacagtgtccccatatcccttactcttctcaggaatcctaaacctgatggatgagggcttcactcatgtgaccccatttaacctcaattacctctcctaaaggccccatctccaaatacggtcacattggaagttagggcttcaatgtgtgaatttcggggggcacagttcagtccataaccctgagtgacagaagccagtcatgaaagaacaagtattgtaggagtccacgaacaccagaacagg

SEQ ID NO: 60466 - DNA, 601 bp, Human
gctaagtgaagccagccctagaagagaacctccagttcacccggcccacctccacagtcagaggcaactgacacccgggggccggtgatgcccaactcgacagggcaggccggtgacggggttcctgccctacagatctggaaaggggacagtcattgtaaaaatgtcaaagcccacttggaaaagctgactctgtcctgggcactgtgactcctgagcagactctgcgctgtgcactatgactcctgagcaccctgggaggacccctctacttcctcatctgtgaaatggggcagatgaygtgcatcagagcacaatgagaatcagccccctcacctggcccctcccagaactggccaaattcatgggtcccctcaccgagagctgggccatgcagcctctgagccgagccccacctcaggctggcgtgcagcccttgggggtcagaccttccagcccccaagtgcccatgtggatctgtagccaaggacgtctgggcccaagggaactgacagcctgcctgcttccacagggccttcttagccggttactaggtgcctctcccagccccggaccctggtggaaggctgggggctcccag

SEQ ID NO: 60467 - DNA, 601 bp, Human
cagggtgggtagatgtgagtggtgaaggagatccaggaaaacccccagctcagcccagccccatgtcccagcacatggaaccaacccctcgagtggcagccccacccaggggtctggagcatcctaggtcacctgctaagtgaagccagccctagaagagaacctccagttcacccggcccacctccacagtcagaggcaactgacacccgggggccggtgatgcccaactcgacagggcaggccggtgacggggttcctgccctacagatctggaaaggggacagtcattgtaaaaatgkcaaagcccacttggaaaagctgactctgtcctgggcactgtgactcctgagcagactctgcgctgtgcactatgactcctgagcaccctgggaggacccctctacttcctcatctgtgaaatggggcagatgatgtgcatcagagcacaatgagaatcagccccctcacctggcccctcccagaactggccaaattcatgggtcccctcaccgagagctgggccatgcagcctctgagccgagccccacctcaggctggcgtgcagcccttgggggtcagaccttccagcccccaagtgc

SEQ ID NO: 60468 - DNA, 601 bp, Human
gtacagaacacacatacatggcatctatgaagacttcagagtacacacagtgtacacttggaacctaatgtgtagaataacggcacatgtgacatagtagcacactatatacagatagattagaccaagaggcacatataactacagcgcacccatattcaccagcaaatattgtctatgcagtgtgtgcgcctgtagaacacacatgacacaggctgtgtatgtgccacacctatgtatatgctgcagactgcacgttttagtagtacacaccatgtctacagattgtatgtagaagatmcaataaagaacatagaaaatgcatgtatgctggacacgtgacacaagatggcctctaagctcttcccaagaggagaatgaggtacaaatctaatacattcccccagcacctgtgtgacagctcaagtcctgagaaaccatttttttcccatctgcaaatgaacatatcccagcatcacccgcccaggggtcagaagatatattcattcatctactcatacattacccattcagatatctccattgactgtgccctgggacctgctcttggcacaggggattccacaaacacttctttcct

SEQ ID NO: 60469 - DNA, 601 bp, Human
accttatgtgtgtaagcacttttgaaattcttgatgcaacttcattgcgtggttgctgcagggaatccaagtcaagactgtatttcctcacattcgaaatgaaggcaatgatgttgaataggtgaagtcagctgcagggtcacccaagctggtcagtgacaatgtcagagccaggatgggatcttcccaatatggcagaaggaacaagagactcagtaggttcaaactgtgggactaacactacccagaataaaaacctggatcatggacagtgtttttttggacagaaattttgaaggaygtacctggtcttccaacatctaaaatcctgcccatcaagatagatttccctgatgggaccctgtcacatgttcatggtcacttagcttgctgctttaccttgggttccataagttttttcaaacccatgtgtctttatctgttacatggcataattgttcttaggtggcgttgtatggatccgccgagatcagacagctccgagccaagagtctgatacacagtagggacctaccagaccccaggatcctctgccgctccttcctgcatgaagctgcctctgacggctctagctcacact

SEQ ID NO: 60470 - DNA, 601 bp, Human
tcgctgctgtattcccccatacctagaaagtaaaatatttatttaataaaggaatgaataaatttgcaccactctgtgaatggagcctggatagaaatgaggaaacaacccttaaagaccttatgtgtgtaagcacttttgaaattcttgatgcaacttcattgcgtggttgctgcagggaatccaagtcaagactgtatttcctcacattcgaaatgaaggcaatgatgttgaataggtgaagtcagctgcagggtcacccaagctggtcagtgacaatgtcagagccaggatgggatcytcccaatatggcagaaggaacaagagactcagtaggttcaaactgtgggactaacactacccagaataaaaacctggatcatggacagtgtttttttggacagaaattttgaaggatgtacctggtcttccaacatctaaaatcctgcccatcaagatagatttccctgatgggaccctgtcacatgttcatggtcacttagcttgctgctttaccttgggttccataagttttttcaaacccatgtgtctttatctgttacatggcataattgttcttaggtggcgttgtatggatccg

SEQ ID NO: 60471 - DNA, 601 bp, Human
caccgagcggccgccatagtcctgcgagcggtagcaggtgcaggagcacacagactgcaggtccgggacgtccgccttgtacctgggccggctgggccgcggctcctcagggatgtgaatgaccatgctgttgcggtttccggcgagggatgccctctcttcagcatcccgccgctcatcctcactgttcatggtcaagaacctgaggacgaccaggttgaggaaggccccgatgaccgtcagccccaccaggatatacataaagctaaaggccacgtagagcggcttcttctgcagggcrcccttggtctgcagggccacgtagtccccgaacccaatggtagtcaacgtgatgaagcagtagtagtaggcgtggaagaagctccactcctcacactgggagaaggcggccgccccgatgcacagcgtccccatgcaggagaagaagcccacagtcaccatgttctccatagacacgtcagtgttgcgcatgccacagcacttcttaatgcgcttcagcaggtagcgcacgaaggtgttcatgcgctcgcccaggctctggaacatgaccagtgtcagcgggatgcccagcacggcgtag

SEQ ID NO: 60472 - DNA, 601 bp, Human
gcgccgccccattttttctaatacttggactcgaactagtggggtcactgttaggcgaagaaaggaatgacctccaaggtcacatgcaagcaaactttggtctcaactaaacaggaaattgcaccgaaatcgctgtcgctagcgccttacaagtaagggttttctccttaacccaaacaagcctttcgggctgggtttttatcacgtccgctccaaaaccgaggaggttgagtgaacttcaccccacgaccccgactctccgcggcggccggaagcggaggcctggcctggggagggcagraccccgaggggcgaggagaggaggagggggctgcgctcacctcggagcagagccatggcggctgctgggtcgtcggcggcgcgggtctgtggtgtgggggacgctgagcggccgctcgcaatcacccagatttcaagagcgtgggtggcgccccgagagccacgcccctgccctttcacctacttcctggggctccttggcggggtcccagcgtaagatggtcctaccccacgcgtagcgctgcccgcctcaccccagcccgagggagcccaggggacggggctcggatagaccacaacg

SEQ ID NO: 60473 - DNA, 601 bp, Human
gcaaacacttggtatgctgcttgagagaagtttatctttaatgattctagctggcctgtaacatcactatttcaagctcaaagcttgggttctagtcacagccactaactacctgtgttattatacacaaccactttacctctctcgacatgagtgtcctcctaattgctacaataaggaaatggaaaaaaatacaatcactagctctaacactacagtaaattgtaccagaaatttataaactttatacttccttaatacaggtgtcaatgtgcatttttttcctttttgggtttatagkatttgtgaaattttcaaacaggtctgtattataagaaagggtaagaaccactgataaaatattaaaatgatatcagtaaaaatattatttccttttttagaagatagctcatgacaatgcaccttttaaatgaagtgtaaatgcctcgtctaaaaaaaattcaccacgctgctttatgaagtaaatgtagtaaattcagtcaggaagggcactggcaaatgaaatccacgttgcaggaaactgtaaacactgcatttggtcccagaatacggatttttcccttgatttgttcccatgcca

SEQ ID NO: 60474 - DNA, 601 bp, Human
tgactgaaatctgacaaattaatgttaatccttaacaaaatttaactcaaatgtgtccttttccctataatcagtcacatgctcttctttcttcccacccatcctgcaaacacttggtatgctgcttgagagaagtttatctttaatgattctagctggcctgtaacatcactatttcaagctcaaagcttgggttctagtcacagccactaactacctgtgttattatacacaaccactttacctctctcgacatgagtgtcctcctaattgctacaataaggaaatggaaaaaaatacratcactagctctaacactacagtaaattgtaccagaaatttataaactttatacttccttaatacaggtgtcaatgtgcatttttttcctttttgggtttatagtatttgtgaaattttcaaacaggtctgtattataagaaagggtaagaaccactgataaaatattaaaatgatatcagtaaaaatattatttccttttttagaagatagctcatgacaatgcaccttttaaatgaagtgtaaatgcctcgtctaaaaaaaattcaccacgctgctttatgaagtaaatgtagtaaat

SEQ ID NO: 60475 - DNA, 601 bp, Human
agtgtagtgagtccaagtagctccaagaaaggccctggaaagatgtgctgagttgacaatacaggaaaagcaccactaggaaagaaacaggagcactacctttctatcacattgttaggtaaatattcacttagagcaacttcaggcagcaacgagggcaaattaaggaaagctgcggtggcatccagttgtttcaagattaaggtaatttagcagccctgtctacttgccttgaaaaaatacacaaacattcccaacaaagctaggagcagtaggagagctatgatctgtcgagcgaaamcctcctgccaagtactgggatgggtgctaataaaaacctaggagccggttcttcttgttgactgaaatctgacaaattaatgttaatccttaacaaaatttaactcaaatgtgtccttttccctataatcagtcacatgctcttctttcttcccacccatcctgcaaacacttggtatgctgcttgagagaagtttatctttaatgattctagctggcctgtaacatcactatttcaagctcaaagcttgggttctagtcacagccactaactacctgtgttattatacacaaccacttt

SEQ ID NO: 60476 - DNA, 601 bp, Human
gaagtgcggtagtgtgatcttggctcactgcagcctcaacctcctgggctcaagcaatcctccaccacagcctcccgagtagctgggactacaggcgagtgccaccatgcttggctaatttttgtattttttgtagagactgggtttctctattttaaaaaataatttgttattattattttaaatcttcattttaacaaataatctgggatgtgcagatagactataaaggtttaaagttttttttttttaatttcataaattgtataccatgtcaattttcatttgatgtcaattttaygtggatactaaaaggtctaaaacttaacaatctttaacaccaaactgaaatctcatttgaacaccctgaaaattcagaggctaaaaatttcccaaaactgaaagacagtgaagagacctattaacccagagtgtagtgagtccaagtagctccaagaaaggccctggaaagatgtgctgagttgacaatacaggaaaagcaccactaggaaagaaacaggagcactacctttctatcacattgttaggtaaatattcacttagagcaacttcaggcagcaacgagggcaaattaaggaaa

SEQ ID NO: 60477 - DNA, 601 bp, Human
tccgtactttctgctcaatttttttgtaaaacctaaatctgctcaaaaacaaagtttgtaaattttttctttaaagtcggatagtaaaaaaacacgggcagaacctcaaggactaacaagttacagtcataggagaggacagagaatggatttaaaaaaacatttgcagaaataataaagaagaaatttccaaatttgataaaaaacataaatttgtatattaaagcttggtaaacctcaactctaataaacaccacacgtaacactccacaccccgttctcctgcagcttggcacatcaytgtcaaacttttgaaatccaaagataacaaaaatatataaagcatccagaaataaaaatgacatattgcacacatggaaatgacccctcacttctcagaaacaatagagcctaatttcatttgtctctctacaaagttccttttatgaacttctcccctatgtctcatattctaagaaagcatttgatagggcagtgctagtagtgaaatatgcaatatctacaaaggaaagggtgtgcatgggaaaataaaaacaaaaaaaaacctcccctttacctatattacttcttatttgatgct

SEQ ID NO: 60478 - DNA, 601 bp, Human
ctcctactgcccgaccccgcaggcagtaaagaccttatggttatcttcccttgttccctaaaaatcgctgttattctgttcaaggtgcactgatttcatattgctcaaacacacgttttacaatcaatttgtacagttaacacaatcatcacagtggacctgaggtgacgtacatcctcagcttacgaagataacgggattaagagattaaagtaagacaggcgttaagagtattattagggaagtgataaatgtccatgaaatcttcacaatttatgttcctctgccacagctctagccrgtccctccattcagggtccctgacttcccacaacaatgtccttcaacaggtgaatggataaacaaactgtggtgcagccatacaatggaatattattcagcaataaaaagaagtgagctatcaagccataaaaggaaggaatcttaaatgcatgtcgctaagtgaaagaagccagtctggaaaggccatatactgtatgattccaactacatgatatctggaaaaggcaaagctatggagacagtaaaaagatcagtgcttgccaggggttcagagacagggataaataagtgaatcaca

SEQ ID NO: 60479 - DNA, 601 bp, Human
tgcaaaagatgctgttaagagaatgaaaagacaagcgacagactaggagaaaatatttataaaaacacctaactgataagggactggtatccaaaacatacaaagtgttcttacagctcagcaattaaaaaaaaaaaaaaaaacccatgcaacccaatttaaaaatgggcaaaagatctgaacagataccttactaaagaagatatacagatggcaaataagcatatgaaaagatgctcaacattgtatgtcattagggaattgcaaattaaaacaatgagatactactacacaactattrgtcttttggattttagaaaggctaaaatcccaaacactgacaacaccaaacactggtgaggatgtggaacaacagaaattcattcactgctggtgggaatgcaaatggtatggccagcttggaagacactttggcagtttcttataaaactaaacacacctaaccatatgtatgatacagcaatcaggttccttgtatttacctaaatgatttgaaaacttatgttcaaacaaaaacctgcaaacaaatgtttattcctaattgttaaaacttgaaggcaaccacgatgtcctatcatgg

SEQ ID NO: 60480 - DNA, 601 bp, Human
tttggctgactccttagccattcatgtgtaggtcagaccacaagcacctaagccaagccttaaaaaactgaacttagatttaagctgctgcccactacaaggggagacatagtttatcacgggggtgcatgggggtgattttgtaggcaaagtaactgtctacaaaaaataaatagccaaccaatcaataagtcagttctgtctgcaggattataacagaatccagtctccacaatgttccatctgcaatattcataatacaattcaaagttaatccacatatgaggaaacaaaaaatatkacaatcaacagagaccaatcccaagaagacccagacactgaaattagcagacaaggattttaaaatagcattctattacaactatgctcaaggatgtagaggaaaatatgctcctaataaaacataggacatctcagtaaagaaatacatactataaaaatccaaaatggaaattccaaaactggaaaatacctgaaataaaaaattccctggatgggcttaacagcaaaatagaaatgaaaggagaaaaattcagcgactttgaagatagataaatagaaattaaccaatctgaagaac

SEQ ID NO: 60481 - DNA, 601 bp, Human
gcatcactattagttaaatcggtgtccttgtacaaataaataaaaatcaccccttcccaatcacctactaccatctgccaaaaaaaaacttgtgactatacaaatatatgattatgatgtgagtggtacccactcatcatcattagagctgtacagtgcaaaaccggcatatcagtaagcagcatcagttatagccatttcatcatattgacattcattaggtgtctactaaatactagacattttatcactttccacacaaaagctaatcttcccagcaactctgcaaggtaaatattayagctaacatagaggggacacttactatggaatagacttcatgctagcactttgcatatactaactttattctctccaagacaatctaagctcacatttccacatcttgtcaagaaattatgggactttcggcaatgggtttgtgataagatactgatctacaaatgagactattcaagcattataccactactggtatctaagtataatcttccagtttatgatctctttcatcaaacaaaccaagcctagcctaaaatatttctatttcaacctctcttttcattcctattttgagaaa

SEQ ID NO: 60482 - DNA, 601 bp, Human
gctgctaccggttctagagtcacaggatgactcaagttacagacttcaaataaataacctgaactattatcttttactcttagaaaaaaaatgggcaaaacaggttaccttctacatgtgtatcccccacctccagtatctgaagtcagctaacctgtaagtccccaaacctagtgactctcatctcaggtaaattaaaggcattctttcaatagttttttatttgacattaattctgactgctttcctctaaagacactgtagtttgccaacatcctattaaaatgtgtcccttagaatrtaagaatataacaaaaatagcatgcattttatctaatcacaaagaatagaggaattatctatacatctactaatacaaactaagactataaatttgcagcatcactattagttaaatcggtgtccttgtacaaataaataaaaatcaccccttcccaatcacctactaccatctgccaaaaaaaaacttgtgactatacaaatatatgattatgatgtgagtggtacccactcatcatcattagagctgtacagtgcaaaaccggcatatcagtaagcagcatcagttatagccatttca

SEQ ID NO: 60483 - DNA, 601 bp, Human
ctaaaatccttcttctatgtgctggagtatattgcctagtattagaataaaagaatctccaaactagaaggtgccttagggttgtctgaggtcaaccactcactctataagaactacctctaaaaattcctgacaaaaggttctctctaaacctctgccaggaaactttcagtaagagggcatactctactgcatgaaacagtgtgctggtcatggacaacataaactaatgatattgctttttttttttttttttggagacagagttttgctcttgtcgcccaggctggagcgcagtggygcgatttcggctcactgcaacctccgcctcccgggttcaagtgattctcctgcctcagcctcccgagtagctgggactacagacacccaccaccaggcccggctaatttttgtatttttagtagagacggggtttcaccatgttggccaggctggtcttgaactcctgacctcaggggatccacccacctcagcctcccaaagtgctagaattacaggcgtgagtcacccactcccggccccaacgaatgatatttctttatattgaactaactcagcttacaaagtcttccatccacca

SEQ ID NO: 60484 - DNA, 601 bp, Human
tcttgttctctgatgcttcacaatgctagaaacatatgttgagaactaaaatccttcttctatgtgctggagtatattgcctagtattagaataaaagaatctccaaactagaaggtgccttagggttgtctgaggtcaaccactcactctataagaactacctctaaaaattcctgacaaaaggttctctctaaacctctgccaggaaactttcagtaagagggcatactctactgcatgaaacagtgtgctggtcatggacaacataaactaatgatattgctttttttttttttttttggagacagagttttgctcttgtcgcccaggctggagcgcagtggtgcgatttcggctcactgcaacctccgcctcccgggttcaagtgattctcctgcctcagcctcccgagtagctgggactacagacacccaccaccaggcccggctaatttttgtatttttagtagagacggggtttcaccatgttggccaggctggtcttgaactcctgacctcaggggatccacccacctcagcctcccaaagtgctagaattacaggcgtgagtcacccactcccggccccaacgaatgatatt

SEQ ID NO: 60485 - DNA, 601 bp, Human
gcttgggtttactaaggtggcatatagagaagatcaattaacttcaagtaagccaaggaagtcaatctgctatttaggaagcactgaaatgcatcccaagtcagacatacagtttctagaacatatgatgctttgaattatgcatgctgttgattctggagtcacagaattactcaaattacaaacgtataaagtctgtaactattggctgggagtggtggctcacgcctgtcatcccagcactttggggggccgagacaggagaatcacgaggtcaagagatcgagaccatcctggccamtgtggtaaaaccctgtctctattaaaaacacaaaaattagctgggcttggtggcacacgcctgtaatcccagctactcgggaggctgaggcaggagaattgcttgaacccgggaggcggaagttgcagcgagccaagatcgcaccaccatactccagcctggcggcagagcgagactccatctcaaaaaaaaaaaaaaaaagtctataactattattaacttgtttaccattatgatatgttaaaggaattatttttagaaactgatcaaagaagcaataggagtgaacaccttccttta

SEQ ID NO: 60486 - DNA, 389 bp, Human
gcgtctctgcccggccgcccatcatctgggatgtggggagcgcctctgccccgccgccccgtctgggatgtgaggagcgcctctgcccggccgcgaccccatctgggaggtgaggagcgtctctgcccggctgccccatctgagaagtgaggagaccctctgcccggcaaccgccccgtctaagtgaggagcccctccgcccggcagccaccccatctgagaagtgaggagcccctccgcctggcagccaccctgtctgggaagtgaggagcgtctccgcccggcaaccacgccatccggragggaggtgggggtcagcccccaccaggccagccgccccgtccgggagggaggtgggggtcagccccccgcccggccagccgccccgt

SEQ ID NO: 60487 - DNA, 601 bp, Human
gtttttcaaaacttgacaaattcggcacatttataagttaagggttttgaatgcagatggaactgggaggaactcagtataacatcaattaatctactaactaaatgtttcatctgttgactgagatgaaattatcttattttacaaattaatgtcattaaaaaaattcttggccaatggatattcttttgccaaggtttgtcaaatatcacatatcaacagaataaaaaaaatttacacgatcatctcgtgtaaattattaacagataaatatttggggttaggcctttatggttaagaragaacagaatatgcttcgaataacatttgacaaataccacaaagctgcttttctaattgagtttaatattattaaatatcacttggaataaatgagttttacttatttcttaggaaacaatgaaatccaatgtggatttcaacacaaaaagtcaacagaaaaagtatttgacaaaatacaacaccctttcatgacaaaaacactgaacaaactaggaacagatggcaactttctcaatctgacaaagggaatctataaaaaatccacagctctccctctccccctcctcctccccctctc

SEQ ID NO: 60488 - DNA, 601 bp, Human
aaagaaaaataattttctctataaatctactaattaagaacaagcacgaaatacatggaaatgttggcaatctatcaaaaatgataaactatatggctctaaggtaggacaaaatgcatctaagtacagcatattatatctaatatgtgtttacaatttgaataaaaactacagtcaattgggtttttttctatttttttattggggcaaaatacacataacaaaatgtatcattgtaaccatttttaagtgtatagttcaatggtattatttaaatacattcataatgttgtgtaaccayagtcaattggttttcaaatatattaaagataattgctacttagagaaatcccattaagtccttaatataagacagaaatttataacaattagagttatttaaaaatggaatacgctatcctaaagtagtatgctccttaacagaggaagtatcggaggctgtggttctcaaccttggttgcaggctggaataacctaggaagctttattaacatactcatgcttaagttcctaagcaaatcaattaaaccagaaaggctggaggtggggcctgggcatcagtagtcacttttaaaaagca

SEQ ID NO: 60489 - DNA, 601 bp, Human
gtatatatatatatataatacttaccattttaaccatttttaagtatacagctcagtagtttaagtgtattcatagtgtgatgcaaccattaccatcacccatctccagaacgcttttcatcttgcaaaactgaaactccatatccattaaacactaactttccctcaccagtccctgggaacaccattctactttctgtctctatgaatttgactacgctaggtatctcaaagaagtagaaacatacagtatttgtccttttatgacaggcttattccactttcaggttcattattagcttttttttttttttcttttttttggagccaaggtctcactctgttgcccatggctggagtgcagtggtatgatcatggtttacttgacctccagggctcaagcaatcctccctaaagctaaagtgttatattgcagtgggacatttcttctagtaactattaacatattttcagagaatttaaaaaaatgttgtccatacctgacatccattcacaatggactgaaaaccagaaccacagagcctattaatcgtgagagctggggtctcctttgggattcccacacgcaaaccaacatgcc

SEQ ID NO: 60490 - DNA, 601 bp, Human
tatgactgagtaaccttaatggctttaatcagtttccttgcctgtaaaatgggaataataataatagttcttgcttcataggatggttgtaagattaaatgagatattgaatgtaaatctagcagggtgcctagcatgtaggaagcactcgaaagaatgatgaacatactagcttttaaaaatattgaagtatatatatatatataatacttaccattttaaccatttttaagtatacagctcagtagtttaagtgtattcatagtgtgatgcaaccattaccatcacccatctccagaaygcttttcatcttgcaaaactgaaactccatatccattaaacactaactttccctcaccagtccctgggaacaccattctactttctgtctctatgaatttgactacgctaggtatctcaaagaagtagaaacatacagtatttgtccttttatgacaggcttattccactttcaggttcattattagcttttttttttttttcttttttttggagccaaggtctcactctgttgcccatggctggagtgcagtggtatgatcatggtttacttgacctccagggctcaagcaatcctccc

SEQ ID NO: 60491 - DNA, 601 bp, Human
caacttcagcttctttaacacaaatttcctatttaaaaacaaacagtaataaaaactccttttaccgtacccaaacaatgtattaagaaacacactgattttacaaattaatggtaaatcaaacaaatattgtactgtagcttacagtgtctcaaaaggaaatgcttttaaagtaactgtaaagcaaatgctaaagtatccattaccaagatgtaggaggagaaaactaaaaggtttcaatcatgtttgcctgagtaacaggccctacctacatgtggctaagaatagtaattcttaacasaatataaatcttgaaaatcaacagatattaatacctggcataaatgtacagcagataataaaggacataccctttaaaaaggcaaaagaaaaatttatcccattaatggatgtatctgaacaagaacagagatttacaagaactagttcaatctaggtgactcataaaaaggaaaccacttcattcttccaacactttccactgtttgcctttctcagaaaaggagcaaataatgagcctctatgaacctgatggttcttaaaattattactaggaaaaccgaggtcactatttaagata

SEQ ID NO: 60492 - DNA, 601 bp, Human
ggctcatgctttcggttcctccacataaaacaacttcagcttctttaacacaaatttcctatttaaaaacaaacagtaataaaaactccttttaccgtacccaaacaatgtattaagaaacacactgattttacaaattaatggtaaatcaaacaaatattgtactgtagcttacagtgtctcaaaaggaaatgcttttaaagtaactgtaaagcaaatgctaaagtatccattaccaagatgtaggaggagaaaactaaaaggtttcaatcatgtttgcctgagtaacaggccctacctrcatgtggctaagaatagtaattcttaacacaatataaatcttgaaaatcaacagatattaatacctggcataaatgtacagcagataataaaggacataccctttaaaaaggcaaaagaaaaatttatcccattaatggatgtatctgaacaagaacagagatttacaagaactagttcaatctaggtgactcataaaaaggaaaccacttcattcttccaacactttccactgtttgcctttctcagaaaaggagcaaataatgagcctctatgaacctgatggttcttaaaattatta

SEQ ID NO: 60493 - DNA, 601 bp, Human
ctcacattgtcgcctgggctggagtgcaacggcacagtctcggctcactgcaacctctgcctcccgggttcaagtgattctcctgcctcagcctccccagtagctgggattataggtgcccaccaccatgcccggctaattttttttatatttttagtagagatggggtttctccatgttggccatgctagcctcgaactcaccacctcgtgatccaccctccttgacctcccaaagtgctgggattacagatatgagccaccacgctcagcctgagtctttactatttacttacacaacktaccttccgtattggaggatttacgataccatcatgtgtttatgtagttgcattttgcatcttttaaaaattatagagtctttactatttacttacacaacttaccttccgtattggaggatttacgatactgtcatgtgtttatgtagatgcattttgcatcttttaaaaattatatttttaaaaattatatttttttaaccacaattttttttcaccaggtactgctaagactgttagcagcatctgtctgtttgctatagatgtaatggcaataaatggacttaataccccttttaa

SEQ ID NO: 60494 - DNA, 601 bp, Human
ctctgtttcaccccaggatttctcccatctcataatttcttttatcttgtcaggatcacgtaattcttctgttattttctgtgttgatttctaaactctcaaaggaacaataagatataattactgtgtgttgattttttaaatctcaaatggacactaagatatgattacttcctccatggagtttacacggtcttggtttttctattgtgtctaggacagttcttcataaagattttttatttaaactgattaccaatcttcttttctctacaggtgaccttggtttggccactttttyaggactctgaatgccaaagaagacttacctccagaaatattatagaaccagtttgttttactataaacttaccaatacccatgatagagggatcacatccagatacaaagtagcccacaattcttgccagtggtgtgaagttatgtttcttaacagcatcttcactagctatgataacagctccagcaccatcagctacacccttgaaaataaaaatactagattaactaaaggctaaaataatccagttaatcaaagtttgaactaatggactagtagtattaggaatatggcagtaca

SEQ ID NO: 60495 - DNA, 601 bp, Human
tttagttattcaaaaaagggctaaacaatctgaaatctataccctagggcaggcttttccttacagtgggaggttatatgtaggtgggatatatcaaagttactgagcaccaaattttatttttctaagtaaggcacctaattggttccctgttcccccagagaatgacaggaactattaaaattcagcatcgtgtgtggttcctaggagtgcatccagcaaaaagctctttgttctacttctaaatcaaatattttaagccaagactatacatgtttatggacttccaaattttttccakctagcattttaccaatctaattataagtctttattttgctaatactcacctgagcaagaggaatattaatttgacttcctgagactatgcgtttaactcacagtgaagagagcacttgatttcagagagacttggattcacaccctggctgtcacttactgatttggaaccttgtaagacaacctccctaagcctcaattttctcattcacaaagaagtctcccttactggagacgtgggaagactgaatgtgtgtaaaacaaccagcaaggagctgcgataccaccttctccatacagc

SEQ ID NO: 60496 - DNA, 601 bp, Human
gtcttctctgagggacatggcagcaaatatggttgagtattaatcccaagtcagtgtaagtggtattgtttgagtagaacctgtaggcttacactgaaggatctctgagatggcaggtcagtaacaggttatcctcctcctcctctcttggaacccacctcagaaaacaatttagttattcaaaaaagggctaaacaatctgaaatctataccctagggcaggcttttccttacagtgggaggttatatgtaggtgggatatatcaaagttactgagcaccaaattttatttttctaagtraggcacctaattggttccctgttcccccagagaatgacaggaactattaaaattcagcatcgtgtgtggttcctaggagtgcatccagcaaaaagctctttgttctacttctaaatcaaatattttaagccaagactatacatgtttatggacttccaaattttttccatctagcattttaccaatctaattataagtctttattttgctaatactcacctgagcaagaggaatattaatttgacttcctgagactatgcgtttaactcacagtgaagagagcacttgatttcagagaga

SEQ ID NO: 60497 - DNA, 601 bp, Human
gatatgtcttctctgagggacatggcagcaaatatggttgagtattaatcccaagtcagtgtaagtggtattgtttgagtagaacctgtaggcttacactgaaggatctctgagatggcaggtcagtaacaggttatcctcctcctcctctcttggaacccacctcagaaaacaatttagttattcaaaaaagggctaaacaatctgaaatctataccctagggcaggcttttccttacagtgggaggttatatgtaggtgggatatatcaaagttactgagcaccaaattttatttttctaagtaaggcacctaattggttccctgttcccccagagaatgacaggaactattaaaattcagcatcgtgtgtggttcctaggagtgcatccagcaaaaagctctttgttctacttctaaatcaaatattttaagccaagactatacatgtttatggacttccaaattttttccatctagcattttaccaatctaattataagtctttattttgctaatactcacctgagcaagaggaatattaatttgacttcctgagactatgcgtttaactcacagtgaagagagcacttgatttcag

SEQ ID NO: 60498 - DNA, 601 bp, Human
ttttgcatatgatgccaagtaatagataatgccagactgctccagctgaagaggctcaaagttccacccaccaacctctaccattgccacccctgaggagttccagggagtgctgtctttctatagctgtgtatttcctcagaaccagtactattcttttcaagtcatggctttccccgtttttttttggtctgcagctattctgcagggctaaggattgctagtcattaggtaatcatagaactgagaaccactattcttgtaagttagattaacaaaccagttcccactagatacttawtaacttattctccccacttattcatctgggatgcttcaacgagttactttgtttaatcccatcactatatacaagtgacagccaaacttctagatgaagggggcagctgatactgtgggacatctggaatgtacagctctgttcaagccccgaggaaaaatgacaatcctaccacaggagcattctttgtactttagggcaaatattcaggcccaggaacagaaggaaggaaaacaacgctttcttggttcactggctatgctaatctaccagaacctattaaataaagttaaactgaaa

SEQ ID NO: 60499 - DNA, 601 bp, Human
aataagacttctgaaataaactttagctcccagatttctgatgatgtaatgagagtttaatattgctcataatttaaatccatattttttctcaaaaggtaaaaaatttgggtagagaagattatctacttctcgacttgttcttaaagaatgaaactgccaaaaatgtctacaaagaaaaatatgtagtatgttctgctgaattcaagtagtcaaatattctgcatcaagtttcacaagcattttaccttataaaatggaaaatcagtctttacaagaaaggcataatgaaacctaaatrtaatatttattttgtcacgtagttaaaatactctttggacaacaaaccacgtgcttattgattaggactatccagttaatgcacttcaatttaaaatgccagtttcatgtggctactgatttactacagctactgatttactacaggatctgattccagattctctttgtatgtctaaagcatgaaatcatgaaaatgagatgggtagtcagtagtaaagcatcagttatccagcctggtgaggggatgaagtagccaacagtggtgacagacacataaaaggtggacaatgttcagacc

SEQ ID NO: 60500 - DNA, 601 bp, Human
gacaagaaatagcagtatctccacatgggcacagagagatgggaaactacgaggcacttcagggaaggttttatgaagtaaggtgatgtttacaactccaagggtaggcaggaaatttaaataaaacataactcctaatttaagaaatgcaactccatctaataagacttctgaaataaactttagctcccagatttctgatgatgtaatgagagtttaatattgctcataatttaaatccatattttttctcaaaaggtaaaaaatttgggtagagaagattatctacttctcgacttgytcttaaagaatgaaactgccaaaaatgtctacaaagaaaaatatgtagtatgttctgctgaattcaagtagtcaaatattctgcatcaagtttcacaagcattttaccttataaaatggaaaatcagtctttacaagaaaggcataatgaaacctaaatataatatttattttgtcacgtagttaaaatactctttggacaacaaaccacgtgcttattgattaggactatccagttaatgcacttcaatttaaaatgccagtttcatgtggctactgatttactacagctactgattta

SEQ ID NO: 60501 - DNA, 601 bp, Human
tacgggaaaggagtgagaagaggaggtaactggataaatgggaagctggggaaggggatgaacattaagctcctttgatttatatatttgatttatatagtgtgagagcctcatggcaccttagaagaaatgtaattaataaagtttgtccctatgaaagggcagataatttagaaactatccatgtccctttcataaaaattagactcttttaaagtactcctcactcctaatatgatgacttcgagaaaattatccaggaattacttttgtatgtggcaatcacctatttcaactcagkgaatcattaagtgaaataagagtcacatttcccctggcctaacagggagtcagagtaatttttcagcctgacttacttggttttgtttgcaatttttctacagagcaaaatattccaaaaatagaagagctcctccttctggtactatctatcaaaactgaaaagcaccaaacacccaaaaggttcctcctggaaccctgcaagcagtgaaaagaaaaacttagacccaaatgtcagtttgcttagatttcataaattatggcatctagatcagtactcactcagtactttttttttcta

SEQ ID NO: 60502 - DNA, 601 bp, Human
tttacttcgtgtgctagcacagccaccacgccagtccagcctctatcgtcttgcatttagattcctcacagcctcctaattttcctgcttccatctaccctactacacacataccactctcccgcagccagaaaaatctttgtaaaaatatgtaagatcctctttaaaatccatcagaataaacttacttgcatcctgttatattcagactaacattcaaactctcaccacactctaggatgccctgtataagctttgggcaagtcttgtcctccatctacactgggctccttttaaatawtctaatacaagaagctcacctcagtgtcttcactctggctcttccctctgcctagaagactcttccctcagttggctgctgcttctccaagctccacgcaagcatcacaatccgacccaaagcagctttttaattcttcattctatcatatcactgcatttggttgtcttctttgcactcattaccatatcaaattataattaatttgtttacttgtttatcgtgtatttctatcccttaggaaggcaggagttttgtgttttgttaatcactgttatcctcatatgtctagaaacagtg

SEQ ID NO: 60503 - DNA, 601 bp, Human
gaaaaaaaaatacaggacttttctgggtcacccatactcattactaaaaatttggtcaattaatctctaaaagttcataattaagtgttaacatttttagaagtatgctttatcaagctaagaaaactcttatttctaatttgttaatatgaatagcaaattttatagaaagccctttctggatccatgatgatcataaagtgcttcttaaatatgattatgtggtatcttatactaatagatttcctgtagttgagtcatccttgaatgacaataaacattacctagacatttttttttytttttttttgagacggaattttgctcatcgcccaagctgcagtgcagtggctcaatctgggctcaccgcaacctgtgcctcctgggttcaagcaattctcctgcctcagcctcccgagtagctgggattacaggcacatgccaccacacccagctagtttttgtattttcagtagagaccgggtttcactatgttggccaggctagtctgaaactcctgacctcaggtgatctgcctgcctcggcctcccaaagtgctaggattacaggcgtgagccaccatgcctagttatgtttttgt

SEQ ID NO: 60504 - DNA, 601 bp, Human
tggagaaaccctgtctctactaaaaaatacaaaattagacaggcatggtggcgcatgcctataatcccagctacttgggaggctgaggcaggtgaatcgcttgaacctgggaggcggaagttgcagtgagccgagatcccgccactgcaccgcagcctgggcagtaagagcaaaactctgtctcgtttctaagaggcaaaacaaaatccaaatgttaatggcagcattaaaaagaaacatcctggaaggacacatgaggaactagtaatacaacgttcactacagaggaaaactgggtgaygaaaaaacaggggtgggagggagactgatttttccaccgtataatcatggttgatttttcagttatgtacatgctactttatgtttttaagtaacttttttttttttttaaagggacagactctcactatgttgcccggtatggagtgcagtggctgttcacagatgtgatcactgcacactagcctggaatttctgggctcaagtgaccctcctgcctcaacctcccaagcagctgggactacaggtgaatgctgccacgtctggctagaaatacactttttgaaggcaaaaacagtca

SEQ ID NO: 60505 - DNA, 601 bp, Human
acaggttatcaaacttgaaattcagagttccctccaccatagtgtttcatacatattacgatacagacagacacacgcacatgcctatgtatgaatgggaagaaagaattatcctattatgaaaaagcagttgcttaagaatggaagaatactacagtttgggttcaaaaagacttctctttagctattcctggttacctagagaagcaaaagggtatgaacatgaggttagaaataaaagatgacagtttttttaatgacaactgctctattccaagacagtctgcataaagttactaaytactctgatgtttaaaagtctgtaagaggtggccgggcatggtggctcatgcctgtaatcccagcactttgggaggccgaggcgggcgggtcacctgaggtcaggagttcgaaaccagcctgaccaacatggagaaaccctgtctctactaaaaaatacaaaattagacaggcatggtggcgcatgcctataatcccagctacttgggaggctgaggcaggtgaatcgcttgaacctgggaggcggaagttgcagtgagccgagatcccgccactgcaccgcagcctgggcagtaagagc

SEQ ID NO: 60506 - DNA, 601 bp, Human
tgaatatttccaataaatcatattcctagctataatgttttatagcttatgaagctcatttacattatttcaatggacccaaaagtcatactgtgaaagtactcagatagcactactgcctttcacagctgtgaacagtaaaaaaagtacagtcatattccctaggatctacattcatcaatactaaagaagctgacacaaaaacaggttatcaaacttgaaattcagagttccctccaccatagtgtttcatacatattacgatacagacagacacacgcacatgcctatgtatgaatgrgaagaaagaattatcctattatgaaaaagcagttgcttaagaatggaagaatactacagtttgggttcaaaaagacttctctttagctattcctggttacctagagaagcaaaagggtatgaacatgaggttagaaataaaagatgacagtttttttaatgacaactgctctattccaagacagtctgcataaagttactaattactctgatgtttaaaagtctgtaagaggtggccgggcatggtggctcatgcctgtaatcccagcactttgggaggccgaggcgggcgggtcacctg

SEQ ID NO: 60507 - DNA, 601 bp, Human
gtgctttcacatttataaactgtatatgacaaactggatgataaggctgataaaaggtccctattccccataacctcaaagttctaattcatatttataaagttttattgctctgactttatcaacaaattttatacatttaataaactaaattatacatcatgcaatgttgcctggcaaaaactttttctaagcagagacaatacattttaatgtctacaatttaatgtgagttctcctgaaaaacaaaaatagagaacgaagacctagaatatctgaatatttccaataaatcatattsctagctataatgttttatagcttatgaagctcatttacattatttcaatggacccaaaagtcatactgtgaaagtactcagatagcactactgcctttcacagctgtgaacagtaaaaaaagtacagtcatattccctaggatctacattcatcaatactaaagaagctgacacaaaaacaggttatcaaacttgaaattcagagttccctccaccatagtgtttcatacatattacgatacagacagacacacgcacatgcctatgtatgaatgggaagaaagaattatcctattatga

SEQ ID NO: 60508 - DNA, 601 bp, Human
atccagatgaactaaaactgcagcaaagcagctttctaggtgaactgacaaatgcctatcacttcctcccctggagtcacgtgtagattctaggtgcaggctaaaggcttggtctgagaaaagaagctctgaggaataaaacagtagaacttttgacagtcacatgagtattccccctcaagacgcttatcagatcttaaagctgaggctaaagagctcatactttcaaagtcacctcatacttcgaaaaagtagaagtgaatctcccagtgtttcaggggttaggtgacagtctaacaarctttcaatcaaaatccctggagcgctgtttgcaggaaaggtataatccagtggcagactaaaccaaattaaaatggcagtctagccccacccagctcaatcgctaattagattaaggggagcttctctctatctacctggtaaaggtaggaaaggtcaaatactctggggagagcattatttgcaagatctttatgagtgaattttacataatgtacaaaacatatggcatacaataaaagctgtatgacatgaaaatgcaggaaaatttgagaaagaaaagaatggacaataacagaag

SEQ ID NO: 60509 - DNA, 601 bp, Human
gtttagataacatgttaaaatgtttaggcaaatgtttaagcacatagattaatgttttatacctgtggatgcaaattatataaggcatcatataaaaattacaggaaaacccttttaaattacttaacttcattataaatttgtgttcagtatctctcaatgtccctatcatcctaaacataaatataaaaccttctttcattgcccccaaaccccgttgtcctagcaaatttcagagaaactatatctatatctatccatctatctatctatctatctatctatctatctatctatctatctatctaaccataaagataagcaaagttctaaaagacaaaaggctggggtgaaggagttagtgagaagtctccttatatatttcagttctaatttaagtattattagtgatcacagtttcataagagcaccaagaccatttcatagcgcttcccatcataacccaaagtcagagttaaaagttggattttgagagtaaagactaacctaccgcttcaaggaaaacgatgatgataatagaagaaaactgtagttgtaacatttctttgaaaataaagcatcactggctaatttaaccagt

SEQ ID NO: 60510 - DNA, 601 bp, Human
tcaagtgacccacctgcctcagcctcccaaagtgctgggattaaaggcatgagccaccgtgtctggccaatatatactgtttttaacaattaaaaagaaaaatagtaacataaatgacaaaataaatataaaatataagtacatgttattctaatcttaaaataagtgcataaaatctggaatacatggttggtctctgtatatgtgggctccacatccatggacagaaaatactagaggaaaaactagataaaataacaatacaacaatgaagaatacaggctgggcatggtgactcacrcttgtaatcccagcactttgggaggctgaggcaggcagatcgcttgagcccaggagttcgagatcagactaggcaacatgatgaaaccctgtctctaccaaaaatacaaaaattagcctagcatggtggcacacaattgtaatcccaggtattcaagaggctgaggtgggaggatcaccggagcccaggaagcagaggttgcagtaagccaacactgcactactgcactccagcctggacgacagagccagacgctgtctccccactgcctccaaaacaaagtatatggtgggggatgta

SEQ ID NO: 60511 - DNA, 601 bp, Human
ctcctatcactgctctctcaagtcatttttggaccaacttggaagcctgccatgctctactcagacagcatcattatgtgagtaataaaccttttcatgccctcttggtgcatgtaatataagtgacatcatcagtttcacttcaaaatcaaattttatatataaaatcccatcccacatatagttcacacttattaagcaccaactatgtaccaagctcttacacatattaaaccgcttaatccttcaacagtgccatgaatcaggcactgttgtccccatttgacaaatgaggtaatgraaacacaaagtaacacgtctaaggtcctacagccagcaagtggaagagacagaggccacatttttaattattaacattattccgccccatatatagttactaaaaagaaacaagtaatataaacatagcaaatcaaagctaaaacaataaaactggtataatatcccaggtatgtaaaacatttacacaacatgtttaattataaaaactgaagatttcactgtaagagacattttctcaggaaagaaaatttctttggacaagtaaattgagaaagccccttccaaattaaaataagca

SEQ ID NO: 60512 - DNA, 601 bp, Human
caagccccaccatttcctcttccccttctgcctcgaatctgggcaagctggtaagaaagcccaggtgctccacctgttgatattagagaaatttcaaaccaggcaagtctcagcatatgtacagtgtaaaaaccagcccacagccccattccctaatcaccataaaaccccaagccagtctcctatcactgctctctcaagtcatttttggaccaacttggaagcctgccatgctctactcagacagcatcattatgtgagtaataaaccttttcatgccctcttggtgcatgtaatatargtgacatcatcagtttcacttcaaaatcaaattttatatataaaatcccatcccacatatagttcacacttattaagcaccaactatgtaccaagctcttacacatattaaaccgcttaatccttcaacagtgccatgaatcaggcactgttgtccccatttgacaaatgaggtaatggaaacacaaagtaacacgtctaaggtcctacagccagcaagtggaagagacagaggccacatttttaattattaacattattccgccccatatatagttactaaaaagaaacaagtaatata

SEQ ID NO: 60513 - DNA, 601 bp, Human
tctataaatatcacgtaggtagttaataatgtaacttaataatgtaacttaaaacttctatgtctttactgatttttttgttctaattgaactctccaattgtggatttgtgattctgtcccattaattctacccagttttgctgcatgtatttttaagttcctttattaagcagatacaatttattgttatgactccctgatgttggtgatttagatatatcactttacaatcttctctgttgctgatcacctgtcatttgtatgctgcgtgccatttttcaccagctgctttaagattycctctttcatgagtttgaccatgatatatctaagtgtggttttctttttatttatcctgtttgtgttgaataagaaatccaactccatttctgatacttgactgctgataggtttcaagccccaccatttcctcttccccttctgcctcgaatctgggcaagctggtaagaaagcccaggtgctccacctgttgatattagagaaatttcaaaccaggcaagtctcagcatatgtacagtgtaaaaaccagcccacagccccattccctaatcaccataaaaccccaagccagtctccta

SEQ ID NO: 60514 - DNA, 601 bp, Human
taaggacacaagagtagacatccctgtcttgttcttgagggaaaacacagtatttcatgattaagtaaatccttagctgttagtgtttcttaaataccttttatcagactgagaaagtctctttgtttctcatttgctgggaatgcttatcatgaatggatgatgaattttgtcaaatgcttttgaccaagtgaggtgatcttatagtttccctccttggttaatgcagtaaattacatagtttttttgtttgtttgtttgttttgcccgacagggtcttgctctgtcacccaaactggartgtggtggcgtgatcactgctcactgcaggttcaacttcctgggtccaagtaaccctcccacctcagccttccaaataactgaaaccacaggaatgtactaccacgcttggctttttttttttttttttttttttttttggggagacagagtcttatgttgcctaggctggtttcaaactccttaactctcaagcaatcctactgcgttggcctcccaaagtgctgggattagaggcataagccatcgcatctgacctgattaatttttcttttttcgggggtgggggacaaggtcccaa

SEQ ID NO: 60515 - DNA, 601 bp, Human
aaatgttttgcaaatattttctcccactctgacttattttttaacaatgtattttaataatatgttttgtataccaatggagtctaacttagcagctttcatggtcactgctttctatatactttgaacaattctctgtttacccccaagtcataaatattctcctatattttcttataaaagctttatagttttagctttaattagactacaatttatccagaaatattttgttttcactggtgtaaggtggagtcatgttcattcttccacatggatattcagctgttccagcaccatytgttgaaagactttcctttccctactgggttgctttggcaactttgttgaaaatcatataggcacacagtgtttatctatgtggggctatcttatctgtttttatgtcagtatcacactatacagattactatggcttcaaggtgagtcttgaagtcagggtaatttaagtactctaacttattactgagttttccaattcacaagtgtatccatcagtttactgcatggtaattccaacatgtaggtcttctagggttggtctcctcattataaagggtcacattttctttgttctttg

SEQ ID NO: 60516 - DNA, 601 bp, Human
attcttatactgatagacacctgacctgttgccaggttttaattattgtgaataaagttgtcatgaacattcaagaaagtacatatcattatatagaaatatgatttctttttttctcgggtaaacacctagaagtgaaaatcttgagtcagtggatagatgcatgtttagcttttcaataaattgccagatcattttccagagtacgattttacagtcctccctctttcaatgtatgagagagagctcctggttattccaaagcctcatcaacatttggtgtggtcagtctttaaattayaggtagtctgatgattgtgcagtggtatttcattgtggtttcaattgtcattttcctgaagcctaccgatattacacatttttccatttctttactggacctttatcttcagtgaagtagccaactactgtccattttaaaattaggctatctttacattactgagttatagaaatctttataaattctagattcaatcctttcagaaatgttttgcaaatattttctcccactctgacttattttttaacaatgtattttaataatatgttttgtataccaatggagtctaacttagca

SEQ ID NO: 60517 - DNA, 601 bp, Human
tggagaggaatatctcagaaaagaaaaactcaacagtttctaagtatttattccaacttctcagatacttccatgaacaagctttccatcttctcctgagttctgtatgataaaaaatttcaaacatccattaaagttacgagtaagcaccctacacattgatcagctaaattctgtaatttggatttgttttcttttgctctctcatgtatctacttaacctctctatccatcccttactttttggaacattaaaaataagggtgtatgtgggcagcctgggcaacatggtgaaaccccrtctctatcaaaaatacaaaatattagctgggtgtgctggtgcacacctatgctcctagtattcaggaggccgagacttgagcccagtaggtggaggctgcagtgagactgcaccactgcactcactccatcttgaatgacagagctagaccctgtctcagagagaaaaataaaagctgcagataacacaaatctagacacttaagaatgcacataactagagttcgctgttctttttttctttaggttaaatttacacagcatgaaacacacatcttaatggtaccatttgagttttctc

SEQ ID NO: 60518 - DNA, 601 bp, Human
tcggtaacatagtaagtccaaataatgtccagatatgtgaggaatagctttattccaaggtctttgatgctcatgtaataagtacaattttaacaactaattctattacaaaagactgcagaaagctctgtacagctggatccctatacgttcttaagaatcaagcaaacagcctgtgcaacaaagtgagaccccatctctacaaaataattaaaaaattagccaggcatggtggcatgtgcctgcagtcccagctatttgggaggctgaggcaggaggatagtttgagttcaggagtttsaggccacagtgagctatgacgcactactgcactccagcctgggtaaccgtgagatcccatcttaaaaaacaaaacaaaacgaaagaatcaagcaaacttttggagaggaatatctcagaaaagaaaaactcaacagtttctaagtatttattccaacttctcagatacttccatgaacaagctttccatcttctcctgagttctgtatgataaaaaatttcaaacatccattaaagttacgagtaagcaccctacacattgatcagctaaattctgtaatttggatttgttttcttttgc

SEQ ID NO: 60519 - DNA, 601 bp, Human
ggcagtaattaaatctggagacagtttaacagggtccttaactggcttaaaccttcactctgtgtagaaaatgtttttcgattttatcttgtagcaatgaaatagtaaccattcaaaaacaaacagtcaccaaatgtgcattccggtatgtcagggtttcattctaagtttcaaatcagaacagagcatgtctacattccagatacccaagctgtacagagctctaagtagagctcaccacacaatggtgtggtactgttatttgtataattttataagaacacacatgaaacagaatttwaaaaaataaactaataccaagtcttcctaatcggtaacatagtaagtccaaataatgtccagatatgtgaggaatagctttattccaaggtctttgatgctcatgtaataagtacaattttaacaactaattctattacaaaagactgcagaaagctctgtacagctggatccctatacgttcttaagaatcaagcaaacagcctgtgcaacaaagtgagaccccatctctacaaaataattaaaaaattagccaggcatggtggcatgtgcctgcagtcccagctatttgggaggctga

SEQ ID NO: 60520 - DNA, 601 bp, Human
aattctggaggtgactgaagagtcagaaaaggaactagtgtgaagaatgataaataccaacaatgatgtgatagtaacttcctcagactactgcaactctttacccagttgtgactgttttgagaactgaggtatatttatgtagttcacaaataaatgtggatggtgatgaatatgatgagatgaaatgaacaaataccatatacgcaaaaaagaaaatgaagtgattaaaaaaagtaacataaaaatgagttaacctactgttaattgtgatataaggggttcattaagtatgtattttattagtataaagatgagattctgataacaagaaatttagcaaaactcatcatgtatctacttaaaaattaggccaacaacagattataatctgatctcaagctaaaataaatatatagttatcaaaattattattctttaggggatacagtaatttaaagaagattcaaactagaattgcattgattaaaacatcagctgaaacatttaatatattttttatactggcaagcagatattttaaatgctatgccttattttacattaaggaaacatcctaggcaaaattatactaagcaac

SEQ ID NO: 60521 - DNA, 601 bp, Human
aagaaaaaaacttgcaatattcctacctggtgtctcaactctctgatagtggtaagggtttacacatacttcatcctttttaagattaaaagcatattcgcagttttcaattgccttgagttcatgatgactgtgaagatcaggccagcgccataatcggcaatatataacatgtggcaatccttttcgatgggatacctggagacgaccatcaagagacctgttgggaagcaaggggaaaagaaaggagggaactttaaaaaaaaaaaaaaaaagtgcagtcaaatgggctaaattagtmcaataaaagcataaagaaaagaatgacagccatttagttagttttagtgagaatcaagaacaaaaatgtactatttaatggatctgataaaagtatgcagcagcactagcagatgtttcttataaatatgtcacataaatgactcaaatgccaatgaaaggctaacaacttgggaaaaactgattttttaaaaaagagagtttatgcagttatacttgaaaaactttgtcaacttctatgtttagtaaatcaaactcattttagagatgcttctaaggatattaattctggaggtgactg

SEQ ID NO: 60522 - DNA, 601 bp, Human
gaagttcaggcatttaattcaaaaccaagaaaaaaacttgcaatattcctacctggtgtctcaactctctgatagtggtaagggtttacacatacttcatcctttttaagattaaaagcatattcgcagttttcaattgccttgagttcatgatgactgtgaagatcaggccagcgccataatcggcaatatataacatgtggcaatccttttcgatgggatacctggagacgaccatcaagagacctgttgggaagcaaggggaaaagaaaggagggaactttaaaaaaaaaaaaaaaaagtgcagtcaaatgggctaaattagtacaataaaagcataaagaaaagaatgacagccatttagttagttttagtgagaatcaagaacaaaaatgtactatttaatggatctgataaaagtatgcagcagcactagcagatgtttcttataaatatgtcacataaatgactcaaatgccaatgaaaggctaacaacttgggaaaaactgattttttaaaaaagagagtttatgcagttatacttgaaaaactttgtcaacttctatgtttagtaaatcaaactcattttagagatgcttct

SEQ ID NO: 60523 - DNA, 601 bp, Human
aagaaatcgagacactacagcttaatcctcatcctaacatcatgctgtttctgctagggagaaaaatcaaccaaacaaaaaggaaaacatacaagaaaagtaacaaagtattagttgttctccaaaaaaaaaaaaaagaaaccataaaaaacgaaaaggccagatatcatatcgtggagtattactggatcacataatacatcagaacaaaatttgagaaccatgtagctgaattcaattttcatcagaaattactgagatgcagacgaaacataattaaaggaggttttctgacgttcgkgttataatatgtaagtgttgctatgtctatagaactaagtattatatttcttatagaaatgttatatttctgttaaatattaccaagttatctaagaaaaagtgatcattgggtggatattcagttacatgtgtttggggggtacttttctcctacaccatttgttttgcttacattctgcatctcgcttagcttcaacaactaagacaaacttactaagatcttttcttttctgcttctcacagtactttgattaaagtcactgcaaaagaaaatgaaatataaagtaaaactcttctc

SEQ ID NO: 60524 - DNA, 601 bp, Human
gcgcggtggcttatgcctgtaatcccagcactttgggaggccgaggcaggcagatcacctgaggtggggagttcgagaccagcctgacaaacatggagaaaccccatctctactaaaaacacaaaattagccgggcatggtggtgcatccctataattccagttactagggaggctgaggcaggagaatcatttgaacccaggaggtggaggctgcggtgagccgagatcacaccattgtactccagcctgggcaacaagagcaaaacaccgtctcaaaaaaaaaaaaaaaaaaaaaaaaggaggaagagaagatacaggttaagggtctccttcaataaccttttacaatatctattcaataaactaaccacaaactttaagtatcaaacttttcatttaagtgtcagtacccccaaatttttaaaacaaaaattctaagaataaattatcttcatatactcaaagaacataaaaataagggtacatattatgcatattttaaaagttaaagctaataaagttaaacggcgctaagctttttgagtttaacctgtatttcaaagatctaatcagaaagaaatgctgaaccttaaaatacg

SEQ ID NO: 60525 - DNA, 601 bp, Human
gaataaactgcatgtaaaataaaaacatgtatacaatttaatcaactgtaattccagggaggaaaaataagttcagaagactttcatcagttttacatttacactgaacagttttgagcgattcaagataacaaagacacatatccaaacaattttaaaattatcaaaagaacgaggccaggcgcggtggcttatgcctgtaatcccagcactttgggaggccgaggcaggcagatcacctgaggtggggagttcgagaccagcctgacaaacatggagaaaccccatctctactaaaaayacaaaattagccgggcatggtggtgcatccctataattccagttactagggaggctgaggcaggagaatcatttgaacccaggaggtggaggctgcggtgagccgagatcacaccattgtactccagcctgggcaacaagagcaaaacaccgtctcaaaaaaaaaaaaaaaaaaaaaaaaagaggaagagaagatacaggttaagggtctccttcaataaccttttacaatatctattcaataaactaaccacaaactttaagtatcaaacttttcatttaagtgtcagtacccccaaat

SEQ ID NO: 60526 - DNA, 601 bp, Human
tccaacatgttgtctgaataaaacacttatgttcagaaaggtatctgaatagctgaataaactgcatgtaaaataaaaacatgtatacaatttaatcaactgtaattccagggaggaaaaataagttcagaagactttcatcagttttacatttacactgaacagttttgagcgattcaagataacaaagacacatatccaaacaattttaaaattatcaaaagaacgaggccaggcgcggtggcttatgcctgtaatcccagcactttgggaggccgaggcaggcagatcacctgaggtkgggagttcgagaccagcctgacaaacatggagaaaccccatctctactaaaaacacaaaattagccgggcatggtggtgcatccctataattccagttactagggaggctgaggcaggagaatcatttgaacccaggaggtggaggctgcggtgagccgagatcacaccattgtactccagcctgggcaacaagagcaaaacaccgtctcaaaaaaaaaaaaaaaaaaaaaaaaagaggaagagaagatacaggttaagggtctccttcaataaccttttacaatatctattcaataaac

SEQ ID NO: 60527 - DNA, 601 bp, Human
gtgatttcactggtagtttattagttctgctgagttatacattttattacgtaagacgtgatttaaagctttaatttttttcttcatcactttttggagttgatagctaagcataagaaattaatctactataattcaaaactcactattaggttaaaaaagcagtgaaaagctgatccccatccttcacccccaaattcctctgaaaatctgttatttgagtaattatggttttttatcacagagagatacttagtcatagggttactaaaattttcaacagaagcaaatacttaaaaagaaataaaagtatgtgcatgttttcaaattttcatttactctaataaaaaataacaattattctgcagagtagcatacgttataatttttcagtgacaacatggacctctttggtagttcagatatgttaaatcaagatagaagatcatcttttttggtatgcgtctcaacttctctaaatttaagagtaacatcttttgtgaatttcaaacaatacaagaaatgtatatctaataactgaggaattttcaaagacattttttttacctgtgtccatactttgattcaactgttggtcact

SEQ ID NO: 60528 - DNA, 601 bp, Human
taacatactgctttcaaggtccatccatgttgccacacgtcatgctatactgtcattcctttacatggttgaataattccattgcagaaacatacctcattttattcatccattcatcatttgatggacatctgagttgtttctaactttgaatattaagaataatgcctgcataaatggtcatgtacaagtttttgagtagacatgttttcagttcacttggatacatagctggccacaatatgttaactctgtatttaactttttgaggaacaggaaacttttccaaagtgttgaaccrtttaacattcctactagcgatatatgaggactccaatttctccacatcctcaccaacatttgttattgtccttttttgattatagcatctagtaggtgtgaggtagtatctcactgtggtttatgacgttcagtatcttttcccatcattcacttttaaatgtcacagtaacagctgtccatcacaggcaaaaaagaatattattgcttcaagaagagtgtcatctaattttagtaaaacatatgtggaaagtcaaatattatttgcattaagatgtataacacgttatttccaacgttc

SEQ ID NO: 60529 - DNA, 601 bp, Human
gttacctagctagcatatgtaagaggaacatttcaaactcagatagtctagctcagagtctcactatgctattttgattatatgcatttagttaagaggattaagtcttgtaagtggagtgtatgggaaaactgtctaggagtacaaaaaactagtagtttacaagaagaaaaaattaaaatgtattttctatttatttaatctcatccttcaatttctaatttttgtatatatttttaaatgtacttgaagtacctgtatataacttacaaataattaagtgtacatattagtaggataytctcaaaatcttaatactcactgtattagcttcctagggcttgctctaacaaaataccacaaactgggtggcttaaaacaacagaaatttattttttcagagctttgaaggacctaagtcccaagacaaggtgtcagcaaagccatgctctctcaaaggctcaaggggagaatctgttccatgcctttctcttaagcttttgggtttcccaacaatcctaggaattgctcagcttgcaggtgctaactccagttacctgcctccatcttcatatagcacattcctccctatcttataaag

SEQ ID NO: 60530 - DNA, 601 bp, Human
attcttcactttccttcacatctttgtgcaatccactatcttcctttttcttaatggttaactcctcttaacattttaactaccttcatacagtgcttattacaggttagaacacatagatgccttataaatatcagtcctattaatactctatgagttaaatgctattattgtccctattttacagatttaaaaactaggttacctagctagcatatgtaagaggaacatttcaaactcagatagtctagctcagagtctcactatgctattttgattatatgcatttagttaagaggaktaagtcttgtaagtggagtgtatgggaaaactgtctaggagtacaaaaaactagtagtttacaagaagaaaaaattaaaatgtattttctatttatttaatctcatccttcaatttctaatttttgtatatatttttaaatgtacttgaagtacctgtatataacttacaaataattaagtgtacatattagtaggatactctcaaaatcttaatactcactgtattagcttcctagggcttgctctaacaaaataccacaaactgggtggcttaaaacaacagaaatttattttttcag

SEQ ID NO: 60531 - DNA, 601 bp, Human
attaacatcatacttaaagggggaattgtgaaatgtgttcttcctataatcagaacaatgcaaaaatgtccattcttatagcttcaacagtttattgtaggtcttagttaggacagaaaaagaaaaaagcatgaagactggggaaaaaaagaaaaactgtcagccgggcacagtggctcacggctgtaatcccagcactttgggaggccgaggcgggtggatcacctgaggttgggagttcgagaccagcctgaccaacgtggagaaactccgtctctactaaaatacgaaaaataagctrggcgtggtagtgcatgcctgtaaacccagctactcaggaggttcaggttacagtgagctgagatcatgccattgcactctagcctgggcaacaagagtgaaactccttctcaaaaaacaatcaaacaaaaaaaaactgtccttatcaacagatgacatggctgtgtatgcagaaaacctcaagaatctacagaattctagaaccaaaaagtcaatttaacaagaatgcaggagaaaagaatatacaaaaatcaagtatttcccatatcctaggaacaactggaaaataaaatgtaaaaac

SEQ ID NO: 60532 - DNA, 601 bp, Human
gaccagattaaatgaaaagtaagcagacaaaaagatgaatacaaacaaaacagaaaagagacaaagacaacaaagactactgattaatccattacaagacattctaataaaaaattaaaaagtcaaattactaacattataaattttaaaatggatctcacatatatgaaaggaataacaaatatcagaaataactttatatcaatacattctccagccttggcaacctggtgaaatcctatctctaaataaaacacaaaaattagccaggtgcagtagcatgtacctgtggtcccagctyctcgagaggctaaagtggggaagattgcctgagcctgggaggttgaggctgccgtgagccaaccaggccactgcactccagcctgggcaacgaagtgagatcctgtctcaattaatcaatcctatgacttaaatgaaatgaacacatttctaacaaaatccaagtttatcaaacacatacacaaaattaaaaatgtaaataattctcaatttaaaaaaccttttcctacaagagatggtttctctggaaaaatcaaactttgttttgaatacaaggtctcgctgttgcccaggctggagt

SEQ ID NO: 60533 - DNA, 601 bp, Human
acactatagtatatacattctttccaactatatatggaactcttatcaagataagttacaagttatagcataaaataattttcataaatttccaaggactaaagtcacacacactatatgctggactgttaacagaattaaattagaaattgatgaagtatctagaaaatcctcacactcctaagaaaaacccaaacttctaaataactcatgaatcaagaagaattagaaaataagtgataatttaaaaacaacataaaatttgtaatatagagctaacataaagcttagagggaaattyatagctttaaatgtgtacattataaacaaatcaatgatctaaatgtacaccacaggaggctagaaaagaccagattaaatgaaaagtaagcagacaaaaagatgaatacaaacaaaacagaaaagagacaaagacaacaaagactactgattaatccattacaagacattctaataaaaaattaaaaagtcaaattactaacattataaattttaaaatggatctcacatatatgaaaggaataacaaatatcagaaataactttatatcaatacattctccagccttggcaacctggtg

SEQ ID NO: 60534 - DNA, 601 bp, Human
tcacaatagcaaagatacagaagacaacccaagtgtcccatcaacagatgaataaataaagaaatggagggttatacacacaattgaatgttatcctgccttaaaaagggagatcctaccacttttggcatggatgaatctggaagacattatgccaaggaaattaggtggacatagaaagacacatggcataatctcatatgtggggttttttttttttaagccaaatacatagaaacataataaaatggtgattacaggttggggggaaaatagggagattataggtcaaagggtatamagttgcagatatgtaagatatgcccagagatctaatgtacaacctgaggactacagttacaatattgtgttgtatactggaaatttagtaagtcaattttaggtgctcttatcacacacataaaaaggtgactatgtgagatgatggatttagttgactacagcaaccatttcactacatacaccaaatatcatgttatataccttaaacatatacaataaaaatgtatgctttaaaaagtctaatttactgaatacagactaaagtgttcacaaaccttccagaaaactgggaatcatc

SEQ ID NO: 60535 - DNA, 601 bp, Human
aactttctgctgaaaaagctgattgtctaatgaagactcccttgttatgtggcacgttgcttttactcttgctgcttttattcacaatagcaaagatacagaagacaacccaagtgtcccatcaacagatgaataaataaagaaatggagggttatacacacaattgaatgttatcctgccttaaaaagggagatcctaccacttttggcatggatgaatctggaagacattatgccaaggaaattaggtggacatagaaagacacatggcataatctcatatgtggggttttttttttttaagccaaatacatagaaacataataaaatggtgattacaggttggggggaaaatagggagattataggtcaaagggtatacagttgcagatatgtaagatatgcccagagatctaatgtacaacctgaggactacagttacaatattgtgttgtatactggaaatttagtaagtcaattttaggtgctcttatcacacacataaaaaggtgactatgtgagatgatggatttagttgactacagcaaccatttcactacatacaccaaatatcatgttatataccttaaacatatacaat

SEQ ID NO: 60536 - DNA, 601 bp, Human
ccaaagtggctataccatttttcattctgaccagtaataaatgagtgtgcctgttgctccccatcctcaccacaccagcactgatgaactccctcagcttttgtctgaaaaattttttatttctccttcatttctgaaggacagctttactggttatagtattcttggttggcaggggtacttttttctttttttcagatggggtctcactctgtcacccaggttggagggcagtgtcacaatcttggctcactacaacctccacctcctaggctcaagcaattttctcaccttggcctcstgagtagctgggaccacaggtgtgtaccaacacacccggctaatttcagttttgttttttaattctttcagcactttaaatacaccacccatctctcctggcctgcaaactttctgctgaaaaagctgattgtctaatgaagactcccttgttatgtggcacgttgcttttactcttgctgcttttattcacaatagcaaagatacagaagacaacccaagtgtcccatcaacagatgaataaataaagaaatggagggttatacacacaattgaatgttatcctgccttaaaaagggag

SEQ ID NO: 60537 - DNA, 601 bp, Human
tattcatatcttttaactgtttactcctctattaaatacttagaaatgaccagtaggatcatttaaattaacaggcgttcagtcagatgtgacaggttagaattacagattacaaaaaagacaaattttaaaaacttaaaataagctaacaattaatagaagcctttaaaaaaaaaaaaaccagaggcaacgaactgatgattagcctatgaattattcatacataaatgctgctattggagtctcacctaccacaggtcttccacttagaatattataaatatcctatttgagatccagygtgaattagcagtgtctacttacagctaaaccatctacagaaatccctgtgcatgtatcttcgcatacaaattcacatatatttgtaggatacattcgtcaaacctttgacaaattaacaaatgtcaaataaaatgtgttaaacttttataagtgccaaaataccctctcaaaaatgtttcatctcactaagaatttataagctagtgtttcttcacaccgtgtcactacatgttgacatctgccaatatgataggtttaaaaggagcaattttttaatttcttgtttttgttgtaaaca

SEQ ID NO: 60538 - DNA, 601 bp, Human
ataaaggtgaaatggtagcccctagataaataaatgaatcagagaagggatgcttagtttttagaagacagtacggtcttccacaacataattaagttatgttccttttttctcagtttgaaaaatctgctggcaagtcacaaatctgctggcaagtcacaaatctgctggcaagtcacaacaggtacaactaagataggtcaaaacatatttggaacaatgagctaaaattcactgctgtttcctgaaaccaacataaaataaacaaagccactattagaaatggaggaaactgcccaaytattcatatcttttaactgtttactcctctattaaatacttagaaatgaccagtaggatcatttaaattaacaggcgttcagtcagatgtgacaggttagaattacagattacaaaaaagacaaattttaaaaacttaaaataagctaacaattaatagaagcctttaaaaaaaaaaaaaccagaggcaacgaactgatgattagcctatgaattattcatacataaatgctgctattggagtctcacctaccacaggtcttccacttagaatattataaatatcctatttgagatccag

SEQ ID NO: 60539 - DNA, 601 bp, Human
tttgatagatttgggtaaaattatcattcatcaaggttgtaccagtttacattcccagtcacaacatagtaaagggatgcttgaggtgttattgcttctagatgaaaacatggtcacaagtacagttttaattttgagtagctttacacatgtttatattatatttccttcctgtgatagtctgttcttttcttttgcgatgttgatcattttcttactgattgtttgaaagctctttatgtgtattagggatgtaagtcttcttatggtatgagctacaaatatttaatcattggtcttwtgactcttaatcctaattttgatcatgtagcactaaaataaaagcccttctacaagatttatcaatcatctttgggttagcgtcacactttgggataaaacagtgatgacggtggatatcttactcttgacttttagggtaatgtttctaccattttcccattaagcatggcattggctttcaggctaacagtaataaaatatttatttaggatttttgcatcaatagtctcaagcaatacaagcctgaagatttacatgagtgctatgtttgtaaggctctgtggtcaatgttatgaca

SEQ ID NO: 60540 - DNA, 601 bp, Human
cagttttggcttctagcccaacagttcatcttcccaaagatatctaatattgacggttccttgggtatctttccaaaatactctatgaaccacataagcaaatacatttttgttctgtgtcctttcttttcatatacaagtggtaaccgtttttcatcttctatattattctatcagattgttcacaatgtgtttccttatttgtctatctacatatcaattagtcacataacatcgcgatcccatattgatggatattcaagctattttcaatcttttgctataagaaccaatgctttgmgattgcaataactaatcttgaccgttttgcacgcttccaatcacatctgaaagatacattcttcaagaaactgccaggtcgaaaggtttgtgtatttgcaattttgatagatttgggtaaaattatcattcatcaaggttgtaccagtttacattcccagtcacaacatagtaaagggatgcttgaggtgttattgcttctagatgaaaacatggtcacaagtacagttttaattttgagtagctttacacatgtttatattatatttccttcctgtgatagtctgttcttttcttttgc

SEQ ID NO: 60541 - DNA, 601 bp, Human
atttttattattaagtaggtgatacagtataaaaatgatgaggggaacatatgtgcaacttacccaagctatgattaacaggggaaagagtagtaggagatagttctgctggagagcctaaaacaaaaggatttaaaaataaatgaagtatttccagaacttctgatcaagtaatcataaaactagctttatctggttataattatcaacaataatacaaagataatttaaataccaagaattcagaatatgtaagtgcttaaatttagtttaatttgtggggggtcgggggaagagaagsgggggttccagtataaaaggtgcaacagttttggcttctagcccaacagttcatcttcccaaagatatctaatattgacggttccttgggtatctttccaaaatactctatgaaccacataagcaaatacatttttgttctgtgtcctttcttttcatatacaagtggtaaccgtttttcatcttctatattattctatcagattgttcacaatgtgtttccttatttgtctatctacatatcaattagtcacataacatcgcgatcccatattgatggatattcaagctattttcaatc

SEQ ID NO: 60542 - DNA, 601 bp, Human
aagaaaaacagtaataataaaaggatacaaaatatgacatatttttgacatttgtctattttaacatcaaactcttggtgagataccctagctacaaaaagagaaaacccactcatacataagaaccagaaagcagtaacacacaaagatcatgcaagtagaaacagaccatagagtcaaaagactacttatttcactggaaaactatatatttagcttctgcagtttgactaaaacatatcataaggaatactgcaaaagaaaaaaacctcacaattttgtagaataaattccaaacatrtaacaaccgaagagaaattgtgaaatagggtaaaatgagggcaaaaataataatagtaatacagaaatgtatgtatatatatatatatagtcatcccttggcatttacaggggattggttctaggaccggctccccctaactaaaaacccttagatgttcaagtccctgacataaaagggtgtagtatttccatgtaacttaaattcacgtcatcctgtatactttaaataatctctagattacttataatacctaataatataaatgctatacaaatatttgttatactgtattttaaa

SEQ ID NO: 60543 - DNA, 601 bp, Human
aaaacccattaaatttttttgcagaaccccaattaagtcacaaaaacaaaaaactattttagttaaagcacctacagcgacactgggtatcttaataagattatccaaatttatacatcaagcaagatttgagaacttccacttggaaccaagtaatagatcttctagtcactatcattttgcagtatcaaaatcacactttgataaccagcattacttctcacaagaggtaatggttaattagaaaaaaaacagaagcaaactactgttaaaagaagttactttaaggtgatgagaatgmtgttcaattatgaatggttctcacactttttcacttcatcgttaaggaaatactgaggaccccaaagagcttttgtttatgtgaatattatggaaaatgaccatattagatataaaaactgagatttaaaaaattcatttaaaaatcaaatccattacatattaacaatgtttataaaaaacaactgtatttccaaagcaaaaaaaaaaaaatagagtggcaacatttcaccatttttgtctatgaaaaacaactatatttccaaagcaaaaaaaaaatagagtggcaacatttcaacat

SEQ ID NO: 60544 - DNA, 601 bp, Human
agaaataaaaaatttaaaaaaatccaataacgacagcaatctaaaactttggagggagaagagaataaggcagagaaaacccattaaatttttttgcagaaccccaattaagtcacaaaaacaaaaaactattttagttaaagcacctacagcgacactgggtatcttaataagattatccaaatttatacatcaagcaagatttgagaacttccacttggaaccaagtaatagatcttctagtcactatcattttgcagtatcaaaatcacactttgataaccagcattacttctcacargaggtaatggttaattagaaaaaaaacagaagcaaactactgttaaaagaagttactttaaggtgatgagaatgctgttcaattatgaatggttctcacactttttcacttcatcgttaaggaaatactgaggaccccaaagagcttttgtttatgtgaatattatggaaaatgaccatattagatataaaaactgagatttaaaaaattcatttaaaaatcaaatccattacatattaacaatgtttataaaaaacaactgtatttccaaagcaaaaaaaaaaaaatagagtggcaaca

SEQ ID NO: 60545 - DNA, 601 bp, Human
gaatgaagttcctcctcttaacctacatctagtttgtctcaatttaattgtccagccttatttttctattctccaaactgaattgctatgctattgtcaagattatcacttcccaactctgcccaccccatttatgactattgaaatccaatgcaccttttacaactagatcatgtgccatcaagttttccttgagcaccgtgtgcaaacatctctccttccataaactgacataacccttcatatacaccccttttatgatatttaacactctgaattacgttaaaatgcacgcctgtgyatgttttaatatcttccataatggcagctcagtaatttgcaacagttttgaatttggaggcctccaactttattttacataaagatcagctgactctataacctcattgaaaatagatacaaatgaactccagaatatgcaagaatgcaatgaaacataattacactgtggaaatttaagaaccaaatatgtatttcataccggtattctgctccccaccctttcacaaaactcattcttatggtgcacattctagttagctgatagacggcttcaaaaccctgattaacagactgagcc

SEQ ID NO: 60546 - DNA, 601 bp, Human
ccaggaaagaagcatccccaggagcagccctcaaccaaggaaacagaaattgacatttacatgcccagcacttctgttcccctgggtaggataattctgtagactgtttactgtttcctagagtttccccaagggtgtcagttctagtgacccacccactctggtagatggcttaacaatggtcctggctgccctgttctcccctgtcccacttccctttctagaataatccataatccaggtcacccaaggggagtaggtttaagaaggctgccactcgattaaatacaaattcttcatrcatctaaatttcctgtttactacatttcctcatttttgtgctaacaaccaagatgacattaaggaaatttaaaaaaaatagttttagaaacctaaacattaggtctatttcctcagctccagaatgattacagacagtaagttcctggtagctacccacatatccacagatagatggatatttgccattttgatttgtaaatgttacaggaaactacttgattttccaaagtcagatgtacctgactcccaatactcataaaaacatactgcatattactgcttctgtaattacagattt

SEQ ID NO: 60547 - DNA, 601 bp, Human
gtcaaagtacttctgatgaccttgttttagaagtgatttacaagaacatctttttctcatcgcactaaaattaataaggtgatcttattattcaccatcatccaaaatggaacacctgagagagaatgtagatactattaatatcaggccagggccaggcgtggtggctcacacctgtaagcccagcactttgggaggccgaggcaggcggatcacaaggtcaagagattgagaccatcctggccaacatggtgaaaccccgtctctactaaaaatataaaaattagctgggcgtggtggygtgtgcctgtagtcccagctactcgggaggctgagacaggagagtcacttgaacccaagaggcagaggctgcagtgagccgagatcatgccactgcactctagcctggcgacagagtgagactctgtctcggggtggggggcagaaaaaaatcaggccaaaaggagacacgtgaatcaggattgtccaagcaaaccaagacataaagtaactgtacttaccaaatcaaccacagaatagtagatactcaaatatcaaacagaatctaagtaaaagtataccaaagcaaaaacaaaatttt

SEQ ID NO: 60548 - DNA, 601 bp, Human
caatccagcaaggagtacttgttaccgtctgccttctgtttaaaagaatacaggaaaatgattatgaaattcaagtccacaggcagggaaaatggctatgtttaggtacactgcattaaaaatttacagaaattaaaaggttgtgtatataattttggacacgattattccgcaaaatggttgatcctcaaagtcaaagtacttctgatgaccttgttttagaagtgatttacaagaacatctttttctcatcgcactaaaattaataaggtgatcttattattcaccatcatccaaaatrgaacacctgagagagaatgtagatactattaatatcaggccagggccaggcgtggtggctcacacctgtaagcccagcactttgggaggccgaggcaggcggatcacaaggtcaagagattgagaccatcctggccaacatggtgaaaccccgtctctactaaaaatataaaaattagctgggcgtggtggtgtgtgcctgtagtcccagctactcgggaggctgagacaggagagtcacttgaacccaagaggcagaggctgcagtgagccgagatcatgccactgcactctagcctgg

SEQ ID NO: 60549 - DNA, 601 bp, Human
tatttggttcccaagacacttctctctggactaaagcttccacgtgttaaagctgagcccaccggctacacagcacaaatacatgaaaaaggaacaaaatgtaaagcatatcaagggaacgtctttgcaaaaacagcaaaaaacccagccacaacagaaaaattcaccaaacttccaacagaggaaacctagaaccaacgtgaagcccagcacctccccaagcctttgcctacacacaaaaagccacgttctagaggctctatttctaacttaagataagcaggatattttaaaaatcatytactcaccagttggtttgagaaaatccatcgggtatctggagtaaggaggggggggagactctgaaattaaaaaagcaagagaaaataaaggcccagccatgagaagagagatagaaacttatgataacagaggcattcttttagcccaactgtttgtcttagctgtgggggttggaggcagggccgcgaggcggtgattgccttgatatttagctgtcagataaacaaaagaggccgcctggcgccagcctcggcgctccgctcctccacgtctgcggccgcagccgccgcgctcggct

SEQ ID NO: 60550 - DNA, 601 bp, Human
tcaagttacagtctttaggaaaacagagcttggtaattccagttaacgtttgttacaaatacagagagctgggtatctccttattaataaccatttatctggtgttttgtaaatcgaaagcaaaatatcacatgctttgcgggccacttattagaccggcaccaggcaagcaggaacgccttcccaacttgagggagctggtagagtcccaggaggactggctgcagagtatgggcttcggttacacgttcattaaagtatttaatttatgacaacgccccagcaaaacttttaattagtkgggggaaaggcccaacagccaaaacgcaggaggcggaaggacttgcagaattccaggagctaaatggtgcccaacccttcacttttccttctcccagaaccttggcaaaataaaaatgtcccaagtattaatgtttttttcaggcaccagtatacaggcacaaaaaccaaggttacatacaacctgtacttttagcaaacagatctatctcctactgtaagagggagctccaggaatttgggtttgtccttgttgtcacccccaagttcattttgctgaccctgtccccagcactgtgat

SEQ ID NO: 60551 - DNA, 601 bp, Human
taagatggagacttcacaggatgtattcctttagttgtgcaactggttaacattttaacagttgtccactgtaaaactttgtgcctgtttcatctagtaacccaagaccaaaacttcaacctaagggacatagaaactgaagaatgtaaatggtccatgtagattcccgggccaaacattctcccatacgcaaaatggggatgaagacctgggtcagcgcccatctgtggtctgacctcaatgcccccggccacagcagctggcaaaaccagccccagacctgtgaggggggcggggggggtgtgctccagctccagacctggctgtcctccaatgtggcaggacaattcccttcgtgggggctttgtctattactgatgctaaattcttacacagcagcgccttttctcatttctttttttgttctattttcaacaaaacgttttgggtgagtaaccagctgtcttagtttccgattggcaggttaatcacttcctattggctgatctggagaacttttctcccccttggaaatggcacattcctgtctttgtggcttctctgtttacacacattttgctacctaatgtcaacacttgct

SEQ ID NO: 60552 - DNA, 601 bp, Human
aaagtccaggcctcccagatgctgagtggagtggcttaaattatagcaaaatggagttcctagctttgagccctctgtgtctccaaaggctgcagggtaccaggccccagccccattcccaccaccttttcctaagatggagacttcacaggatgtattcctttagttgtgcaactggttaacattttaacagttgtccactgtaaaactttgtgcctgtttcatctagtaacccaagaccaaaacttcaacctaagggacatagaaactgaagaatgtaaatggtccatgtagattcccrggccaaacattctcccatacgcaaaatggggatgaagacctgggtcagcgcccatctgtggtctgacctcaatgcccccggccacagcagctggcaaaaccagccccagacctgtgaggggggcggggggggtgtgctccagctccagacctggctgtcctccaatgtggcaggacaattcccttcgtgggggctttgtctattactgatgctaaattcttacacagcagcgccttttctcatttctttttttgttctattttcaacaaaacgttttgggtgagtaaccagctgtcttag

SEQ ID NO: 60553 - DNA, 601 bp, Human
gaacactctttcaaagaaggctctcctggttggaccacacagtacctaggtgtctaaagtccaggcctcccagatgctgagtggagtggcttaaattatagcaaaatggagttcctagctttgagccctctgtgtctccaaaggctgcagggtaccaggccccagccccattcccaccaccttttcctaagatggagacttcacaggatgtattcctttagttgtgcaactggttaacattttaacagttgtccactgtaaaactttgtgcctgtttcatctagtaacccaagaccaaaamttcaacctaagggacatagaaactgaagaatgtaaatggtccatgtagattcccgggccaaacattctcccatacgcaaaatggggatgaagacctgggtcagcgcccatctgtggtctgacctcaatgcccccggccacagcagctggcaaaaccagccccagacctgtgaggggggcggggggggtgtgctccagctccagacctggctgtcctccaatgtggcaggacaattcccttcgtgggggctttgtctattactgatgctaaattcttacacagcagcgccttttctcattt

SEQ ID NO: 60554 - DNA, 601 bp, Human
gggtgtctttctgacttctgacagccacaagtcacaactggcctcccctaggttcagtcatgtgaacactctttcaaagaaggctctcctggttggaccacacagtacctaggtgtctaaagtccaggcctcccagatgctgagtggagtggcttaaattatagcaaaatggagttcctagctttgagccctctgtgtctccaaaggctgcagggtaccaggccccagccccattcccaccaccttttcctaagatggagacttcacaggatgtattcctttagttgtgcaactggttaasattttaacagttgtccactgtaaaactttgtgcctgtttcatctagtaacccaagaccaaaacttcaacctaagggacatagaaactgaagaatgtaaatggtccatgtagattcccgggccaaacattctcccatacgcaaaatggggatgaagacctgggtcagcgcccatctgtggtctgacctcaatgcccccggccacagcagctggcaaaaccagccccagacctgtgaggggggcggggggggtgtgctccagctccagacctggctgtcctccaatgtggcaggacaattcc

SEQ ID NO: 60555 - DNA, 601 bp, Human
tgtaagcttgtcatgcaccactggcagcgccaaactccctgaagtcctaggggagagcccggctaaggaaaggtgctgcccaggtccgcagcaaacacaacaggttggatcgtgcagacaccaggcctcctaccccaggccaccaggacaatgtccctgtgggtttccagttggaaccacttggccatgctggcaaataggaaagccaaaaaaaaagagcagacgggcaagtagcccatgggaatcctttagtggcctacacatagccccaaaccatctctgggtttctgctgtctgcccctcttaatgctaagtttctctctctaactcagggtcactccctctcccacattctcaaggctggaaggacaacttttcaagaactctcctaagcgggcgaggggcagaagtggaggcaggcgtgggggtgaggtggctgcggtgggtagggggaaagaagactgtgtgtgtaatctcattttatcagggtaaagtctaattcctaacaggaatatacagttttacaggatacacttaatcaaacagaaaacaatagaggcaggcaggaaatggagttacttgttaaatggtgtataccctg

SEQ ID NO: 60556 - DNA, 601 bp, Human
acgtttggcacccaacactcggagtttcctcactgatttttacctttagattgcatctgcccttaactagacttctcttcaacttctgtcaccctcaggtactctgcacagtgacctcaccgttaatgaggataatgacaattccagctgagaaacagtctccacaaccgccctccaagcaattaaagcaaaacctaatgtccatgaaccacaactcattagtcccatgaaacacaaatacacaagaccctgtaagcttgtcatgcaccactggcagcgccaaactccctgaagtcctagsggagagcccggctaaggaaaggtgctgcccaggtccgcagcaaacacaacaggttggatcgtgcagacaccaggcctcctaccccaggccaccaggacaatgtccctgtgggtttccagttggaaccacttggccatgctggcaaataggaaagccaaaaaaaaagagcagacgggcaagtagcccatgggaatcctttagtggcctacacatagccccaaaccatctctgggtttctgctgtctgcccctcttaatgctaagtttctctctctaactcagggtcactccctctcccaca

SEQ ID NO: 60557 - DNA, 601 bp, Human
gaaagacaaaccacacattccaaaaggctgactcgcggccttgatgctgattattaatggtctgctcaggcttcactgcccatcgtaagacagaccacagcaccttgtcacccgtctgggctccgggcagccagttaatcattactcgagtcaggctcaatgagactggctggaatttctcttgcattaccagtcccccattacggataccaggtggttcccaaggtcaaaggaggtttgggttggactttctcaaccctggttgctctgtcatccctcatcaagggcagaaggctctctycttggagcccatgtcctctctgccttcatccttttaaagacaggtttcccagttcttgaaaacattctcaagattgatgttgggctgccgggacttctttccccttttttaattgaggactaacttaagtagagcaaagtatacaaaatcccaagtagacgcaatgaatgttactcatgtatacatctgtgtaaccaccaccagatcaagacagagaacattctcagcaaggctccgagccggaggggaaatgttctacctctcccgggctagtccaaacccctcatctctggaaacctt

SEQ ID NO: 60558 - DNA, 601 bp, Human
aaaaaattaaaacattaaaaaattttaaaaagaagcaaaggaagccaaacttgatcatgaattcttcggcatttcctcccttttcactgctccaccggctctgagcttgccacggaggtcccataggtgtacaagtctacgcagctacagtcaggctttgctaagtaaaggcatgtgtgtgtgtgtgtgtgtgtgtgtgtgtgtgtgtgtgtgtgtgtgtgtaggaagtgaggggcaatcagcatgctacagtgtcaccaaaagtgacaccacccaaagcctggccttcacctggccctcyccctttgctggcccagttcagcctggggacaggatgcgtgaggcggcagcagaccatcttgtctggccggcagagcagcccaaatttgctccagagattttaaatgctgtcaccctgtatttaacccctgccggactgcctcattctttccaggacaaaaggggttttatcagtaagcccttctccagggggaagtgcatgacctggggcactgcagaagaggcggggtccaggactggtcttcaccagggtgtgggtgtgcaccaggtgagcccgccccagccctgactcatcctgttg

SEQ ID NO: 60559 - DNA, 601 bp, Human
aacccggtcccatgggtcccttttacaatcccattcatgacagcaaagcaaaacagtggaccatgtatagttaataatagttttctctcaaatgtctctacaaagaagcaagaaagttatctgggaagctgaatcccgagggattttagtgtgcgagcaagtccaggaaccagcactttacaccttttttttcttctgccaggtgaagacaactgctttgagggtgctgctccgagttcaaggcctggaccgaagggagtaaagaccagcctggccatcataattctgcaaggaattatgrcacagtaacaacaataataaaggagcaaagaggccgggcgcagtggctcatgcctggaatcccagcactttgggaggccaaggcgggcggatcacctgaggtcaggagttcaagaccagcctgaccaacatggcaaaaccctctctctacaaaaaagtacacaaattagccgggcgtggtggtgcacgcctgcaatccaactactcagaggctgaggcaggagagtcccttgaatccaggaggcagaggttgcagtgactcgagatcctgccattgcactccagcctgggcgacagagca

SEQ ID NO: 60560 - DNA, 601 bp, Human
gttccttatagattatccaagtatctacatgtatttaaaacctaccgctggccattttttggtcaaacttgtggtaaaatacacataacttaaaatgtgccaccaatggcattgaatacattcggtgaactgtgcaaccatcaccactctacagttccagaacattttcatcgtcccaaaaggaaacccggtcccatgggtcccttttacaatcccattcatgacagcaaagcaaaacagtggaccatgtatagttaataatagttttctctcaaatgtctctacaaagaagcaagaaagytatctgggaagctgaatcccgagggattttagtgtgcgagcaagtccaggaaccagcactttacaccttttttttcttctgccaggtgaagacaactgctttgagggtgctgctccgagttcaaggcctggaccgaagggagtaaagaccagcctggccatcataattctgcaaggaattatgacacagtaacaacaataataaaggagcaaagaggccgggcgcagtggctcatgcctggaatcccagcactttgggaggccaaggcgggcggatcacctgaggtcaggagttcaagac

SEQ ID NO: 60561 - DNA, 601 bp, Human
acatcacagggactggggtctccaggggcccaggaagggtctggatcaccagcttttggagccaaccctggcaccatcctggttcgcagtcactgggatgggcaggccagggggaccccgcagagtgagaacaagcatattcacttcccccagcagaaaagtcaggccgggaatcaaaccagagggaactttcctgtctctcatttctggaacccacgaagaaaaaaggaaggtcgaaggatcagcacagatgtgtctgcttgctcaggtaacacacagcagaaggccaggcgtggtggtrcacgcctataatcccagcactttgggaggctaagtcgggaggatcacttgaggttaggagttcgagaccagtctggccaacatggtgaaacgccctttctactagaaaaaaattagccaggcatggtgtggcacgcctgtaatcccagctgctagggatactgacgcatgagaatggcttgaacccaggaggtggaggttgtagtgagccgagatcacgccactgccctccagccagggtgacagagtgagactccatctcaaaacacacacacacacacacacacacacacacacacac

SEQ ID NO: 60562 - DNA, 601 bp, Human
acgggagtggaagcccacatctcccaggtgaacccacagagagaaacagagaggctggggggcagccgagtcccccaagtgagccaacaggtttaggtagagtggccgggatcaggtgagtgttgctttcttggtgtgttaaccactaaattgagaactgtgcctcagcagttaataatatcttcccgctgaaaatagcccggagaggaagcctctgtgtgacagtaggcaggcagccaggcttggggctagccattcaataccgagcgagaggtggtagggccagtggtgacctccctgyggctgtgcttacagtatcctttcacgaggctcccgcaaagggagggtgcccgggccagtcacctacggccactgcagccctagaacttgggcaaggacatcacagggactggggtctccaggggcccaggaagggtctggatcaccagcttttggagccaaccctggcaccatcctggttcgcagtcactgggatgggcaggccagggggaccccgcagagtgagaacaagcatattcacttcccccagcagaaaagtcaggccgggaatcaaaccagagggaactttcctgtctctcat

SEQ ID NO: 60563 - DNA, 601 bp, Human
gcagccctgagttcccggcggctaagtgccaggtgcctctgttaggggaaggcagtaccgggggtgggtaaaaaggctaaaggcgtgagtaaattcttacgtaccccccatcaaaaaaaaaaatacaatcttttttttgcaagttaaaactgagctaatgacactgggtggggctcagtgttgaggactccgcagccaaaccaaaattagcttccagccaagagctgcttggccttaccatttggggaaggaagctgaaaaagtcatgaaagattctttagtaaaatgggaaataaggcgrcagttaacatttcaactgaaggtgacccttctggtaaaatatttttttaaataataaaaataacataaagttctcaaacagcctctttcttaaagaaaatggcctacatgttctcgtgggagtggaagggaagaaaaaaaaaacacaaaacagaaaacaggctagccgtttctcagccactacctttcacgaaccacttttctctggagttattctcaaaaaaaaagatgatgcaatttcctgtcttgtcccaatatttcctgttaacttacaaggtgaaagttatcaccctgttttaaa

SEQ ID NO: 60564 - DNA, 601 bp, Human
tccgagacccatttcccctccactcctcactagcaccctagaaatagtctcaggaaagttacagaactcctgcaggatgagggggacacggtggcttgaaaacacgaaggcagccctgagttcccggcggctaagtgccaggtgcctctgttaggggaaggcagtaccgggggtgggtaaaaaggctaaaggcgtgagtaaattcttacgtaccccccatcaaaaaaaaaaatacaatcttttttttgcaagttaaaactgagctaatgacactgggtggggctcagtgttgaggactccscagccaaaccaaaattagcttccagccaagagctgcttggccttaccatttggggaaggaagctgaaaaagtcatgaaagattctttagtaaaatgggaaataaggcggcagttaacatttcaactgaaggtgacccttctggtaaaatatttttttaaataataaaaataacataaagttctcaaacagcctctttcttaaagaaaatggcctacatgttctcgtgggagtggaagggaagaaaaaaaaaacacaaaacagaaaacaggctagccgtttctcagccactacctttcacg

SEQ ID NO: 60565 - DNA, 601 bp, Human
taggtgaaccatatcactccttcctccaaagcacagcaccgttactggacacagctgtaccagggcagctccgagacccatttcccctccactcctcactagcaccctagaaatagtctcaggaaagttacagaactcctgcaggatgagggggacacggtggcttgaaaacacgaaggcagccctgagttcccggcggctaagtgccaggtgcctctgttaggggaaggcagtaccgggggtgggtaaaaaggctaaaggcgtgagtaaattcttacgtaccccccatcaaaaaaaaaaatacaatcttttttttgcaagttaaaactgagctaatgacactgggtggggctcagtgttgaggactccgcagccaaaccaaaattagcttccagccaagagctgcttggccttaccatttggggaaggaagctgaaaaagtcatgaaagattctttagtaaaatgggaaataaggcggcagttaacatttcaactgaaggtgacccttctggtaaaatatttttttaaataataaaaataacataaagttctcaaacagcctctttcttaaagaaaatggcctacatgttctcgtgggag

SEQ ID NO: 60566 - DNA, 601 bp, Human
atgccctgtgtcattagaacaatgacatcaacaaagaggggatttagaaacccagagacaaaaaatggaactggaccttatctgcaccactgtagggctgtgataagccccctctctgggagatgcttctaggtgaaccatatcactccttcctccaaagcacagcaccgttactggacacagctgtaccagggcagctccgagacccatttcccctccactcctcactagcaccctagaaatagtctcaggaaagttacagaactcctgcaggatgagggggacacggtggcttgaaaayacgaaggcagccctgagttcccggcggctaagtgccaggtgcctctgttaggggaaggcagtaccgggggtgggtaaaaaggctaaaggcgtgagtaaattcttacgtaccccccatcaaaaaaaaaaatacaatcttttttttgcaagttaaaactgagctaatgacactgggtggggctcagtgttgaggactccgcagccaaaccaaaattagcttccagccaagagctgcttggccttaccatttggggaaggaagctgaaaaagtcatgaaagattctttagtaaaatgggaaat

SEQ ID NO: 60567 - DNA, 601 bp, Human
cggcatatgccactgagaggtgtttccaaggccggcgccggcccaccaacctctgtgggcacaccacctgcccacagcattctgctttggcgtcctgctctgtttggacaagttgccctcaccaagtgttcaacaatgcttttacacaccccagggcccttgttgtgttatgaaaacaaaacaaagcacgctaaggaaaaagctgggagggtgggggtgagcgtgagtggagagcgggccagccacacacacaggtctctttctttctggtctctgtcctaaagacggctccttggcagcrcgggccggggcactgtcccatgccctgtgtcattagaacaatgacatcaacaaagaggggatttagaaacccagagacaaaaaatggaactggaccttatctgcaccactgtagggctgtgataagccccctctctgggagatgcttctaggtgaaccatatcactccttcctccaaagcacagcaccgttactggacacagctgtaccagggcagctccgagacccatttcccctccactcctcactagcaccctagaaatagtctcaggaaagttacagaactcctgcaggatgaggg

SEQ ID NO: 60568 - DNA, 601 bp, Human
acttggcagccaagcccaagcccttattttgcagatgagaaaactgaggcccagaacacagaaatggctcctgcaaggccatgtggccagccaggggctgagacactcggcctcaacccaggagagcaggccagcctctagtgacaggaaagtggaggatgctggccccgacattgtaattctctcccagccccctcctgggactagggcatcctggacaccctggggggaaggtgggggggcttctgagtttttgcaggccccacgatcctgggctcttccccagaaaacagccccccccagcagggttttgattgtgcccccactgagcaggagatggggcccatctatttgtaagaacggtatggtgcactcagatcacactgataactaactttttaattttccctcttggttactgattcatgagggggtggggcagggctggctcagaggctgcagtgaggctgacaaggtccccaggcccagctcttgatgatcctcacttagcctgcaggggaaggagacacttaacagcttcatgaggtgactggaaggtgggacaggggacagggacaatcatttaacctccgagtgagcc

SEQ ID NO: 60569 - DNA, 601 bp, Human
agaaagaactacaacctttttattttaaaatggaagcagtctttggcttccatagggatatctcatcaatagggggatcattcccacacccctcaaatccaagagacaaagatcacagatcaccgaagggacttggcagccaagcccaagcccttattttgcagatgagaaaactgaggcccagaacacagaaatggctcctgcaaggccatgtggccagccaggggctgagacactcggcctcaacccaggagagcaggccagcctctagtgacaggaaagtggaggatgctggccccgmcattgtaattctctcccagccccctcctgggactagggcatcctggacaccctggggggaaggtgggggggcttctgagtttttgcaggccccacgatcctgggctcttccccagaaaacagccccccccagcagggttttgattgtgcccccactgagcaggagatggggcccatctatttgtaagaacggtatggtgcactcagatcacactgataactaactttttaattttccctcttggttactgattcatgagggggtggggcagggctggctcagaggctgcagtgaggctga

SEQ ID NO: 60570 - DNA, 601 bp, Human
taatttagcaattccacctctgggtatatacccagaagaactgaaagcggcgactccagtggtatttgcacatccatgttcacagcagcattattcacaatagccaaaaggtagaagcaagccaagtgtccatcaagcaataaatcaaccagacatggaatattcatacaataaaatattattcagccttaaaaaagaaggaaattctgacatacgctagagtatggatgaaccctgagggcattatgttaagtgaaataagccgatcacaaaaggacaaacactgtctgattccactatyctatgaagtacctagaggaggaggcaaattcatagacagaaagaatggtgggtgccaagtgctgggggaggggagaagggaagttagtgtttcatgggaacaaagtttcagctagggaagatgaaaaagttctggatgtggacggtggggataatagcacaatatgaatgtacttaatgccacagaactatacacttaaaaattgttaatatggtatattttatgtatattttaccacaataaaagaaaaaggcctcagctctcttaaggctctcctttgcacccccataactagtcctc

SEQ ID NO: 60571 - DNA, 601 bp, Human
aatgaaagggtcccccacccagaagctgctgtcacaaggccctggagtccaacatacacggccagctgctctgtgctgggtgccccacctttcagagcctccaggcctcccataaacatgggctcccataaatgtgagctccaatctggctggtgactgcagcagcccagcactgcccctcccccaccgcgcagggacagactgtcccctccccgctttctcactccctctgccccaggattcgccctcaagcccaccccggtgggtagggctcccccaccgcatgcgatcggtgtgtgccgacacacgaggcacaagtcaaggaggccctaccgttggcgatgccttaaaaaattaaacacagaatgacagtgtaatttagcaattccacctctgggtatatacccagaagaactgaaagcggcgactccagtggtatttgcacatccatgttcacagcagcattattcacaatagccaaaaggtagaagcaagccaagtgtccatcaagcaataaatcaaccagacatggaatattcatacaataaaatattattcagccttaaaaaagaaggaaattctgacatacgctagagtatgg

SEQ ID NO: 60572 - DNA, 601 bp, Human
cccaacctggggatgaatgctcctaagagcatttatctcgccatggagaatgtaattgagggtggcacggggcaggggaggaaagccacacaaatcaaaagctcttgtctgtctcgccagtcaggctgacgcggcttcctgtgccccagcattcagccatgcaaattacagcgtgtacccagctgcctgcagccactgctgtctgaggaggcccactctgcccaggctcctctgagagaggcctcagaggaagggtggggactcccgacccagccaactccattcataatattgacagtaagggcctctctggctgctgtttagtgtgcatgcagtcgaatcatttctcgagttcaaatttccagatacttcccctccatggtacaccaaccaggttcccactgttaccccccaagtaactcagagcagctctcttcagaaagggggttcacatattagcaggcacagaagccctcagccctgcatggcattgtctgctcagctgccttccctctgggcatgaccctggcacccccaggaagacacaagggctgggacaagcatggaacagaaagtctgtcgtgtccaagagaaactacca

SEQ ID NO: 60573 - DNA, 601 bp, Human
aagaggaaacaggaccccagagctccctcagactcctcaggaaacacagacaatgctggggtttagagtgagttcctcatggaggaaacaaaccaaaatgtttcaggtaaactgcgagttaatcagaaaacactggggcccaacccatctccaccaccccatgctctctccccaaacagatcagacgatgaatcctggctggtggaaggctgacctgagaacactggattttttttttttcatgctttgcagcatctccagtgaagtgagatggctggacttgggggtgggcagggggtgycacagggtctccttcaaaggccaggctgctctctggttcccgggcccagcaggcttcgtttccaccccttagcgcattctagccatggcagaacccccgcgcctgtgccaaccccagaggtgagccgaccagctacaaagccagatatgcatttcacaccaacctcgcatgcagtctcccggtaagttcagctcatccctaaaacagggttcccccaaggccagcctcataaggttgctgtaccaatttgatgcaaaagtgattggggccagcttgtggagagtgctgcacacacgttgg

SEQ ID NO: 60574 - DNA, 601 bp, Human
ctgccaaagtccaacagggccacgggcctatcagccccctcctccatggtccagcagagcagaaggctgaggacggagaagttggggaggaagggcgcctgggcaggcacggccgcctcctgcaggctccctgtgccaatcaggggcaaatgaagggcagaaatgtggacacagacagcttgcacctggcaacctgggagcgcaaacatcaccacgcctcgctaacgccaggtccagggtcctccctcctcaggacccaggcgccaccaacggttgcctcatcctgtctctccctccacawcggacatctcaaaggttaacagcacccatcccctgctcccaaccctgtcaggaaattggctgttctgatatcaacaagccctcttcagggacaagcctaagataaaaggggactccagtgccaatccatcccatctattctcacgccaaaccatcataattcacaaggacccttgctggtctcttgttttcaataggcgaatccctcccccaaatagagacgcgtaaaacttgctgagatatctgggctcactttaaggggctgtctctaatccaccatgctcacagcctcatccaaaag

SEQ ID NO: 60575 - DNA, 601 bp, Human
aacctcacaccccaggtctcaatggcacagggtgaccaggcctcaaggccacattttaggttaagcaaggaattttccccttcttaaatgtttttcttttttttttttgagatggagtctcgctctgtcgcccaggctggagtgcagtggcacaatctcggctcactgcaagctccgcctcccgggttcacgccattctcctgcctcagcctcccgagtagctgggactacaggcacccgccaccacgcctggctaattttttgtatttttagtagagacagggtttcaccgtgttagccrggatggtctcgatctcctgacctcgtgatccgccagcctcagcctcccaaagtgctgggattataggcgtgagccgccgcacccagaccccttcttaaatttttaatttgaaggcgtcaggagatgagaaagaagaaaaatgggaggaggggggaaaggccttgctcagtgcctcaacaataccattctccacctgaaggcagagggcagagaggcagagcagctccaagaacagccatggggttatgagaacacgggcacgcgtggaagagaagctatctgggcctgactgggcccaga

SEQ ID NO: 60576 - DNA, 601 bp, Human
gcataaaatcctccctttaaagggaagggggaggtgggtattgagaaaggagaggacttcagcctgtgtttgcgctccaactggggaagaccacttagcaaggagctccctgactcttacaaagagttatttaattaccctgctcatgaatgaacagaccagacccttccaggagaccagaggctcgtgaatgaacctcacaccccaggtctcaatggcacagggtgaccaggcctcaaggccacattttaggttaagcaaggaattttccccttcttaaatgtttttcttttttttttttgagatggagtctcgctctgtcgcccaggctggagtgcagtggcacaatctcggctcactgcaagctccgcctcccgggttcacgccattctcctgcctcagcctcccgagtagctgggactacaggcacccgccaccacgcctggctaattttttgtatttttagtagagacagggtttcaccgtgttagccaggatggtctcgatctcctgacctcgtgatccgccagcctcagcctcccaaagtgctgggattataggcgtgagccgccgcacccagaccccttcttaaatttttaat

SEQ ID NO: 60577 - DNA, 601 bp, Human
ccttttccggtattttccacaaacttctccccctccccagaaaactgtacaggggcttgttttaaaacagtatgtgttcattttaaagcatccaaaagaaaagctgtgttgtaaaaagctcactaatcagatgcctgctcacagttgtatctttttattacagtgtggggaatttttggagcaacaccagaaaaatgctgaatctgcctaaaattcctttaaggtgttgcccccccccccaccttccccatttcccttaaagcataaaatcctccctttaaagggaagggggaggtgggtrttgagaaaggagaggacttcagcctgtgtttgcgctccaactggggaagaccacttagcaaggagctccctgactcttacaaagagttatttaattaccctgctcatgaatgaacagaccagacccttccaggagaccagaggctcgtgaatgaacctcacaccccaggtctcaatggcacagggtgaccaggcctcaaggccacattttaggttaagcaaggaattttccccttcttaaatgtttttcttttttttttttgagatggagtctcgctctgtcgcccaggctggagtgcag

SEQ ID NO: 60578 - DNA, 601 bp, Human
ctctcgctgatagttaacctctgaaggcaaaactcacagtcctttgttaatttccctcagctttataaccttttccggtattttccacaaacttctccccctccccagaaaactgtacaggggcttgttttaaaacagtatgtgttcattttaaagcatccaaaagaaaagctgtgttgtaaaaagctcactaatcagatgcctgctcacagttgtatctttttattacagtgtggggaatttttggagcaacaccagaaaaatgctgaatctgcctaaaattcctttaaggtgttgcccscccccccaccttccccatttcccttaaagcataaaatcctccctttaaagggaagggggaggtgggtattgagaaaggagaggacttcagcctgtgtttgcgctccaactggggaagaccacttagcaaggagctccctgactcttacaaagagttatttaattaccctgctcatgaatgaacagaccagacccttccaggagaccagaggctcgtgaatgaacctcacaccccaggtctcaatggcacagggtgaccaggcctcaaggccacattttaggttaagcaaggaattttccc

SEQ ID NO: 60579 - DNA, 601 bp, Human
gtagcaggacggggaagtgtcaggtgggtttctgtttcatctgtgcagcccgccagcaatgtgctgccagacaccccctggaaaaagcatttttctgctgaggttaatggcccagcccagaaaaactgcagtgcatggatgtcgtgaatgctgctgtgtgtgaacaagggccctgaagtccatttggtgccctaacccaccgcagggagactcctgcctgctcctccctcgctgtcccctccagctcccccaccagcagcctctgtcctcccgttaggacagctccagtctcctcctgccrggactatctctaagcacacacaaaaaacaagctttccagcaaaaccattcggcaacagcaaaggcccctcgaacacacacccttgtgtggacatcacaccttctggggaccccgcacgacatcccccattgccactacagagattcccctttgccctgaattccccgccatttgggctcatttctgggaaatgctcagcttcatcttcacagaaacacagttccctgaatcgggcccacagcccacacgagtctccccacaaaggtctgtgtggacgctttgctcccagggacttcccgg

SEQ ID NO: 60580 - DNA, 601 bp, Human
ggaagccttgtctgccaagggtgggggcctctgggggcagaggaagctgggtggggactggagcctgagatctgtagcaggacggggaagtgtcaggtgggtttctgtttcatctgtgcagcccgccagcaatgtgctgccagacaccccctggaaaaagcatttttctgctgaggttaatggcccagcccagaaaaactgcagtgcatggatgtcgtgaatgctgctgtgtgtgaacaagggccctgaagtccatttggtgccctaacccaccgcagggagactcctgcctgctcctccstcgctgtcccctccagctcccccaccagcagcctctgtcctcccgttaggacagctccagtctcctcctgccgggactatctctaagcacacacaaaaaacaagctttccagcaaaaccattcggcaacagcaaaggcccctcgaacacacacccttgtgtggacatcacaccttctggggaccccgcacgacatcccccattgccactacagagattcccctttgccctgaattccccgccatttgggctcatttctgggaaatgctcagcttcatcttcacagaaacacagttccctg

SEQ ID NO: 60581 - DNA, 601 bp, Human
cggggtgattctggtaaggtaattttcctcaacaggcacttggaggactttaaaaggggggtcacacggagggaaagggagccccggcggcgggcattctgactcctccttaagtaggagccagcgggcaggcctcagacttgggaccataaatctccccagcccagccagactgcaggaacgctgtggtttgtggcagcagggtggagaccggaagtcttgtatttgttaacaaaaatggggacagcagagggggaaaagcagaggggaagggccccacgtcggtcagggccttgccctsgctccctgcagccccagctcctcctcttggggacctggggggcacaaagcaggggttgagtgtgagatgtgttttggtgtggcctttgtgtttctggagtaactgggttcagagtcaatgatgatgggttgcaccctgcagggggtccatggcggaagatggggccgcatcctgctgccccagcaggctgggtaactggggcagcccaggacactaactggctccaacttttacaggcgtgttaggacctgggaacccactggctccactcagttgttgttgttgttgttgttgttttaa

SEQ ID NO: 60582 - DNA, 601 bp, Human
gagcacagatgcaaagggacccttaatagcttgggtagtctgcttttagggcctcaaaaagcctcagcaacgtcctggagttacagatctttcaactggatggaaccttgaaggccagctcctccagccccttgtcatcctgatgagaaaaccaggacccagaaagcctgctgctggagtaccaggggatgacacagccagagctagaacccaggtgtctagactctgggaccacctatgcgatggtctctgggtgcctgtcacccagctctcaaatcagtgccgtggtcatgagggacccatctggtaaaaataaaaatgagggtggcttgggacaaaaacatctatattcctaataggaaaacagtctcagtgtgtcagcagcagccctgtacacaaagggtgaattcatgtcaaaatgccaaatcacaacatgcagaccggtattaacccgggctaccttaacaaagcttcctccagcccagacagaagattatgtgtctcaaatagatgcgtcccccttctccccttctctgccggcacccccatccccaggggtgccccctctctcccctccttccacagaagcatctggagcctg

SEQ ID NO: 60583 - DNA, 601 bp, Human
atcaggagtccagtacaccagcatctgtgcccacctggccaacaaagcctcttctctgcagagcacagatgcaaagggacccttaatagcttgggtagtctgcttttagggcctcaaaaagcctcagcaacgtcctggagttacagatctttcaactggatggaaccttgaaggccagctcctccagccccttgtcatcctgatgagaaaaccaggacccagaaagcctgctgctggagtaccaggggatgacacagccagagctagaacccaggtgtctagactctgggaccacctatgsgatggtctctgggtgcctgtcacccagctctcaaatcagtgccgtggtcatgagggacctatctggtaaaaataaaaatgagggtggcttgggacaaaaacatctatattcctaataggaaaacagtctcagtgtgtcagcagcagccctgtacacaaagggtgaattcatgtcaaaatgccaaatcacaacatgcagaccggtattaacccgggctaccttaacaaagcttcctccagcccagacagaagattatgtgtctcaaatagatgcgtcccccttctccccttctctgccggc

SEQ ID NO: 60584 - DNA, 601 bp, Human
gctgatctgcacggtaaagcccgtccacggctgctgcataaactcgtggtcattgggccgctgcaggctgtacgccttctcgtagtcgaaagccttgatggagaaaccggggaacaccttgtgtaccaacagcgtcctggagtccgggttgtccagtgtggcggacttgatgaagatggggtaactgctgcggttgtacacccacacaccatccacctcccgcgtcagctggatgccgcagccgattttgctccgcaccttctgcaccagctgactcttgttgtccgaattgagctgtccraggcaaaagccattcccctgaggtagatcatagaagatatccagagagggctcctggacacagtagagcctccccactctcgtcttctcctcccagtatgccaccacgcaccagtgtgaccgatccccaggctccagaagaagttgggaatctagaaaacacattggcagagagggttagtggggacaggcattggtgactcctagaatgaagacacccgcccccccactgcacccagtcaccagctcatctctcaggacgagacagaaagaaggaggcggtgaggctagtcctggactt

SEQ ID NO: 60585 - DNA, 601 bp, Human
cttcttccaaaaaaacccccaacaattcttttcataagctatttctcaaagagcgaaacaaaacagaacacaaacgaggacgagaagaagaaaaccaaccaacaaacaaaaaaaaaacgaccaaagagtttgcatgaaaagcaagcactcaggaggaaaatattagcagcaaagtagtttgaagtgtggcctgctcagctcacgctctgtcccctccgcacgcggctaccggctgttgaagatgacctctagccagcacgggcagctgctgatgaactggcgggtgtagcactggccccascccttcacaaagctgatctgcacggtaaagcccgtccacggctgctgcataaactcgtggtcattgggccgctgcaggctgtacgccttctcgtagtcgaaagccttgatggagaaaccggggaacaccttgtgtaccaacagcgtcctggagtccgggttgtccagtgtggcggacttgatgaagatggggtaactgctgcggttgtacacccacacaccatccacctcccgcgtcagctggatgccgcagccgattttgctccgcaccttctgcaccagctgactcttgttgtccgaa

SEQ ID NO: 60586 - DNA, 601 bp, Human
agtgtatcactacttaacatgattggatgctaattgcaatatgctgtgccttacactagccgaccagctccgagcaagcgctggcttgattttcatactccttttgcgagcagctactctattttcaggaagggttgtaaaagggaacaggaggtttatgcaggctgggcaaactgcagtgctgaattgcttaacactggtttgacattcctgactgcaaaacaaatagaaaattgacaaagcaagctaatcaatacttaaagtattgaaggtaaagaaacccgtgaccttggaaaattgrccacagaaaagagatatatgtgagacttacaggacaaacaaggtcaaaatctgatatgatctcaataataaagttggaaatggtgacggggtggggtgggagggcagggagagataactatactgtcaaaccttaaagagagtattcaattttattaaataagtaaaagcatgaaaaaccccttttatttaaaggtttttgcagttgttacatatttggtgccatttgtcttttgaatgcaacagttgacatatcagaaatcaatggaggagtcaggtagccagccaagatttctaaaga

SEQ ID NO: 60587 - DNA, 601 bp, Human
tggttatgtgtgcctattgaatacaaaaattctgaaataaggcctccaacaaagcaacaaatttttaccctacttattttagttcttcttcttacattgaacatgtaaataaatagaaagaagagacaacataatctggatttttgaagtcttgattgaaagctacagagacttggttcatctgctcattctcaaatatttttaccctgtattttgaataaagtaccacaaaatatagagcacagatgtcttttaaagataaaagaaatgcatacccttggtcactagaaataaattttcrtttactttagagtgtttttctcttgggaagccttacctctaacccacctgctgctgttttaacctctcttctttgacactttatggattgcagttttctttacagatggccaacccagagtggaagataggttaaatcgaaacctatttttttccttgaaggaaaagaacccactgtgcatctatctgtaacggagactttagatttgaccgcaaagcagatgagtctagaggctgctcattgaatacaaagggcagccagacccctatgtggtactagtggttaggacctcgtcatact

SEQ ID NO: 60588 - DNA, 601 bp, Human
tggtcactagaaataaattttcatttactttagagtgtttttctcttgggaagccttacctctaacccacctgctgctgttttaacctctcttctttgacactttatggattgcagttttctttacagatggccaacccagagtggaagataggttaaatcgaaacctatttttttccttgaaggaaaagaacccactgtgcatctatctgtaacggagactttagatttgaccgcaaagcagatgagtctagaggctgctcattgaatacaaagggcagccagacccctatgtggtactrgtggttaggacctcgtcatactggttgggctgtcctggtgtcctttctcaaatctgttgtcagtttccaggaatcacaattctggtaatactggaactaaatgtcaatatttatatacatacatgtatgcatatatctgttagatctaattacataaataatatattttagatgtaatataaatcaattgataaatatgcacctgtgtgtgcatgtgtcttaatctttcactagttcttataccttttctttttagtatgacagctttcttaagaattcctcctactcaaacattgtctc

SEQ ID NO: 60589 - DNA, 601 bp, Human
taaataagtatgagctatacacttatatatgccttgggaaatatatttgcacagtaaatgatttttaaaggcatgtgtgtatgtatgtgtgtatatatactatgtgtgtgtgtgtatatatgtgtgtgtgtgtgtatgtatatatatctgtctccttaaatcactcagagcttttccagataatgtcttaagatgtcctttaagggtgatatttggcttttaagacctctgtatctttgaatgtcaagttcatatatgtattttcgtaagaaattgataacttcatatttggaactgcatkttttttttattaataatagcttttaatattggccatgttaaaatccttaatttttttcagaactttaaatttggctttaattataaacctcactacataatgacattttattaaaattaaataaggggctgggtgtggtggctcgctcctgtaatcccaacactttgggaagccaaggtgggcagatcacttgaggtcgggatttcaagaccagcctggccaacatggtgaaaccccatctctactaaacatacagaaattagccaggtgtggtggcgggcacctgtaatcccagttact

SEQ ID NO: 60590 - DNA, 601 bp, Human
aataagtatgagctatacacttatatatgccttgggaaatatatttgcacagtaaatgatttttaaaggcatgtgtgtatgtatgtgtgtatatatactatgtgtgtgtgtgtatatatgtgtgtgtgtgtgtatgtatatatatctgtctccttaaatcactcagagcttttccagataatgtcttaagatgtcctttaagggtgatatttggcttttaagacctctgtatctttgaatgtcaagttcatatatgtattttcgtaagaaattgataacttcatatttggaactgcatttkttttttattaataatagcttttaatattggccatgttaaaatccttaatttttttcagaactttaaatttggctttaattataaacctcactacataatgacattttattaaaattaaataaggggctgggtgtggtggctcgctcctgtaatcccaacactttgggaagccaaggtgggcagatcacttgaggtcgggatttcaagaccagcctggccaacatggtgaaaccccatctctactaaacatacagaaattagccaggtgtggtggcgggcacctgtaatcccagttactca

SEQ ID NO: 60591 - DNA, 601 bp, Human
acatatttaatgtgacaaatgccttaaaattaatttatccctcaccttttcccagaaaggcttataaaatttaaatatgttatctcctacctcactagaaaacactcaacctgaaatgcattgagcaaaagtaattcataaatggaggagtctactgattgagaaattgtcatatgtactcaaagtattttggaataaagaagggcaaggtctggccttcttcttgatcaagaagtgtctcatagcagcactgctatgagctcccaaatgtcctttaggtctggccttcatgagatgttayatgtggaggtgcttaactgtgggttagggttaagtcctttgctttgcatgataagaacctgtttcacgaagggtgatcaagtcctactgagttgatttgcactgtggtacaccttcgttgctggcagatttcctaaataaataaaggtcagaaggaatatatgagatctaagcaggtgaatttacatcatcttaagagatatttccattaatttgtgctagcctactgaattatcatccgtcactaaagatacacacaactcatgatggtcacatggtcacatctgttagacatggcccc

SEQ ID NO: 60592 - DNA, 601 bp, Human
ttgaagttaaacttttctgcacatacgctgatagctaccaaatcaatatgcccagcccagatctttcttccaagttttagacccatattcaaaagtttccagacatctctatttggaaactctccaggcactgtaaacatggttatacaagactgagctccatccttgcggtcctgttcctccctctctctgctcctcccttccactctcccaccactacttatatctactcctcatttactggttagattaaatgacacttttatactctccattgtccaagccagaaacatggtcctgyccctcttctttactttctgatccattcaatcatgttcaatcattgctacttccttgagagctctggaatcttttctttctattccacctatctccatcctagtgcaggctgttattttcttccccagttaccacagtaactgcagtagtccattctcaccctgctgtaaagtagtactcaagactggataatttataaaggaaagatgtttaattgactcacagttcctcataactgggtagacctcaggaaacttacagtcatggcaggaggcaaaggagaaataaggaccttcttcac

SEQ ID NO: 60593 - DNA, 601 bp, Human
caaatcaatatgcccagcccagatctttcttccaagttttagacccatattcaaaagtttccagacatctctatttggaaactctccaggcactgtaaacatggttatacaagactgagctccatccttgcggtcctgttcctccctctctctgctcctcccttccactctcccaccactacttatatctactcctcatttactggttagattaaatgacacttttatactctccattgtccaagccagaaacatggtcctgtccctcttctttactttctgatccattcaatcatgttcratcattgctacttccttgagagctctggaatcttttctttctattccacctatctccatcctagtgcaggctgttattttcttccccagttaccacagtaactgcagtagtccattctcaccctgctgtaaagtagtactcaagactggataatttataaaggaaagatgtttaattgactcacagttcctcataactgggtagacctcaggaaacttacagtcatggcaggaggcaaaggagaaataaggaccttcttcacgtggcggcaggagagagtagagagcaaagggggaagaa

SEQ ID NO: 60594 - DNA, 601 bp, Human
ccaagttttagacccatattcaaaagtttccagacatctctatttggaaactctccaggcactgtaaacatggttatacaagactgagctccatccttgcggtcctgttcctccctctctctgctcctcccttccactctcccaccactacttatatctactcctcatttactggttagattaaatgacacttttatactctccattgtccaagccagaaacatggtcctgtccctcttctttactttctgatccattcaatcatgttcaatcattgctacttccttgagagctctggaaycttttctttctattccacctatctccatcctagtgcaggctgttattttcttccccagttaccacagtaactgcagtagtccattctcaccctgctgtaaagtagtactcaagactggataatttataaaggaaagatgtttaattgactcacagttcctcataactgggtagacctcaggaaacttacagtcatggcaggaggcaaaggagaaataaggaccttcttcacgtggcggcaggagagagtagagagcaaagggggaagaaccccttataaaaccatcagatctcataaaaa

SEQ ID NO: 60595 - DNA, 601 bp, Human
ttattttcttccccagttaccacagtaactgcagtagtccattctcaccctgctgtaaagtagtactcaagactggataatttataaaggaaagatgtttaattgactcacagttcctcataactgggtagacctcaggaaacttacagtcatggcaggaggcaaaggagaaataaggaccttcttcacgtggcggcaggagagagtagagagcaaagggggaagaaccccttataaaaccatcagatctcataaaaacttactatcataaaaacaatgtggaagaaactgcacccattawccagtcacctcccactgggtccctccctcgacaaggggggattatggggattacaattccacatgagatttgggtggggacaaagccaaactctatcagcagcctcctaactggtcaccccatcttagtcttcatccttcaacaatccattctccacattggaactgccattgtgattttttttcaagagcaatcatggtatttctctgcttaaagcccccagttggttcccattttctgagaatatgagtgcaatctgagcaatgttgctatgagacacttcttgatcaagccactgct

SEQ ID NO: 60596 - DNA, 601 bp, Human
gcagtagtccattctcaccctgctgtaaagtagtactcaagactggataatttataaaggaaagatgtttaattgactcacagttcctcataactgggtagacctcaggaaacttacagtcatggcaggaggcaaaggagaaataaggaccttcttcacgtggcggcaggagagagtagagagcaaagggggaagaaccccttataaaaccatcagatctcataaaaacttactatcataaaaacaatgtggaagaaactgcacccattatccagtcacctcccactgggtccctccctcracaaggggggattatggggattacaattccacatgagatttgggtggggacaaagccaaactctatcagcagcctcctaactggtcaccccatcttagtcttcatccttcaacaatccattctccacattggaactgccattgtgattttttttcaagagcaatcatggtatttctctgcttaaagcccccagttggttcccattttctgagaatatgagtgcaatctgagcaatgttgctatgagacacttcttgatcaagccactgcttgtctccttagccttaattctcagcacctt

SEQ ID NO: 60597 - DNA, 601 bp, Human
attggaactgccattgtgattttttttcaagagcaatcatggtatttctctgcttaaagcccccagttggttcccattttctgagaatatgagtgcaatctgagcaatgttgctatgagacacttcttgatcaagccactgcttgtctccttagccttaattctcagcaccttcatcctctggagtcccccagtggcattgaatttcatacagtttcctaacaatcaacactcttttatttgcctgtgctcctccacagaggctgttccctggtctcggttaggtatccttgcttttcccstatcataacacttaccctaccttatcctaattatccctttagttgtctgcccatcttagaacttaagtttctttcattccctttttgattgttgtatctctgttgcccagcaagaatgcctggcctctgacagacactcaagacgtaatggttgaatacatatatacataatgctggggaaatatcaaatttttactctttcactactacctctttattcctacttgtcattataatatgtcgttttgggggatgggggtaatgctctcagtcagtctatgaagcttcccctagatactt

SEQ ID NO: 60598 - DNA, 601 bp, Human
gacagtggaggacgaagaggatttccctgaggaaaatccaagtgctgttttccagaaaacaaaacaaaacaaaaacaaaacaaaaaaaaaagagggaaatggatcctgggcagataaaaaccgcattttttttttgcacatacacagaactttatgataccatttttaaaagtgaaccatgctctcctgtggtgaaagcttagaaagtgaagaattaacatatttaagcttagcagtgctgatgttcctcattacataaatggggattatggaaatggtggctaatagtgatggagtttayaaggaaacatccagaattcaaaatacagaattgcctttccagtaggatttgtacctggcaaaaacttgcagagtagggactcagtatttgaattaatttaagtagtcatggcaaaaagattttactcagatattcagtaagtattggcaacttactgaattataatactgaattatagtaggagcttgcagaattgactgagcaacactttgaagaacatatttataaaatagctaaaatgaaataccacatactctttcattcctttcaaggtacaactttaactactagatccagttc

SEQ ID NO: 60599 - DNA, 601 bp, Human
gaatttcttcttgttgttgttggaaccacaggtctgaacaaacactgttctgttgaatatctagaaggaaagacacaatttggattttgcttttccagaaagttccactccttgggggtcctactaacctctaactttgacatcattatggatgctgcagaaataagtcggatgtcctgggcgcaatggactacattgtgaagcctgttggcaacttcccttatataaggttaattcgggtgaaataaatcaacccgactacttattttgatgaaaataaatgtcagtccagaaaaaaaaagaggagagagaaggcacctgcagtggaaaggaataagaaaagtatcttgcaaactgttcaaactgtaagtaactatcagcacccctcagcaccatttttatctgaaagaacactgcaaatatcttaaaaagtgacttaaggttgtgcaagaagcttcctcaacttactcctgaacgcctgcctctcaaatctgaatatggcagcaggacagaaagaccctagaatttctcaccttgtatgtaagcactctaagcaaggtttgcctatgaatttttgtttgattaaagatgggtgaagaga

SEQ ID NO: 60600 - DNA, 601 bp, Human
aaccatttaaaaataataggattcttatttctatggaccaaaaaaacacttaaaatttcaaaatgaatccccgcttcaaagggaaaaaccatcagggctggagggtccttttctgatttttcatttttttcttctctgtatgatttcttattacacagttttatttttccaatgaacttaactcttgagccatgattgacactacaatcagattaaaggatactcttttaaaagacactgatttggactctactccacaaaaaaggagatgaaagctggctttttctgacttgattggctrttctgtgtttacctttttaatgtccttgatgagacaggtgtttctcatggcattttatgcagtcagtcagtcaaccgggatttcactctgacagctgtgctccatcgctatctggagaaaatggcagcagctcagagttcctacagatacccctgtgatttgatttccagctatagactttcgttttctgccaggcctctgatgggtcagatttaagtaccaatgtgccatctaaatactagctttctgaactcatttcccaactttatcctgttaatgccaaacttctttatgaagggg

SEQ ID NO: 60601 - DNA, 601 bp, Human
ttctgatttttcatttttttcttctctgtatgatttcttattacacagttttatttttccaatgaacttaactcttgagccatgattgacactacaatcagattaaaggatactcttttaaaagacactgatttggactctactccacaaaaaaggagatgaaagctggctttttctgacttgattggctattctgtgtttacctttttaatgtccttgatgagacaggtgtttctcatggcattttatgcagtcagtcagtcaaccgggatttcactctgacagctgtgctccatcgctrtctggagaaaatggcagcagctcagagttcctacagatacccctgtgatttgatttccagctatagactttcgttttctgccaggcctctgatgggtcagatttaagtaccaatgtgccatctaaatactagctttctgaactcatttcccaactttatcctgttaatgccaaacttctttatgaagggggaaggttagcttcgtaataaggggatagatacaagagactccatacacacgtggttttgaatatcagcttctaggagctgatggaagagtatgcacagaatattagtctc

SEQ ID NO: 60602 - DNA, 601 bp, Human
agaaaataaaattggattttattctcccatgcaactcatcatggttttaaaaatttattcttgttaaataatggctctgtgttttgtaaactgcatagaataacacaatcaatgttttattaatagtttctaaattaccatgcagaccacagaagctcaagattttaaattttgaagtaggactttactatcagttgttattagtaatttgaaccaatttctctggtttcaaaatacgttacttaattgccacgagagtggtgaaactttgttcagatttaatgaggaaattctggttcarcttttctttattccttgtctatctttcatacatttcaacatgtcaaagtattaacatatattttatagtaatctcaaataataactaatcaataaatacagaacatctctgtaccatgcaacaatttcagtttcacatgatataaaagattagaactgttacagactttgggcaaaagtggtgagctcagacaatttcacgataaattaaacttagaatcaaagagtgaaaccagaataagcaacgttaagaagtggatgatcaggccaatcttattggaaacgtcaatcgtgtacttgc

SEQ ID NO: 60603 - DNA, 601 bp, Human
agagtgaaaccagaataagcaacgttaagaagtggatgatcaggccaatcttattggaaacgtcaatcgtgtacttgctaacctacagccttctactacatgaagctgcccaactcacagtcactgccaaatggcagttctgtatatacaaactacatggacggcaccctcaccccacaaacaagcagccaaaatgtattcggttgagcactttgacttaggaatttgaatggagaattcacagtatcacttagcagtggagcaggagctgaaagattaccatatgagaattaaagtcatagagggctggatacagtggcacgcacccagctctgtaatcccagagctttgggaggccaaggcaaaaggattttttttttttaagatggagttttgctgtttgcccaagctgaagtgaagtggtgtgatcttggcccactgcaacgtctgacccccaggttcaagcgattatcctgccgcagcctcccaagtagctgggattataggcatgtgccaccacacccggctaatttttgtatttttagtagagacagggtttcgccatgttggccaggctggtcttgaactcctgacctcagac

SEQ ID NO: 60604 - DNA, 601 bp, Human
taagaagtggatgatcaggccaatcttattggaaacgtcaatcgtgtacttgctaacctacagccttctactacatgaagctgcccaactcacagtcactgccaaatggcagttctgtatatacaaactacatggacggcaccctcaccccacaaacaagcagccaaaatgtattcggttgagcactttgacttaggaatttgaatggagaattcacagtatcacttagcagtggagcaggagctgaaagattaccatatgagaattaaagtcatagagggctggatacagtggcacgcamccagctctgtaatcccagagctttgggaggccaaggcaaaaggattttttttttttaagatggagttttgctgtttgcccaagctgaagtgaagtggtgtgatcttggcccactgcaacgtctgacccccaggttcaagcgattatcctgccgcagcctcccaagtagctgggattataggcatgtgccaccacacccggctaatttttgtatttttagtagagacagggtttcgccatgttggccaggctggtcttgaactcctgacctcagacagtccacccacttcagcctcccaaa

SEQ ID NO: 60605 - DNA, 601 bp, Human
cctacagccttctactacatgaagctgcccaactcacagtcactgccaaatggcagttctgtatatacaaactacatggacggcaccctcaccccacaaacaagcagccaaaatgtattcggttgagcactttgacttaggaatttgaatggagaattcacagtatcacttagcagtggagcaggagctgaaagattaccatatgagaattaaagtcatagagggctggatacagtggcacgcacccagctctgtaatcccagagctttgggaggccaaggcaaaaggattttttttttttaagatggagttttgctgtttgcccaagctgaagtgaagtggtgtgatcttggcccactgcaacgtctgacccccaggttcaagcgattatcctgccgcagcctcccaagtagctgggattataggcatgtgccaccacacccggctaatttttgtatttttagtagagacagggtttcgccatgttggccaggctggtcttgaactcctgacctcagacagtccacccacttcagcctcccaaagcgctaggattaaaggcgtgagccaccacacccggccttgcaggaggatcttttga

SEQ ID NO: 60606 - DNA, 601 bp, Human
caaaatgtattcggttgagcactttgacttaggaatttgaatggagaattcacagtatcacttagcagtggagcaggagctgaaagattaccatatgagaattaaagtcatagagggctggatacagtggcacgcacccagctctgtaatcccagagctttgggaggccaaggcaaaaggattttttttttttaagatggagttttgctgtttgcccaagctgaagtgaagtggtgtgatcttggcccactgcaacgtctgacccccaggttcaagcgattatcctgccgcagcctcccargtagctgggattataggcatgtgccaccacacccggctaatttttgtatttttagtagagacagggtttcgccatgttggccaggctggtcttgaactcctgacctcagacagtccacccacttcagcctcccaaagcgctaggattaaaggcgtgagccaccacacccggccttgcaggaggatcttttgaggccatgagttcaagaccagacagggcaacataacgaaacccccatctccacaaaaaaattaaaaaattattagcctggtgtggtggtacgcacctgcagtcccagct

SEQ ID NO: 60607 - DNA, 601 bp, Human
agcaggagctgaaagattaccatatgagaattaaagtcatagagggctggatacagtggcacgcacccagctctgtaatcccagagctttgggaggccaaggcaaaaggattttttttttttaagatggagttttgctgtttgcccaagctgaagtgaagtggtgtgatcttggcccactgcaacgtctgacccccaggttcaagcgattatcctgccgcagcctcccaagtagctgggattataggcatgtgccaccacacccggctaatttttgtatttttagtagagacagggtttcrccatgttggccaggctggtcttgaactcctgacctcagacagtccacccacttcagcctcccaaagcgctaggattaaaggcgtgagccaccacacccggccttgcaggaggatcttttgaggccatgagttcaagaccagacagggcaacataacgaaacccccatctccacaaaaaaattaaaaaattattagcctggtgtggtggtacgcacctgcagtcccagctacttgggaggctgaggtaggaggagctcttgagcctgggaggtcgaggctgcagtgagccgtgttcgtgcc

SEQ ID NO: 60608 - DNA, 601 bp, Human
tcctgacctcagacagtccacccacttcagcctcccaaagcgctaggattaaaggcgtgagccaccacacccggccttgcaggaggatcttttgaggccatgagttcaagaccagacagggcaacataacgaaacccccatctccacaaaaaaattaaaaaattattagcctggtgtggtggtacgcacctgcagtcccagctacttgggaggctgaggtaggaggagctcttgagcctgggaggtcgaggctgcagtgagccgtgttcgtgccactgcactccagcctgagggatggagygagatcttgtctcttagaagaaaaaagtcatggagggtcatggcaagccaaattctgagtaaagaatcccgtgaggaagtggaagctatgtgataaagaatctgcatggaaaagggaaagagtcagccaggtggcaccgggtgcagaccgcagagcatgcaggaggagtggcctataaaggcaacaccctttaagacagaatgttgtgttcatggcagaacaccagagtgaagatcaaaagtcgtctctggtttttctgaagtcttatggtccagcttttctgagttgccacaagtgtat

SEQ ID NO: 60609 - DNA, 601 bp, Human
gagtaaagaatcccgtgaggaagtggaagctatgtgataaagaatctgcatggaaaagggaaagagtcagccaggtggcaccgggtgcagaccgcagagcatgcaggaggagtggcctataaaggcaacaccctttaagacagaatgttgtgttcatggcagaacaccagagtgaagatcaaaagtcgtctctggtttttctgaagtcttatggtccagcttttctgagttgccacaagtgtatattctttaagtaaggcccggccccttgtggggacttcagtgatctctgttcttttcygccaagtggccaacactctaatacaacgaggaaaatatatgatcaaccaaggagacaaaagtgagtgagcgctaaatgttagcataagcttaaatgatgcgacatgataaatcaatataaagatgaaatatatacagagatttctaaaacacaaatgataattaaagcatatctcataaattatgaagtgagacatacttaatcttcagcttaacaatgtctacacttattcgtttaatcaatatttatttaatgcctagcatgtctcagacactatgttattcttgggggatgtaaaga

SEQ ID NO: 60610 - DNA, 601 bp, Human
cagaatgttgtgttcatggcagaacaccagagtgaagatcaaaagtcgtctctggtttttctgaagtcttatggtccagcttttctgagttgccacaagtgtatattctttaagtaaggcccggccccttgtggggacttcagtgatctctgttcttttccgccaagtggccaacactctaatacaacgaggaaaatatatgatcaaccaaggagacaaaagtgagtgagcgctaaatgttagcataagcttaaatgatgcgacatgataaatcaatataaagatgaaatatatacagagrtttctaaaacacaaatgataattaaagcatatctcataaattatgaagtgagacatacttaatcttcagcttaacaatgtctacacttattcgtttaatcaatatttatttaatgcctagcatgtctcagacactatgttattcttgggggatgtaaagatgaatcaaataatcttttccctcaaggaaatcatagtctggcagctagaatgagacatcgctttcatttttttcttttttaaaaaatggattgcttttgattcctgagtcaatctgttatcctcacttaagcagatcatg

SEQ ID NO: 60611 - DNA, 601 bp, Human
tgcaggatttagcttatgacttgatgtggtggctgggcacagtgtcccacacctgtaattccagcattttgggaggccaaggcagaaggatagcttgagtccaggagtttgagaccagcctgagcaacatagtgagaccctatctctacccagaaaagatttaatgtggtgagtaataaggaactggcttcatgatgatcatgagtctgcattgatgtggcaagaggcactccagaaagacttctggcgacgtaggcaattggatttgaatggagactgtcaggaaggccacagtcttatrtattccccaggtgaggtgatcaagggatgagaaaagtcgcagtgacaggggctattgagagaaaaaaaaagaaaatgaaacataaatatgatgattttatctttttctattttacttataaaacatgatttatatagactaaaattttatttgcgataagggaaatggagatagaaaacggctaagtcagaaaaagatagtcattctgcttttcacagcctattttgggccaattgctccctgaaaataaattttttaaaaaaacttctagggcgcagtgaccacacttgtaatcccagc

SEQ ID NO: 60612 - DNA, 601 bp, Human
tttgggaggccaaggcagaaggatagcttgagtccaggagtttgagaccagcctgagcaacatagtgagaccctatctctacccagaaaagatttaatgtggtgagtaataaggaactggcttcatgatgatcatgagtctgcattgatgtggcaagaggcactccagaaagacttctggcgacgtaggcaattggatttgaatggagactgtcaggaaggccacagtcttatatattccccaggtgaggtgatcaagggatgagaaaagtcgcagtgacaggggctattgagagaaaaamaaagaaaatgaaacataaatatgatgattttatctttttctattttacttataaaacatgatttatatagactaaaattttatttgcgataagggaaatggagatagaaaacggctaagtcagaaaaagatagtcattctgcttttcacagcctattttgggccaattgctccctgaaaataaattttttaaaaaaacttctagggcgcagtgaccacacttgtaatcccagcacttttgggggccgaggcgggtggatcccttgagtcaaggagttcgagaccagcctggggaacatga

SEQ ID NO: 60613 - DNA, 601 bp, Human
aggaaggccacagtcttatatattccccaggtgaggtgatcaagggatgagaaaagtcgcagtgacaggggctattgagagaaaaaaaaagaaaatgaaacataaatatgatgattttatctttttctattttacttataaaacatgatttatatagactaaaattttatttgcgataagggaaatggagatagaaaacggctaagtcagaaaaagatagtcattctgcttttcacagcctattttgggccaattgctccctgaaaataaattttttaaaaaaacttctagggcgcagtgrccacacttgtaatcccagcacttttgggggccgaggcgggtggatcccttgagtcaaggagttcgagaccagcctggggaacatgatgagacccctactctacaaaaaatacaaaaattagctaggcctggtggcatgtgcctatagttccagctacttagggaggctgaggtgggaggatcgcttgaacccaggaagtcaaggctgcagtgagccatgatcatgccactgcactccagcttggacaacagagagagatcctgtcttacaaaaaaaaatctttagtatgttttggtttga

SEQ ID NO: 60614 - DNA, 601 bp, Human
gtctactattgaattcgtacacttaatccctctcctagtcactgcggcccctctgtgtgtattataaaaaggtactctctttgagtgggaaaattagaaaaatgcaccctcacagggagcatgtagcctctctttatttcacccctaactcatcctttggcctgggcttttgaacagtacacagaatgtacaactgtacatggcagccctgtcttcactgtcttcactaccagtcagtacctttacaaatttcaagtaactttgacatgcataatcttatttgattttggcttcagccacrtgaaataaaaatgacagttaattacctttctcttacaaaacagaaatctattctctttatgtattgatgtattgatcacacaaaaggtacatcataaaaaccaagcagtggcccaggggcaggaaagatcctgggtatgaaccactgtgtgctttactatactacatgctttgcacatgacttaatttactgttcccaaaagccctacaaggtaggggatcactaacgcctgtacacagattaggaaacagcttcaataaagtgaattaccttgctgggctttccatattttgtaggttg

SEQ ID NO: 60615 - DNA, 601 bp, Human
taaaggaacattatagcacttttggaggctgtggcaggtggatcacctgaggtcaggagttcgagaccagcctggccaacatggcaaaaccgtgtctctactaaaaatacaaaaaattagccgggcatgatagtgcatggctatagtcccagctacttgggaggctaaggcaggagaatcactggagctcaggagctggaggttgcagtgagccgagatggtgccactgcattccagcctgggtgacagagtgagactccatctcaaaaaaaaaaaaaaaaaaaaaaagggggaaataatrttattaaagttgtggacataaggggtctggattccatcagggccccctggaagatgtaccaaaaccttccagaattgtccactttaaggatggcagtggggagcatttgttcacagcttctgtcccctattcattgagagttgtccctaggggcagtcattaccccacatttctgggctggctggtgaaaagaatggatgtttacaggtcgtaagaccctggggcagagtggagagtcccatggcttaggtttgaggtagcacagaggacactgcagctgtggctgggttcagaggtgga

SEQ ID NO: 60616 - DNA, 601 bp, Human
aaaaaaaaaaaaaaaaagggggaaataatgttattaaagttgtggacataaggggtctggattccatcagggccccctggaagatgtaccaaaaccttccagaattgtccactttaaggatggcagtggggagcatttgttcacagcttctgtcccctattcattgagagttgtccctaggggcagtcattaccccacatttctgggctggctggtgaaaagaatggatgtttacaggtcgtaagaccctggggcagagtggagagtcccatggcttaggtttgaggtagcacagaggacrctgcagctgtggctgggttcagaggtggattgacagaatggaatgcagagcaacagaggtgtctgctgcaaatctctttcagccccctccgtgtgtgagcactagatggctgtccttgtcatagacaaaagatagaccagtcacctggggaggcactggcatcagcctgggaaatggtcaaagctgggttttaccagtagtcatttaaagtctcttggtctccatttcccataagatggaaagagtaataggacctgccttacagattgttaggaagacttattaactcagtgtgataaa

SEQ ID NO: 60617 - DNA, 601 bp, Human
gtgtgagcactagatggctgtccttgtcatagacaaaagatagaccagtcacctggggaggcactggcatcagcctgggaaatggtcaaagctgggttttaccagtagtcatttaaagtctcttggtctccatttcccataagatggaaagagtaataggacctgccttacagattgttaggaagacttattaactcagtgtgataaaatgtttcatagaatgctgagcactctttctggcaaatatgagtattcaatttgttgggaaacagagatcccaaaaggcttatattgactggamaaggagttgctttttttaagtgtgtttttttccttttattgtctgccttgttcattcacctagtatattagtccatttccacactgctgataaagacagtccctagactgggtaatttagaaaggaaagaggttgttgacaaatgggatctaattaaagagcttctgcacagcaaaagaaactaccatcagagtgaacaggcaacctacagaatgggagaaaatgtttacaatctacccatctgacaaagggctaatatccagaatctacaaagaactcaaacaaatttacaagaaaaaa

SEQ ID NO: 60618 - DNA, 601 bp, Human
tggttgagcttttagagataatggggaactagggagtactaaatcacagatttggtcccatttttacttatccaagacgaacataagaaattcaatgggaaaggaattcacctggggctctttgagaaataatgagctaaatgtattggagacgtaagtgagaaaggccagcagtcagcagttctgtgctcatcaaattcaggttatgcacagtccttttcctagatatgtatggtagtcttacagatgtggcacatctggtctccagagatgcacctctcccaacccatgagccatatascctgtattcctgtctttgtacagtcctctcccttgaatctgggctgcctccgtgactcacttttggcaggtctaacgtggtgaaagttatgccatgtgactttcaaggttaggtgagaagctttgcagctccttagggtttcttggaatgcttgttcttgggatgctgtctcttggaacccagaaaacaagctgtgagaagctcaagctatacacagcggtcacatgtttttctgtggtcaccatccccagctgagctaccaggtgacagccagcactgtctgccacttgggtgagccat

SEQ ID NO: 60619 - DNA, 601 bp, Human
agtccttttcctagatatgtatggtagtcttacagatgtggcacatctggtctccagagatgcacctctcccaacccatgagccatataccctgtattcctgtctttgtacagtcctctcccttgaatctgggctgcctccgtgactcacttttggcaggtctaacgtggtgaaagttatgccatgtgactttcaaggttaggtgagaagctttgcagctccttagggtttcttggaatgcttgttcttgggatgctgtctcttggaacccagaaaacaagctgtgagaagctcaagctayacacagcggtcacatgtttttctgtggtcaccatccccagctgagctaccaggtgacagccagcactgtctgccacttgggtgagccatcatggatgtccagctaagatatccagctaaggcttgaataaggcttcacatggcagccccagcagctatctgactgttaccatgtcagagtcctcaaatgaaaactgcccaactgagctcaatgaatacacagaaccataagataataagttgttcttttaagctatcaagttctgggagagtttgttacacagcagttgataactggtac

SEQ ID NO: 60620 - DNA, 601 bp, Human
tgaagtctccatttttttgtttttgcttttcttacttttgacatactataaactcgatcctttcaaatagctttatggaataatattgctgttcattagtttttaaatcataaccttacagatgaaattcttaagtgtattgtcaacccttttgtagtctggtgaagcctacggaagtcttttattattaagtgaataataagaaatttgtagaatcacagaagaaaccaatcatgtgggaacacagtttttgaaatactttaaaacccaaatctgtggtgtagtaatatatgtacatctrtgaacacattaaataacactattgatgggcacaattataattttgaagtaccaataaacataatcattttctaacattttgtaacattttagcatggacatttttaaacatgcagcaaagttgatcccacaaagaatatctgtatactcactgcctagactctcccattaacattacttatgctgccgggcgcagtggctcacgcctgtaatcccagcactttgggaggccaaggcgggcggatcacgaggtcaggagatccagaccatcctggctaacacggtgaaaccccgtctctac

SEQ ID NO: 60621 - DNA, 601 bp, Human
aaatatgttttttgaggagtcctggaacattattatttttaaaataagtaggaaccataattccaaagaattcttagacacataagggcaacatatggtcctttaaaaatatatagatgagcaattcttttagagtaggttgaaagagactgaaagaaaaaaatccagatgccatttgatttcagtgagagaagagtctaaaaagcactcctttgacttaatagatcttttttgagaggtatatgacatctctgtatcttaatttccttctctttaaagtttttttcttttttctttttcytttttttttttttttttttttttttagcctcagcctcctaagtagctgggactgtaagcgcgcgccaccatgcctggctaatttttgtatttttatagacacggggtttcaccgtgttggtcaggccggtcccaaactcctgacctcaggtgatccgcccacctcggcctccgaaaatgctgggattacaggcatgagccactgagcctggcctccttttctttaaagtgtttatgttaatacctatttcccagattgcttgaggctgagtatatataaatgtctttgtgcatataatag

SEQ ID NO: 60622 - DNA, 601 bp, Human
aaaaactcaatgaaataaaataataacatgcatttcttctgttgtaactgacctttcaatctaaaagaacatcagaatttggaagaaaaagtaaaaagtgaaatagatggttccttccacctctatttgtttctgagcagcttctggtggccaaatgttttcttggtagcatattccctccagcagaaccttccagaatgcttcactccggtgaagagaaggacaacaggctttctaatcacacggtgttgcttgctgagggggaaggcagaggtccgcctgtataatccgatttcatcarctcacactaatcactactgatagtagcaaaatttagcctggatctgcgctgttaatctagattgacaggaggtaaaaggagaggaacgcaagggcacaggaacaaagggcggagcgccagcactgatttccagccttgctcttccgtctggggcttctaatttggtcccctttggggcttctatttttcttaccttataaacaaatgtccctggttgttaggataccagcctttcatggagcggtttcatcaacaacaggtgcgcagtgagcttctggaactgcagggagagcgataacc

SEQ ID NO: 60623 - DNA, 601 bp, Human
tttgtttctgagcagcttctggtggccaaatgttttcttggtagcatattccctccagcagaaccttccagaatgcttcactccggtgaagagaaggacaacaggctttctaatcacacggtgttgcttgctgagggggaaggcagaggtccgcctgtataatccgatttcatcaactcacactaatcactactgatagtagcaaaatttagcctggatctgcgctgttaatctagattgacaggaggtaaaaggagaggaacgcaagggcacaggaacaaagggcggagcgccagcactsatttccagccttgctcttccgtctggggcttctaatttggtcccctttggggcttctatttttcttaccttataaacaaatgtccctggttgttaggataccagcctttcatggagcggtttcatcaacaacaggtgcgcagtgagcttctggaactgcagggagagcgataacctacgtcgtgaggctgcgcagaaggtacttacaggtactcattgtacctgagactatgtattatttattgaaactgagccctgaattatctttatcctctgagcggcactagtgcctcctaaaatg

SEQ ID NO: 60624 - DNA, 601 bp, Human
cctagatttcttttttggggtaagtcaaatgttaagggtagaatatgtgattttcattattcagtgatattgttggtgtgttccttttttccttggaaacaagatagcatagctgtttcttaattttacgtatctaagtaattgccctcaatcaatgatagacatgtataaagtttaacatttcagtaataacaacggcatgttaatcctaatcaaatttgactccttaatattgtttcaaggtggctgggtgcagtggctcacgcctgtaatcccagtactttaggaggccgaggcgggyagatcacgaggtcaagagttcgagaccagcctggccaatatggtaaaaccccgtccctactaaaaataccaaaattagctaggcctggtggcgagtgcctatagttccagctactcaggaggctgaggcagaagaatcgcttgaacccaggaggtggaggttgcagtgagctgagatcgggccactgcactccagcctgggagacagagtgagactccatctcaaaataaaataaaattatatatatagatttaaggtagtttcctaccaaaaacacaaaacctaccagattgagctcag

SEQ ID NO: 60625 - DNA, 601 bp, Human
cttcttgtagttcaactgcactgtgagaggggcagatggataatccctcatttaaaggtaagaggtaaagcagaggtaataagaatggcgggtttcttccactctgcaaaaactgctgtatgggctgtgtgggcacacctttgagctcttagatggagacgagctcagggatagtgcctttggagaaaaggttggagagattgcactgtgagaggcttcaaatcaagttaccaagtaaataatgagtgcagcacaccaacatggcacatgtatacacatgtaacaaacctgcacgttgtgyacatgtaccctaaaacttaaagtatactaaaaaaaaaaaaaataaaaaataaaagaaaagaaaaaataaaaagaaaaaaataaaataaaaaaagaaaaaaaaagttaccaagtaaatattaacccttttgcaagaattcattaaaactaggagcaccagaagtcgcatataatgcctcttgcccacaattcttaatagttctctttctttctcagaagtgttctggattggacaatacatggcatgctcactctaattgtcataacagagtacgggtggatgatcatggtgggaaggagt

SEQ ID NO: 60626 - DNA, 601 bp, Human
aatcaaaatgaaatcactcatttagcagtcaaagttgtagaacagactttgagatattgtcccagtgatgcccagaacctgaatagcagcagtccagggaagtttgatggggtcaggggtgggtcggggggcgctttgttgctgtagcagtcttccaagctgcttgcagatctgcagcatagcagcagcagaagcgatagcgcctgtatttaaatgtgaatgacattatacaaaatatacttgcatgcacgtttatagcagcagaattcgcaattgcaaaaatgtggaaccaacccaaatrcccatcaataaacgagtggatagagaaactgtgcgatatgtacgcaatggaatactactcagacataaaaaggaatgaattaatggcatttacagcaacctggatgggattggatactgttatcctaagggaagtaactcagggatgggaaaccaaacattatattcatatgttctcaaccgtaagtggcagctaagctatgaggatgcaaaggcataagaatggcataatggactttgaggactcagggggaaagggtgggaagggggtgagggataaaagactacaagttgggttcag

SEQ ID NO: 60627 - DNA, 601 bp, Human
cagcagcagaagcgatagcgcctgtatttaaatgtgaatgacattatacaaaatatacttgcatgcacgtttatagcagcagaattcgcaattgcaaaaatgtggaaccaacccaaatgcccatcaataaacgagtggatagagaaactgtgcgatatgtacgcaatggaatactactcagacataaaaaggaatgaattaatggcatttacagcaacctggatgggattggatactgttatcctaagggaagtaactcagggatgggaaaccaaacattatattcatatgttctcaaccstaagtggcagctaagctatgaggatgcaaaggcataagaatggcataatggactttgaggactcagggggaaagggtgggaagggggtgagggataaaagactacaagttgggttcagtgtatactgctcaggtgatgcgtgcaccaaaatctcacacatcaccactaaagaaacttactcatgtaaccgaacaccacctgttccctaaaacctatggaaataaaaaataaaaaataaaactaaaatgcaaatgacaggtgtgcagtagacttttctagacttgcaggcatattgcagct

SEQ ID NO: 60628 - DNA, 601 bp, Human
cgtaagtggcagctaagctatgaggatgcaaaggcataagaatggcataatggactttgaggactcagggggaaagggtgggaagggggtgagggataaaagactacaagttgggttcagtgtatactgctcaggtgatgcgtgcaccaaaatctcacacatcaccactaaagaaacttactcatgtaaccgaacaccacctgttccctaaaacctatggaaataaaaaataaaaaataaaactaaaatgcaaatgacaggtgtgcagtagacttttctagacttgcaggcatattgcagytttgtgtaatctgtgctgaacagagatcgcatctctcttcataaagctcttttatagtttcacacctgtaatcagctgtcctttaaactctgaagcttcacgggggtctccttagactcgttagtctcatggtggcactcacagtggaggatgtccttgttggctactggtgtcacctttggagttgaaggaatagacagtttattcttgtttttgcttttctctcatggctgtgcgggagtgctggcaaaaagataaggatgtgagaaatgtttaagaaagggagaaggccaggcatgg

SEQ ID NO: 60629 - DNA, 601 bp, Human
ttataggtgtgagccacttcacccggcctaatcagtgttttcatacgtagaattgcaagtcatggtggcagtggacaagtttatttctcaatacacaatgggcaagtatattatctcaaatgaggaaatgaactatgtttataccacctaagagttgtggagcttaaaaaaagtattcagcacatttaagaaaggtattaaatacattttgtttcaaatattgcattgaaaacattgtttgtttccccaaatttccaggtgaaggataagcctgtgctctttttcactccattttttttttcccaatgtaacctaaacctgttaatatctatattcagcaaagctgccctggttgcctggcaaccaggcttcgtgggctagggaaacaccaaggcaaggaaccaaaggcagcgaacacaaccttgactttgcctgccgctgcacaggcgatcatcctctctgtattctgtataaagctctatttccaaaacataagtaaatcttgcaagaatgtagctcgatgctattaggagtttaaaacttacggtttgtgggataacatttcaacataattaaataagcatgaagaaatctctctctc

SEQ ID NO: 60630 - DNA, 601 bp, Human
aataatataaggtaaaacatgtaactggggctgttgaagtggagatttggctaagtatgacaaaaatgagaacagaatacagagaaaattaactcaataatatctcagcacaaatcctcgaaatctgcaatgaacgtatcttttgattcctaagtcatgaaagaagacagtctttcattattactttgccatgtaatagccatttatatcaatttcacattctactttcttctatccttattccatagctggtgtgagttagttttcaagacaaactggaagtcccaattttaagtaacayctcctaatttgtaagtgttggcttcagtaaaaattaacaacctcactctgtaggtcaaacagaacccatctggaagccaggttatgctcatggttgacatttgtgaccccaggtatagggggagaagaagggtaactgaggaattctcacgtgttaagaggctgcatataaaaatgataagtgttgggaggccgaggtgggaggatcgcttgagcccaggagttggaggctgcagtgagctatgattgtgccactgtactccagcctggacagcagaccgagaccccatctctaaaaaaa

SEQ ID NO: 60631 - DNA, 601 bp, Human
ggacagtcaaatattttaacttggagtgtgaaacactaaattaatcacacagtaacttcaggctgttattagccttttatggtcaatgaatattgattgttgagtgaatcaatgattggacacacgttatacatggattttatcacttggaaactctataattatcatactaaattcccgatattgtggttaatagctttctagaaaaaagagttgttataaaaccataatgtattactgttaaaagttgggattcggggaaaagtaagagctgtataattaatccacctatcaaaaaatratcctaattaatatttttattgttagtgaatttgaatgttagttgaattgttcattttggataaggagattacaaagatgtttgactctgttcacaacatggggaaaatgattgggctatctgagactgagttatcaatagagtatactttttgtttgttacatcagtaaatatcagggttttttttttctgtttttcctccttcttcaagtctgaaaaattatttgcctagaaggggaaacatattcagacaattgaaattccacagttcatcttcccacatttgtgagaaaaaaaaaa

SEQ ID NO: 60632 - DNA, 601 bp, Human
tactttaaaaatacaaaaattagcagggtgtggtggcacacatctgtaatcccagctacttgggaggctgaaacaggagaattgctcaaacttgggaggtggaggttgcagtgagccaagatcacaccactgcactccagcctgggcaacagagcgagactctgtcaaaaacaaaacaaaacaaaacaaaacaaaaacaaaaacagtgggccagtcactgtagctcacgcctgtaatcccagtgctttgggaggacaaggcaggaggattgcttgagcccaggagtttgagatcagcctgrgcagcaaaaagagaccttgtctctatttaaaaaaaaaaaaaaaaaaaaaaaaaaaaaacattttttttttttttaattagccagatgcagtggtgcctgcctgtggtcccagttgctctggagcctgaggtgggagggtaacttgagcacagaggttcaaggctgcagtcagctatgatggtgccactgcactccaacctgtgtgctagagtaggatcctgtcccaaagaaacaaaacaaaatgaaactaaaaagagtggtgtgttggtaaatgtttaatattccactatccaaaaaata

SEQ ID NO: 60633 - DNA, 601 bp, Human
cttgggaggctgaaacaggagaattgctcaaacttgggaggtggaggttgcagtgagccaagatcacaccactgcactccagcctgggcaacagagcgagactctgtcaaaaacaaaacaaaacaaaacaaaacaaaaacaaaaacagtgggccagtcactgtagctcacgcctgtaatcccagtgctttgggaggacaaggcaggaggattgcttgagcccaggagtttgagatcagcctgagcagcaaaaagagaccttgtctctatttaaaaaaaaaaaaaaaaaaaaaaaaaaaaaacattttttttttttttaattagccagatgcagtggtgcctgcctgtggtcccagttgctctggagcctgaggtgggagggtaacttgagcacagaggttcaaggctgcagtcagctatgatggtgccactgcactccaacctgtgtgctagagtaggatcctgtcccaaagaaacaaaacaaaatgaaactaaaaagagtggtgtgttggtaaatgtttaatattccactatccaaaaaataaagaagaaaataagttctgatgtgtagcgctttccaatttccatggtataaatactcc

SEQ ID NO: 60634 - DNA, 601 bp, Human
tgggaggctgaaacaggagaattgctcaaacttgggaggtggaggttgcagtgagccaagatcacaccactgcactccagcctgggcaacagagcgagactctgtcaaaaacaaaacaaaacaaaacaaaacaaaaacaaaaacagtgggccagtcactgtagctcacgcctgtaatcccagtgctttgggaggacaaggcaggaggattgcttgagcccaggagtttgagatcagcctgagcagcaaaaagagaccttgtctctatttaaaaaaaaaaaaaaaaaaaaaaaaaaaaaacattttttttttttttaattagccagatgcagtggtgcctgcctgtggtcccagttgctctggagcctgaggtgggagggtaacttgagcacagaggttcaaggctgcagtcagctatgatggtgccactgcactccaacctgtgtgctagagtaggatcctgtcccaaagaaacaaaacaaaatgaaactaaaaagagtggtgtgttggtaaatgtttaatattccactatccaaaaaataaagaagaaaataagttctgatgtgtagcgctttccaatttccatggtataaatactccca

SEQ ID NO: 60635 - DNA, 601 bp, Human
aggagaattgctcaaacttgggaggtggaggttgcagtgagccaagatcacaccactgcactccagcctgggcaacagagcgagactctgtcaaaaacaaaacaaaacaaaacaaaacaaaaacaaaaacagtgggccagtcactgtagctcacgcctgtaatcccagtgctttgggaggacaaggcaggaggattgcttgagcccaggagtttgagatcagcctgagcagcaaaaagagaccttgtctctatttaaaaaaaaaaaaaaaaaaaaaaaaaaaaaacattttttttttttttaattagccagatgcagtggtgcctgcctgtggtcccagttgctctggagcctgaggtgggagggtaacttgagcacagaggttcaaggctgcagtcagctatgatggtgccactgcactccaacctgtgtgctagagtaggatcctgtcccaaagaaacaaaacaaaatgaaactaaaaagagtggtgtgttggtaaatgtttaatattccactatccaaaaaataaagaagaaaataagttctgatgtgtagcgctttccaatttccatggtataaatactcccaccatggacaacttc

SEQ ID NO: 60636 - DNA, 601 bp, Human
tacatttacatatatatgtaaattctctaaaggttaataggtacttgaaacatctatttcccaggtgttttaaagtaattttttgcagtattagcatctacttattcaattccctagttctagtatctaaaacaggagctggtataaattaagttctcaataatgttgggtagctgcctagtcctaacaatgtgaaataggcctgataaatcaaaggaaagttcagttagcctgtattatctcaaattatctctgaattaaaaatctgtattgataactagaaaaggtctttctttttttyttcccccctctctttttttttttttaagacagagtctcgcactgtcacccaggctagactgcagtggtgtggccatagctcattacagcctccaacttccaggctcaggcaatcttcccacctcagcttcctgagtagctaggactacagatacatggcactatgcctggttaaattttgtattcgttgtagtgccaatttcaccatgttgcctcagctggtcttggacccctgggctaaagcaatccacccacctcagcttcccagggtgctggaattacaggcatgagccaccagacc

SEQ ID NO: 60637 - DNA, 601 bp, Human
ctcttctttgtgtccaggtgtacccaatgtttagctcccactcgtgagaacatgtagaatttgattttctgttactgtattaatttgcctaggttcttggcctctagctgcatccatgtggctgcaaaggacatgattttattcttttttatggctgcatagtatcctgtgggtgtatatgtatcacattttctttatccagtgcaccagcaacaggtgcctgggttgattcctcatcttggctattgtgaacagtgctgcgatgaacatatgagtgcaggtgtcttttggtagaatgatrtgaccctaaggaacatccattctttcttgaaaatttctgacatttatttattcatttattccatacatatttattgagtgctcctctgttccagccattgctctggacattgggaaatcagctatgaataaagaacatgaggtctttatgctctaaaagaatctattttaacctaggaatacagcttacaagggacctgaagtacctcttcaaggagaactacgaaccactgctcaagaaaataataggacacaaacaaatgggaaaacattctatgctcatggataggaagattcaata

SEQ ID NO: 60638 - DNA, 601 bp, Human
cctccaactgatggcatttattgattagatcaacttggggtataagtgcagtgatgtaactagactttgagagattgtcttaggttatgttttgactatgcatgtatttgagaataccacagtacttagaaaatttaatttatttcaccagctaccagaagtatgacaaattagtgattgacaaggcaattgctagtgggaaaaaaaaatgaataagacctactgtttgacagcacaatagggtgactatagtcaataataacttagttgtacatttttaaatcacttgaagagtataaakggactgtttgtaactcacaggacaaatgcttgggggcatggacaccccatgctccgtgatgtgcttatttcatattgcatgcctgtatcaaaacatctcatgtaccccacaaataaatacacatactgtgtactcacaaactttttttttaaaggagagaaggcagttggtgtttggtattttaatcacctcactagtgtggatatgtgacaatcataggagccattacctcatattaggtcctggcctgttgatgcatcttttgccctctgcccctctttttgaattgtttttgggatt

SEQ ID NO: 60639 - DNA, 601 bp, Human
gaaattttgaatttaataaaatacaaacatgacagtctaaagtttaaaatacttaaacataaagctttgccacacgaggactgactgtttgggtcttcggatttggtttagaacttttaaagaaaagactttattattatttattggtgcctttttaggaaaggatgaaaacatgcacaaaaaaaaccctgaacctaaaactaaaccagagcccgtaaaaataaaagtcataaagttacaaatatctgtgctaataggacatgaaaataccattttaaaattaatagtttgtctaaaaatyattttaagtacttcttttgtttctaattgttccaacctatactaaatttagtataatagagaaaaaaatgcttgctaggaaatatctttgtggtcatttcttctatgttgtatcatataaaactggaaactgagatactttttatgtgattttgatgattcttttattagattttactttaagttttctaaagatacagaattttacttgctgagttggccctcattaagtattgtacgtgacaattctatttctttaggttctgacatggctggcaatgtatacactaattatcaacgg

SEQ ID NO: 60640 - DNA, 601 bp, Human
catgaaataactgctatattttttcctgcagcggaattctgtgaattacgaaaacatgtataacctaaaatgcaaattgccaaatacattccattggccattttgaatattttcagcaacaaaactggtcacaattatgtcacagttatttaataagaatgacaatctatatgatattaaatagtcacgaggccaggtatggtggctcacacctgtaatcccaaaagtttgggaggccaaggtgggaggatcgcttgaggccagaagctagagaccagcctgggcagcatagcaagatctktgtctacagaaataatagttatcacatgaataatttatcctacaattaattttagtcctatctttaagtatcatggggaatctgcacagggatgtttagtcttttaaattacttctttcctaaaaatagactttttgtttcctatggcctggctacctctcattttaactaataagtatgcttgaatagggcttataaacacatggatttttggatttttgaatggttaaagtttaaaacaactctttttaaagtctttataaccattcaacactttaaattcagtctttctcaaagttc

SEQ ID NO: 60641 - DNA, 601 bp, Human
aagtgatgagttgagtttttatttgcatattggaggacagggagagagattaaatgtcccccttgtgaagtgtgacttctaattggagacctgtgggtcagctatcagcgggctgggaggggaaagcaaatacaaacgctctaaaactgtgtgcaaatatttcagtctctgcatatgtgaacattttctagcttctgccaattatcaaagtggtcctcaacttctaaatggtaataaataaataaatctgagtgggcgtaaacctgagacaacaaataagatgatgatgatgaagtattckaagaaggctagtaattttgggtcgattattttttcttcctctttaattttatattgctcaagcatttatcaaaaaaaaaaaaaaaaagaaagttagcatgtgactgtgtattcctgtatgttataagacaaataatgatctaaggctgcaggcttctacatcactcttcagatataatttgtatttaaatgtaagtataatgtccataaggcctggtggctaatgtatgtacatggagatgctggcttcagcatcaagaggagccatcctgtttgattttactttgccccataaaacgat

SEQ ID NO: 60642 - DNA, 601 bp, Human
caaaaagcttttgactttattcagatatctcacttatttttgacagggagctaataaccattacggagaataaggaaaaggtcacatctgaccgaagcacgcttagtatgaaaagtgcattctgtctcacctttctgttcatagattttacattgtcaggggcagcacaagccaacatatcatcacatttctgttgtttcagggctggcagggcctggcagagaccctgtgcctttgtagcttcctgcagggctccccctccagtggccattcagagatcttccactctcctcttaagagktggagaactggaactttcttttatttgtttgaggtggagtctcactctgtttcccaggctggagtgcagtggcgcgatctcagctcactgcaacgtctgcctcccgggttcaaacgattctcctgcctcagcctcttgagtagctgggattacaggtgcccgccaccacgcctggctaatttttgtatgtttagtagagacgggctttcaccatgttggccaggctggtctcaaactcctgacctcgagttccactcgcctcggcctcccaaagtgctgggattacgggcgtgagccact

SEQ ID NO: 60643 - DNA, 601 bp, Human
atgcaacctccgcctcccagatgtaagcaattctcctgcctcagcctcctgagtagctgggactacaggcgcatgccgccatgcccgtctaattttttttttttttttgtattttagtagagaccaagttgcccaggcttgtcacgaactcctgagctcaggcaatccgcccaccttggcctctcaaagtgctgggattacaggcttgagccaccatgcccagccaagattttattcttaattctagcactggctccttagtttttgagcaagttgattaacatctctaggctttttttttccccctatacaatgaaggcaataatttttatctctctactgctctgtctggaaggctataaaagcctatacgggtaatgcagtatccttaaagcatctgagaatagctgtccctagttttgtctttactttgaagcctgagtaattacttaaggaatgtaccttgaatcttgagaccatgtttctaacaacacaggtatttctgcaacctgaaatctgatgagcctgagatcctttctgttggacccaggttgaggactattttcgtgacttcgcttaatgagatttaatgttcaatata

SEQ ID NO: 60644 - DNA, 601 bp, Human
atgccgccatgcccgtctaattttttttttttttttgtattttagtagagaccaagttgcccaggcttgtcacgaactcctgagctcaggcaatccgcccaccttggcctctcaaagtgctgggattacaggcttgagccaccatgcccagccaagattttattcttaattctagcactggctccttagtttttgagcaagttgattaacatctctaggctttttttttccccctatacaatgaaggcaataatttttatctctctactgctctgtctggaaggctataaaagcctatacrggtaatgcagtatccttaaagcatctgagaatagctgtccctagttttgtctttactttgaagcctgagtaattacttaaggaatgtaccttgaatcttgagaccatgtttctaacaacacaggtatttctgcaacctgaaatctgatgagcctgagatcctttctgttggacccaggttgaggactattttcgtgacttcgcttaatgagatttaatgttcaatataaacacttgaaaggaatttttcaaggctaaattctacatcagaaggttttgagcgtcgtgcacagctcaactt

SEQ ID NO: 60645 - DNA, 601 bp, Human
aagcatctgagaatagctgtccctagttttgtctttactttgaagcctgagtaattacttaaggaatgtaccttgaatcttgagaccatgtttctaacaacacaggtatttctgcaacctgaaatctgatgagcctgagatcctttctgttggacccaggttgaggactattttcgtgacttcgcttaatgagatttaatgttcaatataaacacttgaaaggaatttttcaaggctaaattctacatcagaaggttttgagcgtcgtgcacagctcaacttccaagtcttttacagtggkctgtgaataattaatgctgatttgatatctgggcattcttttaaaaaacgtgtatatccacccaaatataacaatatagaaaaaagaagagcctcatgatattgcccaaaattttaatgactcacatgtgatatgctgagtactatctaggtgaagttaaatgtggcctctgttgacgaaattgccacttacttggataacataacaagataaaaacacgtttgcaacgatgtacattttgagaaatcatgaatttctgcattgtagacataaatatttaaagaactctccgggtaaaag

SEQ ID NO: 60646 - DNA, 601 bp, Human
ctgggactacaggtgtgcaccaccatgcccggctatttttgtatttttagtagagatggtgtttcaccagtttggccaggctggtctggaattcctgacctcaggtgatccacccgccttggcctctcaaaatgctgagattacaggtttgagccactgtgcccagatacaaagtttatattttaaagagacctcagaactaggccaggcaagatggctgatgcctgtaatcctagcactttaggaggccaaggtgggaagatcgtttgagctcgggagtttgagaccagcctgggcaacrtagggagaccctgtctctacaaatatattttaaaaatcagccacatgtggtggtgtgtgcctgtgatcccagctccttgggaggctgaggtgagagatcacttgactcccggaagttgaggctgcagtgagctgtgatcgtgcttctgcactccagcccgagtgacagaatgagtcccaccaaacagaacaaagggacctcagcctttcttcacttctttgttcttcatatgaagggtgggcattcacaggacattgcaggaggtgtgataagattcagagttccccatacagcctccac

SEQ ID NO: 60647 - DNA, 601 bp, Human
gtgggtggatcacctgaggtcaggagtttgagaccagcctggccaacatggtgaaaccctgtctctactaaaaatacaaaaaattagccaggcatggtggcgagtgcctgtaatcccagctactcaggagggtgaggcaggagaatcgcttgaacccaggagatggaggttgcagtgagccgagattgtgccattgcactccagcctgggcaacaagagcaaaactcagtctcaaaaaaatttttttaaaataataaaaataataataataattctcataacaacccagtgaagtagacayatgatcatctctagttggcagataaagcatctcagcacagtcaagtttgtcactagcgtggggtcccacaggtgtccgtggaaaaagcaggaattggaagcaaaagggcagcctcttccatgcacgcagcccacacagcactgcctgtgcctccttgttgtttttgtttgttttgcctctggtgactgcactttctaatggccccagctgctagagcagtcgacgttccctcaggagtagcgctttaggttcccttaatcttcacccaggggtacctccttgaccttgaaccctgcaggt

SEQ ID NO: 60648 - DNA, 601 bp, Human
aaaactcagtctcaaaaaaatttttttaaaataataaaaataataataataattctcataacaacccagtgaagtagacacatgatcatctctagttggcagataaagcatctcagcacagtcaagtttgtcactagcgtggggtcccacaggtgtccgtggaaaaagcaggaattggaagcaaaagggcagcctcttccatgcacgcagcccacacagcactgcctgtgcctccttgttgtttttgtttgttttgcctctggtgactgcactttctaatggccccagctgctagagcagycgacgttccctcaggagtagcgctttaggttcccttaatcttcacccaggggtacctccttgaccttgaaccctgcaggtcctgtagcaggaggtgagattgcccatcagccctccaggagtccaccagacctggcaggccttcatgcagcagaacaaaaggccagctgtttatttcctaggcagagttcatgaaaatcaccccatgggtgtgataccaagatcatcttaaaattaacttgtgttttaaaaaccattttctgtttggttttttagtggtggtggttgtttttgagacagg

SEQ ID NO: 60649 - DNA, 601 bp, Human
ttttaactctgtaactttatgatataaacaaaatatgtaagcatttcttcacagttcgccgatctacgttgattcagtataaggtacacatcaaagtaaaattaaccaaagactctaatttgagggaataataaggcacatggttgataagaaagaatacaatattccaggggttatgaactattagcatttctgattcatggcaatccaatttgagagtataaatttggattaccagcttagttctgaaaaactttctttatactgctctatggcagctgagggcttccggttcatcacrtgtatctgtttagtctgctaactctgacaaaagccattatctattttttttgcccaaaggcattataaggaaatagtatgagcaaagttttctttctagtataaacaataaatcttactagccattgggcaaactcatattctggtgaatatttgaaaaagcttggcactcattaataccagcaagtgtccagtagcttgatgagtactttatagtatttaaatggaatgtatagtctgtcaaaaaactatagtaggccttaattagctgggtgacattggacaaattatccagagtcaa

SEQ ID NO: 60650 - DNA, 601 bp, Human
gtcgtttttttaaaaatgggacttctatatgtaactaacgatttggtgttagtgtgagctatgatttgttctcaggatcatgaatgatatcacacaaatgattacgacacttgaataaatgtggcctttatttaattttttgatgctattgcagagctgctgctaacattcagtcctagttataatcacaaaagtatctgccataagcccagctgattaggctctgcaagtttgatctgatttttctcttttttttttttttttatttttttgagacagagtcttgctctgtcgcccaggstggagtacagtggcgcgatctcggctcgctgcaacatttgcctcctgggttcaagcaattctctgcctcagcctcccgagtagctgggattacaggtgcctgccaccacgcctgcctcatttttttgtatttttagtggagacaggatttcaccatcttgaccagactggtcttgaactcctggcctcatgatccacccgcctctgcctcccaaaacactgggattacaggcgtgagccaccatgcccggcctctgattttttattctcctctgtaatgtccgagtcaactaacatgcac

SEQ ID NO: 60651 - DNA, 601 bp, Human
tggagtacagtggcgcgatctcggctcgctgcaacatttgcctcctgggttcaagcaattctctgcctcagcctcccgagtagctgggattacaggtgcctgccaccacgcctgcctcatttttttgtatttttagtggagacaggatttcaccatcttgaccagactggtcttgaactcctggcctcatgatccacccgcctctgcctcccaaaacactgggattacaggcgtgagccaccatgcccggcctctgattttttattctcctctgtaatgtccgagtcaactaacatgcacrtaaaatatgcaaaaaaccccacaactttctggaaggtttctgtaaggattgctccacggagactctggcaccccaaggctgcaggcccctggaggtcccaggagacctggatctctgcccactgccccatgcattgacacagccctcccttcccaccttccccgctgtaatattgcttacccatcttgattccttcaaggatgaagctgccataggctgggcctctgctcctgcttttttctgatgcttcattcatgcaactatcccaactgcccagcacccactttgcatcacgctagc

SEQ ID NO: 60652 - DNA, 601 bp, Human
gtgttagccaggatggtctcgatctcctgacctcgtgatccgcccgtctcggcctcccaaagtgctgggattacaggcgtgagccaccgcgcccggctgactcaatttcttttacctgtatttcagcactcgtcctttatcatcctgaagtgaaatgtatagttaatgcaaacaaccaacacacaaatttttaaaaaccatttgggtcaaaatactgacccaatgaataaaaagattaatttattctctggtaatgtgtatttcaatgggttattatgctggcataaccacactagaaaaygtgaggaagcagttccatggatagggccactgcatggacggattagcggtgatgtacacctacaggtgtgcggctattaaagacaatagttaacaatttggtaaagttccaaacaaagtacaatctttcattgattgtcacagtactttcatttctggaaaattcagtatattttacaactatgcgaaaagacttgtactcatatccaaaaaaagatttagattctaggttcagataattttatatttttcgcccacatgaattccagcaggatagtcaaagatcgtgagaggaggtgca

SEQ ID NO: 60653 - DNA, 601 bp, Human
ttcctatacaggtacaaggtggctgtgcttgagacatgccaagttttttttaactcagaatacttaccatataaatagagcaatagagtatgatagacaaagctggctaggaaataaaaagcagtggaaggaattcagtttgatgacaaagaagtgtgaattgcccttaagaaacaaacaatagaataaaatgagagcctgaaaataaataacttggttatttatagatttcttgtgtctgtcaatacagcatcacagaccaaaacatttaaattcaggggttttgttgttgctgctgttyttttcataaatatggccatattagaaaaactttacatggcgtttttctcttatgcaatcttttttatgtagcagtttcctgggaaatgttatgtcagctttaatacaggcctgaatttaactggcaaatagtgacacaaattgtcatgatggaaaagtaacatgttgggggttttaataaccactgaaatactgatagccattttcttttttttttaacttctacgttatttagggacctattttgcagacataaccttaaactaaaatatcccgtgtccattgagaagcctacccccac

SEQ ID NO: 60654 - DNA, 601 bp, Human
tgtttgtttgttttgacacagggtctccttctgtcacccaggctagagtgcagtggcgccatctcggctcactgcaacctctgcctcccaggttcaagtgattctcccacctcagcctccagagtagctgggactacaggtgtgtgccaccatgcccggctaatttttttttatttttagcagggatgagattttatcatgttggccaggctcgtcttgaattcctgacctaaagtgatccacccaccttggcctcccaaagtgttaggattaccagcatgaaccaccacacccagcctgragcttataagtaacattctgttttgttttttttttctttttcatactttaagttctggggtacacgtgcagaacatgcaggtttgttgcataggtatacatatgccatggtggcttgctgcacccatcaacctgtgatctacattaggtatttctcctaatgctgtccctcctctagccccccaccccccagcagtccccagtgtgagatgttcttaaactggcatgtttcttggccacatctcttgaattttaattattgtactttgaattattttgatgttaagattaacttttatgc

SEQ ID NO: 60655 - DNA, 601 bp, Human
acccaggctagagtgcagtggcgccatctcggctcactgcaacctctgcctcccaggttcaagtgattctcccacctcagcctccagagtagctgggactacaggtgtgtgccaccatgcccggctaatttttttttatttttagcagggatgagattttatcatgttggccaggctcgtcttgaattcctgacctaaagtgatccacccaccttggcctcccaaagtgttaggattaccagcatgaaccaccacacccagcctggagcttataagtaacattctgttttgttttttttttctttttcatactttaagttctggggtacacgtgcagaacatgcaggtttgttgcataggtatacatatgccatggtggcttgctgcacccatcaacctgtgatctacattaggtatttctcctaatgctgtccctcctctagccccccaccccccagcagtccccagtgtgagatgttcttaaactggcatgtttcttggccacatctcttgaattttaattattgtactttgaattattttgatgttaagattaacttttatgcttatgcttattgctgtcgtgagtggtactaaagag

SEQ ID NO: 60656 - DNA, 601 bp, Human
attctcccacctcagcctccagagtagctgggactacaggtgtgtgccaccatgcccggctaatttttttttatttttagcagggatgagattttatcatgttggccaggctcgtcttgaattcctgacctaaagtgatccacccaccttggcctcccaaagtgttaggattaccagcatgaaccaccacacccagcctggagcttataagtaacattctgttttgttttttttttctttttcatactttaagttctggggtacacgtgcagaacatgcaggtttgttgcataggtatacrtatgccatggtggcttgctgcacccatcaacctgtgatctacattaggtatttctcctaatgctgtccctcctctagccccccaccccccagcagtccccagtgtgagatgttcttaaactggcatgtttcttggccacatctcttgaattttaattattgtactttgaattattttgatgttaagattaacttttatgcttatgcttattgctgtcgtgagtggtactaaagagtcctgggttgtaaattgagccacgagtgcaaagaggaaattaaactattctatattcaaattaag

SEQ ID NO: 60657 - DNA, 601 bp, Human
aataggtgctgcctcctctcctatataaaggaggaaactgaggcacaaagagttcagtttaggtttattttaagagacagagtctcactctgttgcctaggctggagtgcagtagagcaataattacagcttactgcagcctcaaactcctgggctcaagcgatcctcttgcctcagcctcctgagtagctgggactacatgtgtgcaccactatacctggctaattttgttttttgtagggatggaatctcactttgttgcccgggctgatcttaaatcctggcttcaagggatcctcakgcctcagcctcacaaagtgctgggattacaggcatgcaccactgcacccagccttattttgttgttaaggcaatatttatgctgtgtttctaataattcacttatcactcacaagagtcctgtgaggcagacctattgtttttatttcacagagaagaaaactgaggcacagaactttaagtggcagctttgatcacggggctaagatatggtggccacacatagtcatgagtgaggagagcaggctccataacttgtcctcttagacgacttgctggctgtatattcccctgcatctgg

SEQ ID NO: 60658 - DNA, 601 bp, Human
gtagggatggaatctcactttgttgcccgggctgatcttaaatcctggcttcaagggatcctcaggcctcagcctcacaaagtgctgggattacaggcatgcaccactgcacccagccttattttgttgttaaggcaatatttatgctgtgtttctaataattcacttatcactcacaagagtcctgtgaggcagacctattgtttttatttcacagagaagaaaactgaggcacagaactttaagtggcagctttgatcacggggctaagatatggtggccacacatagtcatgagtgargagagcaggctccataacttgtcctcttagacgacttgctggctgtatattcccctgcatctggggtgtcagattatgcacctgctgaatacacagccagcaaggagcagaacaggactgtctgatttcaaaatctatgtcctttcccctatccttagctgcaaaaccagtgatattccctactcactgtgggaagaagcatgaatgccttcctaatcatcaaagccaagaggttttgtccacaattcaaattcctgctgacctttcttttctgttcattgttcatccctccttcatctc

SEQ ID NO: 60659 - DNA, 601 bp, Human
aacaattaacactcagtttatctagcagtggttcacctaatgattgaagcctctttcgagtgtttttgtatacatgcatacatcctattcttttcagccatattgtttttcttgttaaggacttcttaaacatgcttattaaaacattttcaacttaatttgtatttctaaaaagtcatgatgaattttgtttcagttatagctattaagggttttctaaagatcctctcttcaaaatgttttgttaggagcaatagatatttgtaaaatttatgaaaatttgactagttttttctaattstttacattgtgtgattactgtttcctccttgtttttttcccccaagtgattatattagtattctatttttgtcattttagagaatggacacagaagtcaccataggtgaattgacttaaaatcttttaagtataagaaaaatagcaaaaatgataacctgcgaagtgggtgatcaattttttaagtccataacgtgttaaaagtccataacaaatattgccatagaaaatgcatgtagaggctgggcgccgtggctcacgcctgtaattccagcacttcgggaggtcaggaatttgagac

SEQ ID NO: 60660 - DNA, 601 bp, Human
aaccagcttttcttcccatgaacagtaaaataggtttcctaaataaagattttgacatcccagccccttgtgttaaaatctgggatggctcattatttacaagatcaatttcaaaagtattagcctggcgttccaggctctcaacaggatggatggctcaggcttggcttttcagacataacacctatggtttctgtacaagcaccaagcagcacgtctactcacttgaggatgtcttgtacccagtcacccccgctttcttcctggttgaaatcctgtcgccccatggggccttctctgwtccccatggaagcttcatcctctgatcctcagtgccatatggtatttgttgtgctggttatttcttgacatgtctgtcttatgctttcaaagagtgtgcactctctgaaggttcagcatgaaactaccagtaccttccattcccttcagtcttctattctagtaagctcaaagctagcagttcaaagctagtatttaatagcatgtttaaaatatgtatatgactagacaatgtggccaaaggaagtgtctgagccagagggtctgaattcaggtctttgtctaacatactcattatagc

SEQ ID NO: 60661 - DNA, 601 bp, Human
tctactcacttgaggatgtcttgtacccagtcacccccgctttcttcctggttgaaatcctgtcgccccatggggccttctctgttccccatggaagcttcatcctctgatcctcagtgccatatggtatttgttgtgctggttatttcttgacatgtctgtcttatgctttcaaagagtgtgcactctctgaaggttcagcatgaaactaccagtaccttccattcccttcagtcttctattctagtaagctcaaagctagcagttcaaagctagtatttaatagcatgtttaaaatatrtatatgactagacaatgtggccaaaggaagtgtctgagccagagggtctgaattcaggtctttgtctaacatactcattatagctgtgtgacacttggtatggcacctaacctctctggaaatcagttcttttttttttttctttaaatagtaaggatagttataccaatcaaataggtttggtttaaaaacagatcattttggataagtgcattctatatcataaactgctttaaaaatgttaatactggcaatatttttattaatgctgttgcgaatagtagggtcttgaaggcagtt

SEQ ID NO: 60662 - DNA, 601 bp, Human
cttgttagtatgtataatagggtttaaaagtgatcggagattaaagaattatcataaaatccagaagtccatacaatttctcttgcacttaggatagcatttttttcaagtgctgttttatttgtaggcacagaattttggaatgttagtagtagaaagaggtgtataaattaatctaatccaatctacttgggttaaggatgaaagcagatgtctagagaagttaaggcacttgtcttggacctcagagttaattactgactgagttgatagttaagaccatttcctgagttcaacttaytcttgtctcattttttgctaaccactgtattgtgtttcctgcccctgagtttggttaagggcaccatctgggagttagtttgttttcagcatgcaatcaagctgattggctttgaacgagttatttacccctctggccttgacattctcatcagaatatgagaggacaatatagagattctttaaggcctctttttaattttcaacctttcttcatccatatttgacagttatttggtgacggccaattatttacaaataaaagcgatttggactcttacattcagtttgccttcatgtt

SEQ ID NO: 60663 - DNA, 601 bp, Human
acatttatcaatacacatagcaaaacagacagtaaatgtagtcacctgttccttgtatgcaaataaaagatgaagctaaactttaagagttagggatacatttttgaaattgtagaaagctatattaaaccatatacttctttgaaatagtatataattcaattcaaatttaataattatgtttctgcttccttaatatcttattgaattgtgatgtaatttaatttgattttagaaagacttaagaattctaagtttgactgttaagaaacgaacctatgttaaagaatatattttggcygtctggtcatattctactgaaaacgaaattccctttttaggtgcgtttgggggtacagtagaatgagattatttcactttttgtcatatggccaggaggaaagaaatttcttgaaaagcaactgagctctctcctgtaaacacagcaagttgaaatcgcacagctcctaatttggtgtctttatttcaatctttggagtaagattatgaacaatagctataattccattctgagagttaaaagttttcattgtaaatttcaaaatggtcatttctactaatatgggcattatttttccaa

SEQ ID NO: 60664 - DNA, 601 bp, Human
gcaaataaaagatgaagctaaactttaagagttagggatacatttttgaaattgtagaaagctatattaaaccatatacttctttgaaatagtatataattcaattcaaatttaataattatgtttctgcttccttaatatcttattgaattgtgatgtaatttaatttgattttagaaagacttaagaattctaagtttgactgttaagaaacgaacctatgttaaagaatatattttggccgtctggtcatattctactgaaaacgaaattccctttttaggtgcgtttgggggtacartagaatgagattatttcactttttgtcatatggccaggaggaaagaaatttcttgaaaagcaactgagctctctcctgtaaacacagcaagttgaaatcgcacagctcctaatttggtgtctttatttcaatctttggagtaagattatgaacaatagctataattccattctgagagttaaaagttttcattgtaaatttcaaaatggtcatttctactaatatgggcattatttttccaaagacccacttctgtctcttgtttttcgccctcgggtcactggcaatatggaaaaaaac

SEQ ID NO: 60665 - DNA, 601 bp, Human
gatgaagctaaactttaagagttagggatacatttttgaaattgtagaaagctatattaaaccatatacttctttgaaatagtatataattcaattcaaatttaataattatgtttctgcttccttaatatcttattgaattgtgatgtaatttaatttgattttagaaagacttaagaattctaagtttgactgttaagaaacgaacctatgttaaagaatatattttggccgtctggtcatattctactgaaaacgaaattccctttttaggtgcgtttgggggtacagtagaatgagmttatttcactttttgtcatatggccaggaggaaagaaatttcttgaaaagcaactgagctctctcctgtaaacacagcaagttgaaatcgcacagctcctaatttggtgtctttatttcaatctttggagtaagattatgaacaatagctataattccattctgagagttaaaagttttcattgtaaatttcaaaatggtcatttctactaatatgggcattatttttccaaagacccacttctgtctcttgtttttcgccctcgggtcactggcaatatggaaaaaaactttcaaaaga

SEQ ID NO: 60666 - DNA, 601 bp, Human
atgctctataatgaagaaaaaatatttaaagtatgtaatcatgttaaacagttacagcatgagtcactctatttaaaaaaaaagagagagaaccagtctgcacgtgacaacaagaacttaaaggatctggtgttcatttgaaatgtactggtaatttaacatcactgtaaattcattaacttaggtcattctggttattgagatcaaatttgaaatttttcttttgttaagtattcaaatgtttaaaagccctgtaaaccagatcagagtattaggacataaatttgagtgtgtttattcyttaaaatgaggtctacataactgttttaaaaattgcctctggtaattcttctaagtcttacagtaaaatttgccagaggcgtactatttaaattacaattaagctatcaaatttaaaaattactttttcatttcttttagttctgtttttctccccgtgaatcaaatattgtttgtgctactaataattttttgtggatttgtcattatttttgaatatttaaaatatcctgtactttgctgtagtataggtggcagtagtctaaaccttgatctttttaatgcattcacatcaggattt

SEQ ID NO: 60667 - DNA, 601 bp, Human
tgctctataatgaagaaaaaatatttaaagtatgtaatcatgttaaacagttacagcatgagtcactctatttaaaaaaaaagagagagaaccagtctgcacgtgacaacaagaacttaaaggatctggtgttcatttgaaatgtactggtaatttaacatcactgtaaattcattaacttaggtcattctggttattgagatcaaatttgaaatttttcttttgttaagtattcaaatgtttaaaagccctgtaaaccagatcagagtattaggacataaatttgagtgtgtttattccwtaaaatgaggtctacataactgttttaaaaattgcctctggtaattcttctaagtcttacagtaaaatttgccagaggcgtactatttaaattacaattaagctatcaaatttaaaaattactttttcatttcttttagttctgtttttctccccgtgaatcaaatattgtttgtgctactaataattttttgtggatttgtcattatttttgaatatttaaaatatcctgtactttgctgtagtataggtggcagtagtctaaaccttgatctttttaatgcattcacatcaggatttt

SEQ ID NO: 60668 - DNA, 601 bp, Human
atatgtcacatggtgaacattctcttacctaaatattttacgtgcatctttttctttcacaaagattccagaaaaagataattactgagtatttacttttaaaagagtaatatgtattcatacactgcttttcagaaaggttatactaaatttagacttccaacagccagcaatgtttgagttccactgtattactattatttaaaaatagttatttgatagacaaaaatattatctcattcttaaacatgtgcatatttctgattactgttaagtttactgtttttattttgttttttttaattatactttaagttttagggtacatgtacacaacgtgcaggtttgttacatatgtatacatgtgccatgttggtgtgctgcacccattaacttgtcatttaacattaggtatatctcctaatgctatccctcccccctttccccgaccccacaacgggccccggtgtgtgatgttccccttcctgtgtccatgtgttctcattgttcaattcccacctatgagtgagaacatgtggtgtttggtttttttgtccttgcgatagtttgctgagaatgatggtttccagcttcatccatg

SEQ ID NO: 60669 - DNA, 601 bp, Human
tgtattactattatttaaaaatagttatttgatagacaaaaatattatctcattcttaaacatgtgcatatttctgattactgttaagtttactgtttttattttgttttttttaattatactttaagttttagggtacatgtacacaacgtgcaggtttgttacatatgtatacatgtgccatgttggtgtgctgcacccattaacttgtcatttaacattaggtatatctcctaatgctatccctcccccctttccccgaccccacaacgggccccggtgtgtgatgttccccttcctrtgtccatgtgttctcattgttcaattcccacctatgagtgagaacatgtggtgtttggtttttttgtccttgcgatagtttgctgagaatgatggtttccagcttcatccatgtccctacaaaggacatgaacttttttatggctgcatagtattctatggtgtatatgtgccacattttcttaatccagtctatcattgttggacatttgggttggttccaagtctttgctattgtgaatagtgccacaataaacatacatgtgcatgtgtctttatagcagcatgatttataatcctt

SEQ ID NO: 60670 - DNA, 601 bp, Human
tttcttttgctgtgcagaaggtctttagttgaactggatcccatttgtcaattttggcttttgttgccattgcttttggtgttttagacatgaagtccttgcccatgcctatgtcctgaatggtattgcctaggttttcttctagggtttttatggttttaggtctaacatgtaagtttttaatccatcttgaattagtttttgtataaggtataaggaaggggtccagtttcatttttacttttattttgagatggagtttcactgttgtcacccaggctagagtgcaacggagtatctyggctcactgcaacctctgcctcccaggttcaagtgattctcctgcttcagcctaccaagtaactgggattacagatgtccgccactatgcctggctaatttttgtatttttagtagagacagggtttcaccatgttgaccaggctggccttgaacttctgacctcaggtcatccacccgccttcgcctcccaaagtgctgggattacagatatgagccactgtgcctagcgctgttttcatatttttaagccatatttccttcttcctcatttatgtgtccttggataagttatttaaac

SEQ ID NO: 60671 - DNA, 601 bp, Human
aaggtctttagttgaactggatcccatttgtcaattttggcttttgttgccattgcttttggtgttttagacatgaagtccttgcccatgcctatgtcctgaatggtattgcctaggttttcttctagggtttttatggttttaggtctaacatgtaagtttttaatccatcttgaattagtttttgtataaggtataaggaaggggtccagtttcatttttacttttattttgagatggagtttcactgttgtcacccaggctagagtgcaacggagtatctcggctcactgcaacctcygcctcccaggttcaagtgattctcctgcttcagcctaccaagtaactgggattacagatgtccgccactatgcctggctaatttttgtatttttagtagagacagggtttcaccatgttgaccaggctggccttgaacttctgacctcaggtcatccacccgccttcgcctcccaaagtgctgggattacagatatgagccactgtgcctagcgctgttttcatatttttaagccatatttccttcttcctcatttatgtgtccttggataagttatttaaactatctgcactttactgt

SEQ ID NO: 60672 - DNA, 601 bp, Human
gttgccattgcttttggtgttttagacatgaagtccttgcccatgcctatgtcctgaatggtattgcctaggttttcttctagggtttttatggttttaggtctaacatgtaagtttttaatccatcttgaattagtttttgtataaggtataaggaaggggtccagtttcatttttacttttattttgagatggagtttcactgttgtcacccaggctagagtgcaacggagtatctcggctcactgcaacctctgcctcccaggttcaagtgattctcctgcttcagcctaccaagtarctgggattacagatgtccgccactatgcctggctaatttttgtatttttagtagagacagggtttcaccatgttgaccaggctggccttgaacttctgacctcaggtcatccacccgccttcgcctcccaaagtgctgggattacagatatgagccactgtgcctagcgctgttttcatatttttaagccatatttccttcttcctcatttatgtgtccttggataagttatttaaactatctgcactttactgtcttcatcttaagttgctttgtaaggtcgctgaagaccaaatgagt

SEQ ID NO: 60673 - DNA, 601 bp, Human
gtgttttagacatgaagtccttgcccatgcctatgtcctgaatggtattgcctaggttttcttctagggtttttatggttttaggtctaacatgtaagtttttaatccatcttgaattagtttttgtataaggtataaggaaggggtccagtttcatttttacttttattttgagatggagtttcactgttgtcacccaggctagagtgcaacggagtatctcggctcactgcaacctctgcctcccaggttcaagtgattctcctgcttcagcctaccaagtaactgggattacagatgyccgccactatgcctggctaatttttgtatttttagtagagacagggtttcaccatgttgaccaggctggccttgaacttctgacctcaggtcatccacccgccttcgcctcccaaagtgctgggattacagatatgagccactgtgcctagcgctgttttcatatttttaagccatatttccttcttcctcatttatgtgtccttggataagttatttaaactatctgcactttactgtcttcatcttaagttgctttgtaaggtcgctgaagaccaaatgagttagtatatttcacata

SEQ ID NO: 60674 - DNA, 601 bp, Human
gtccgccactatgcctggctaatttttgtatttttagtagagacagggtttcaccatgttgaccaggctggccttgaacttctgacctcaggtcatccacccgccttcgcctcccaaagtgctgggattacagatatgagccactgtgcctagcgctgttttcatatttttaagccatatttccttcttcctcatttatgtgtccttggataagttatttaaactatctgcactttactgtcttcatcttaagttgctttgtaaggtcgctgaagaccaaatgagttagtatatttcacayactgggaacagcaggtgctgaataaattcttagctactattactcttagtccttggtatgacttttgtccactttctcagttgagtagctgagactacaagtgtgagtcaccacacccagcttattttttttattttattttttgtaggaatggagtctcactatgttgcccaggcaggtctgaaactcgtggcctcaagcgattctcccaccatggcctcccacagtgctaggattacaggtgtgagccacagcacccagccccatatttccctaaagactagcagaactcacctcagg

SEQ ID NO: 60675 - DNA, 601 bp, Human
atctgcactttactgtcttcatcttaagttgctttgtaaggtcgctgaagaccaaatgagttagtatatttcacatactgggaacagcaggtgctgaataaattcttagctactattactcttagtccttggtatgacttttgtccactttctcagttgagtagctgagactacaagtgtgagtcaccacacccagcttattttttttattttattttttgtaggaatggagtctcactatgttgcccaggcaggtctgaaactcgtggcctcaagcgattctcccaccatggcctcccamagtgctaggattacaggtgtgagccacagcacccagccccatatttccctaaagactagcagaactcacctcaggctgcactgtcaggaggttgtaaagaagcctctttttgagggttcctattatctgtgttagaggcagaaacttacccctctcctttcattcattcactcagcagggatttattaaacctttatgaaatccaggcactgctttctgctgctctgaactcaatgctgatttgttattgattctactgctatattttggtctcccaaacaaggtaggacagctttcctt

SEQ ID NO: 60676 - DNA, 601 bp, Human
tattttttttattttattttttgtaggaatggagtctcactatgttgcccaggcaggtctgaaactcgtggcctcaagcgattctcccaccatggcctcccacagtgctaggattacaggtgtgagccacagcacccagccccatatttccctaaagactagcagaactcacctcaggctgcactgtcaggaggttgtaaagaagcctctttttgagggttcctattatctgtgttagaggcagaaacttacccctctcctttcattcattcactcagcagggatttattaaacctttatraaatccaggcactgctttctgctgctctgaactcaatgctgatttgttattgattctactgctatattttggtctcccaaacaaggtaggacagctttccttaagggccttcaacccaccatgatgatagcagctattatttattgaatatttatggtaaggcattatattaagtgatgtacatatattattccaaacaatgtttttatatgcaaaatttacagatgaggaattcgaggcttaatgagtttgaaaaatgtgcccaagatcacatagttcataagaggtagaaccagaatt

SEQ ID NO: 60677 - DNA, 601 bp, Human
tccaaacaatgtttttatatgcaaaatttacagatgaggaattcgaggcttaatgagtttgaaaaatgtgcccaagatcacatagttcataagaggtagaaccagaattcaagcttgggccagccaactgcaaaatccaagcctcttcattgctttactctgttcctcccatgaagtcaccctcacaatttctcatttgttctctcaagcctttgaggttagcctagatgttccttcagatttttcattagtatttttttgatttatatttagttaatgcataagatgttagaattattartgcagttgctatgtgatttgctttgggggaagtatttatccagtagatctctactgaagacattggtgcttgtaccggttctctctccaagacaatactgatttccacacttccaaaacaaagttaagatgtaaaaacagagaatacagtgtgggaggaaatcttgaagacttgtgtagaggaatagaagcaaatgtaaacaaaataaataaattagcctccctctttcacactcccatattgcattgtaacactgtactgatttagagaaaaaatattataattaacagcatatcaggg

SEQ ID NO: 60678 - DNA, 601 bp, Human
caagatcacatagttcataagaggtagaaccagaattcaagcttgggccagccaactgcaaaatccaagcctcttcattgctttactctgttcctcccatgaagtcaccctcacaatttctcatttgttctctcaagcctttgaggttagcctagatgttccttcagatttttcattagtatttttttgatttatatttagttaatgcataagatgttagaattattaatgcagttgctatgtgatttgctttgggggaagtatttatccagtagatctctactgaagacattggtgcttrtaccggttctctctccaagacaatactgatttccacacttccaaaacaaagttaagatgtaaaaacagagaatacagtgtgggaggaaatcttgaagacttgtgtagaggaatagaagcaaatgtaaacaaaataaataaattagcctccctctttcacactcccatattgcattgtaacactgtactgatttagagaaaaaatattataattaacagcatatcagggatagatagaatggtagaggaagaagaagctatacagtgattaaagacataaagtactgttttgattgaggtg

SEQ ID NO: 60679 - DNA, 601 bp, Human
ttgctatgtgatttgctttgggggaagtatttatccagtagatctctactgaagacattggtgcttgtaccggttctctctccaagacaatactgatttccacacttccaaaacaaagttaagatgtaaaaacagagaatacagtgtgggaggaaatcttgaagacttgtgtagaggaatagaagcaaatgtaaacaaaataaataaattagcctccctctttcacactcccatattgcattgtaacactgtactgatttagagaaaaaatattataattaacagcatatcagggatagawagaatggtagaggaagaagaagctatacagtgattaaagacataaagtactgttttgattgaggtggaaaagcctgcagagatgattcacaaagctataaccagagcactggatgagcaagaaaagatttgaacatgaggtgttgcctctgaagtttccagaacagggaaggcttaggagaaagtcagtggatgaagagatgccaagtagaccagagggaaaaatggaatcacaagatcacctttcaaaggccgaagagagagggattgatcctgaattaataagaaagagaggtgtccc

SEQ ID NO: 60680 - DNA, 601 bp, Human
cagagatgattcacaaagctataaccagagcactggatgagcaagaaaagatttgaacatgaggtgttgcctctgaagtttccagaacagggaaggcttaggagaaagtcagtggatgaagagatgccaagtagaccagagggaaaaatggaatcacaagatcacctttcaaaggccgaagagagagggattgatcctgaattaataagaaagagaggtgtcccctgtgatgagtataaaggggaacaggtgacctgagagctgaaccagaggcaatatcaaattagtcaaggcaaggccsggtacagtggctcatgcctataatcccagcactttgggaggctgaggcaggaggatagcttgagcccagaagtttaagaccagactgggcagtatagtgagaccctgtctttattttttaaaaaatagaaaatttaaaagaaattagtcaaggctaaggtggtgtaatctgaataatcttttgaagtcctttgtcacctagataggctttttgtattctccacagtagttcaacactctgcatgatgtatgtagcatttcatgtcctgtgcaacagcagaatcacaatgtagcactaaat

SEQ ID NO: 60681 - DNA, 601 bp, Human
gatgattcacaaagctataaccagagcactggatgagcaagaaaagatttgaacatgaggtgttgcctctgaagtttccagaacagggaaggcttaggagaaagtcagtggatgaagagatgccaagtagaccagagggaaaaatggaatcacaagatcacctttcaaaggccgaagagagagggattgatcctgaattaataagaaagagaggtgtcccctgtgatgagtataaaggggaacaggtgacctgagagctgaaccagaggcaatatcaaattagtcaaggcaaggccgggtrcagtggctcatgcctataatcccagcactttgggaggctgaggcaggaggatagcttgagcccagaagtttaagaccagactgggcagtatagtgagaccctgtctttattttttaaaaaatagaaaatttaaaagaaattagtcaaggctaaggtggtgtaatctgaataatcttttgaagtcctttgtcacctagataggctttttgtattctccacagtagttcaacactctgcatgatgtatgtagcatttcatgtcctgtgcaacagcagaatcacaatgtagcactaaatgcca

SEQ ID NO: 60682 - DNA, 601 bp, Human
tgcctctgaagtttccagaacagggaaggcttaggagaaagtcagtggatgaagagatgccaagtagaccagagggaaaaatggaatcacaagatcacctttcaaaggccgaagagagagggattgatcctgaattaataagaaagagaggtgtcccctgtgatgagtataaaggggaacaggtgacctgagagctgaaccagaggcaatatcaaattagtcaaggcaaggccgggtacagtggctcatgcctataatcccagcactttgggaggctgaggcaggaggatagcttgagccmagaagtttaagaccagactgggcagtatagtgagaccctgtctttattttttaaaaaatagaaaatttaaaagaaattagtcaaggctaaggtggtgtaatctgaataatcttttgaagtcctttgtcacctagataggctttttgtattctccacagtagttcaacactctgcatgatgtatgtagcatttcatgtcctgtgcaacagcagaatcacaatgtagcactaaatgccactttccttatgcacacccactgtccttaatgtgttacttagcatcagctctatgcatagggta

SEQ ID NO: 60683 - DNA, 601 bp, Human
acccactgtccttaatgtgttacttagcatcagctctatgcatagggtacagcctccttcccagttttcagataaagaaactcagccttagaactgtaatgtaatttgtccagtagcccctagactctcagatttagtatttgtcagactaccccctaaagacagggtactttagtaaaagcaaaagcctgtgtccctaagatttagcctaaggagaaagttctactttctctgtttgttaaaacttgaaaatgcacacggcaacatggcaagaccccatctctacaaaaatttaaaaaaytagccaagagtggtggcacacacctgtggtcccagctactcgggaggcaggaagattgcttgagcccaggaggttgaggctacagtgagccatgatcataccactgcactcagcctgagcaacagagcaagaccctgtctcaaaaaataaaaaataattgggaagtgaatgtgtccaagtgtcttcttctcttttattttgtcctatgacttctccctcccaatcctgcaccaatgccatagggaaaaagatacatgtatctttattaagataaagataatctcaatgtgctaatgggga

SEQ ID NO: 60684 - DNA, 601 bp, Human
gggtactttagtaaaagcaaaagcctgtgtccctaagatttagcctaaggagaaagttctactttctctgtttgttaaaacttgaaaatgcacacggcaacatggcaagaccccatctctacaaaaatttaaaaaattagccaagagtggtggcacacacctgtggtcccagctactcgggaggcaggaagattgcttgagcccaggaggttgaggctacagtgagccatgatcataccactgcactcagcctgagcaacagagcaagaccctgtctcaaaaaataaaaaataattgggargtgaatgtgtccaagtgtcttcttctcttttattttgtcctatgacttctccctcccaatcctgcaccaatgccatagggaaaaagatacatgtatctttattaagataaagataatctcaatgtgctaatggggatgaagtctgttgttaaattcatcattttctaagtcttctgagaggtagtatttactctttggattgagctttcagacctatgcattgggaaaatgtcaggccatttaaactagaaaaagtagcttttaattgatgaagacctttgtatttattttccctgagta

SEQ ID NO: 60685 - DNA, 601 bp, Human
agaacagatggaggttgctcaaaaaactaaaaataaagctaccatatgatctagcaatccaatttctggatatatacccaaaagaaagggaattagtatttgggagagatatttgcactcccatgtttattgcagcactattcacagtagccaggatttggcagcatcttaaatgtccatcagcagatgaatggataaagaaaatgtggtacatttacacagtggagtactattcagccataaaaaatcagtttctgtcctttgcagcaatatggatgaaacttgaggtcgttatgttaartgaaataaactaggcacagaaagacaaatttctcatgttctagcttccacttatttgtgtgaagctaaaaattaaaacaattgaattcatggagatagagagtagaagcatgtaccagagactgggaaaggttgtggtaggggcaggcattgggggacaaggggatggttaatgggtaccaaaaaatagttagaatgaataacacctagtctttggtagcacaacaggatgactatagccaataattgtaagagttaatgaaagaggaaagaaacacaaaatgtggctggacagttaaag

SEQ ID NO: 60686 - DNA, 601 bp, Human
atgaaagaggaaagaaacacaaaatgtggctggacagttaaagagagaattattttagataaaataaacttgagaggggcttctggccaattttggtcaggagcactttctcttacaggcttagagtggttttagggtgaggaggcttatcacaagcttagaatgtttctgtgtgagggagaagttttatggtggggttggactatctctgcctagaggggaggttatcttggggcagacatctttccagctcggaggagggttatcttaaggctggcatcttcccagagggtttatctcrgggctagcatgtccccggtcagggaggagtttggaatgtttctgctgggagatgttatttggtttatagtcatgctgaccttagccattaggctgatgccctttggatttaggcagtttttgattacggtgaactttagaatgagcggcttgtccaagatggcgatgttcctgctctgtcaataataatttaattgtaaattttaaaataactaaaagagcataattgaattgtttttaacccaaaggataaatacttgaggtaagggatattccatttaccctgaagtgattattatat

SEQ ID NO: 60687 - DNA, 601 bp, Human
cagggaggagtttggaatgtttctgctgggagatgttatttggtttatagtcatgctgaccttagccattaggctgatgccctttggatttaggcagtttttgattacggtgaactttagaatgagcggcttgtccaagatggcgatgttcctgctctgtcaataataatttaattgtaaattttaaaataactaaaagagcataattgaattgtttttaacccaaaggataaatacttgaggtaagggatattccatttaccctgaagtgattattatatattgcatgcctgtatcaacmtatctcatgtaccacataaatatatacacctgcaaaaagaaaaccaaaaaccacccgttctaagataccagtttaagtgtaaataattttaattagtgggtatgtgagaaggggaggagatttcttgtactacatagatggcttctaaagttaaactcctccattacgtttatagaaagaagaattggagtaaggaatgacttgataccaatattaccaatatgtgtattgacatcttgtgagctatataatattatgtctggtgtatcctgtaatacagaggttgacaaagtttttctg

SEQ ID NO: 60688 - DNA, 601 bp, Human
tttgattacggtgaactttagaatgagcggcttgtccaagatggcgatgttcctgctctgtcaataataatttaattgtaaattttaaaataactaaaagagcataattgaattgtttttaacccaaaggataaatacttgaggtaagggatattccatttaccctgaagtgattattatatattgcatgcctgtatcaacatatctcatgtaccacataaatatatacacctgcaaaaagaaaaccaaaaaccacccgttctaagataccagtttaagtgtaaataattttaattagtgkgtatgtgagaaggggaggagatttcttgtactacatagatggcttctaaagttaaactcctccattacgtttatagaaagaagaattggagtaaggaatgacttgataccaatattaccaatatgtgtattgacatcttgtgagctatataatattatgtctggtgtatcctgtaatacagaggttgacaaagtttttctgtcaagggccatgtagtaaatatatttggctttgaggccataagatctgtgttgcaaccactcagttctccataaaagcagccatgaacaattcgtacaa

SEQ ID NO: 60689 - DNA, 601 bp, Human
taatacagaggttgacaaagtttttctgtcaagggccatgtagtaaatatatttggctttgaggccataagatctgtgttgcaaccactcagttctccataaaagcagccatgaacaattcgtacaagactaagtgtggccatgttccaataaaattgtatttagggacactgaaatttgaatttcatgtaattttcgcaacatgagatgttcttcttcttttgattgatttcaactacttaaaaatgtggacatcattcttagctcaagaaccatacaaagaggcagtggatcaacttargcccatgagctatagttggctgatctctgatatagtctgtgtggttagagcggggaaggtatttttataccagcaaaaacgttatgctttctccacaagcctggtataaaaattgggaatgcgctacagatgccacttggtagaaagctgttttattaaggtttctgaaaattagacttgccaacacaaacattaaccttcgctccctttattcagatgttacatttaaatttttacccagacctgggaactgagtaaaattataattatgatagacacagggcccttgaactctttctt

SEQ ID NO: 60690 - DNA, 601 bp, Human
caacacaaacattaaccttcgctccctttattcagatgttacatttaaatttttacccagacctgggaactgagtaaaattataattatgatagacacagggcccttgaactctttcttttggctgttttgaaaggtcgttgtcttcatgttaattaggagccaggaacattctgcttcagctgcttgttgggaaggcattatcattagggaaatgatctaatcaagagtttgcatgggaggtggggtgtgggcctggaggctaggaaacctgagaggttgaattacagggacacgcaacygataattataataaacttctccctagacctgaatgcacagcttggaacctgtcagttttcacattggaattattatactcaaccaatgacagtgtatttggtgatatgtcaacattttcattctgaatgagtgttaattgggtattttagtgcttgaaattatttgttaccaaaaacactgacacagcctgacattctctgctttttataattctgtagcacctataaaatttctttctctagatttaattgctttatacaaaatatgtacgtcaattaatcagagctgtaattattaga

SEQ ID NO: 60691 - DNA, 601 bp, Human
ctgtagcacctataaaatttctttctctagatttaattgctttatacaaaatatgtacgtcaattaatcagagctgtaattattagactccacagttggccgggcatggtggttcatgcctgtaatcttagaactttgggaggctaaggcagggggatcacttgagcccagaagttggagaccagcctgaacaacatagtgagaccctgtttctacaaataattttttgaaattatacaggagtggtggtgtgcgtctgtgatcccagctactcgggaggccgaggtgggaggatcggttsagcccagaaggccaaggctggagtgagctatgatggcaccactgcactccagtctggggaaaccctgtctcaaaaaatagaaaatagactccacggtggcctgacggttaagtatgcctaaatcagccattcacaggtcagggggttctgaaaggggctcttcagaattataaacttcaattttaaaaccaaaaattacctcccttcctctttctgctcccaactccttagaacaaatttgagttgagtgcctgccagcccagggctgttctaggtgctgggggccaacagcacagacca

SEQ ID NO: 60692 - DNA, 601 bp, Human
actgtcatccaggctggaatgcagcggtgtgatcttggctcactgcaacctctgcctcccaggttcaagcgattctcgtgcctcaggctccctagtagctaggacaacaggcgttcaccaccatgcccagctaatttttgtattttttggtagagacatggttttaccatgttgaccaggctggtctcgaactcctgaccgcaggcgatccgcctgcctcagtctcccaaagtgctgggattacaggcatgagccactgtgcctggccccattttaatcacttttaagtgtacagttctayagcactaatccatcacattgtcgtacaaccatcaccactacccatttccagaacattttcgtctttcctggctgaaactctgtgcccattaagcactaactctccattctcaccactccccagccccagcacccaccattctacatttctggacaaggggacagggtttcactctgtcacccaagcttggagtgcagtgatgcgatcatagcacactacagcctcaacctcccagtctcaaacgattatcccatctcagcctcccaagtggctgggactataggcatgcaccacctcgcc

SEQ ID NO: 60693 - DNA, 601 bp, Human
gtagagacatggttttaccatgttgaccaggctggtctcgaactcctgaccgcaggcgatccgcctgcctcagtctcccaaagtgctgggattacaggcatgagccactgtgcctggccccattttaatcacttttaagtgtacagttctacagcactaatccatcacattgtcgtacaaccatcaccactacccatttccagaacattttcgtctttcctggctgaaactctgtgcccattaagcactaactctccattctcaccactccccagccccagcacccaccattctacatttytggacaaggggacagggtttcactctgtcacccaagcttggagtgcagtgatgcgatcatagcacactacagcctcaacctcccagtctcaaacgattatcccatctcagcctcccaagtggctgggactataggcatgcaccacctcgcctggctaatttttgtattttctgtggagacggaatttcaccatgttacacaggctggtctcagactcctgggctcaagcaatcctcctgtcttggtctcccaaggtgctgggattacagctatgagccaccacacctggcccactattct

SEQ ID NO: 60694 - DNA, 601 bp, Human
gacagggtttcactctgtcacccaagcttggagtgcagtgatgcgatcatagcacactacagcctcaacctcccagtctcaaacgattatcccatctcagcctcccaagtggctgggactataggcatgcaccacctcgcctggctaatttttgtattttctgtggagacggaatttcaccatgttacacaggctggtctcagactcctgggctcaagcaatcctcctgtcttggtctcccaaggtgctgggattacagctatgagccaccacacctggcccactattctaccttctgttyctatgaatttgactacactggggatttcatatacatggaattatacagtaggttcccttttgtgactggcttatctcagtttgcataatgtcttcaagatttatcagaaactttacattcttaaaaagttttttcaatgtaaatttttagttttaattcaatcaggttaaaggtcatatctcaagaatgaacagtgttcctcattccttcttaaaatatttttaaaatgttttttgaaccaccaaatggcattttcattttgttttttcttagcaaaaaaataaaaattaaaaggtctta

SEQ ID NO: 60695 - DNA, 601 bp, Human
agatgcatcataatattcttaatttttcagcgcattaaagaaaagatgaataggaaaggagataaataacatcccaactgggggatcctacttttaaagaaaatgtgtagacttttcaccatgcgatcctcatacaatcttgatcttatattaattagcatatttcccctatgtgcggaaatctgtaatgcccttcctctgtggtgggctgccttgctttgaaaacaccaccaggagcccctctgaagaatgacagcagcaggtgttctgagagaaagtagtgagatggacagagctgtgratactaactgcagagaccaagtctccagacacagggccagctggggaaattctactgctggctgccattccttggttctgttgtcagtaatcacaggtcacaagcctcgcctctcctgcctactagatggttcattttggccgggtgcggtggctcacgcctataatcccagtgctttgggaggccaaggcctcccaaatgtatgaactctcgtacattactggtatataaattggtaaaaccatttggtaatatacctattaaggctaagcatgtgtatgccctatgatccaggtgtca

SEQ ID NO: 60696 - DNA, 601 bp, Human
aaatgttctagagctagcctacatactcataaatgtatgcattctttaaaatgcacttatcaaaaaattagctgggcgtggtggtgtgtgcctctaatcccagctactagggaggctgaggcaggagaatcgcttgaactcaggaggcagagcttgtggtgagccgagatcgtgccaagccgagatcgtgccactgcactccagcctgggtgacaagagtgcaactccatctcaaaaaaaaaaaaaaaaaatttattcaaatgacagcaaaacggtgtatttctaccaatgatagaaaaawactctctgatggttttttctttttctgatgcttttttctttttaacctgtaaaatacatcttggagattatttcacattagcatgtatcgctagagataacttatttttttatatgtccaaatgatatgccatcatatggatgcaacataattttatcagtgccctactgatagttatgttattcaaagtaatctgttatcacaaatagtgccataacaaatattcttatatatatatccttatgtacacatttgtatatatctataaaagtcccagaatcagaattagaattatggatc

SEQ ID NO: 60697 - DNA, 601 bp, Human
aaaaattagctgggcgtggtggtgtgtgcctctaatcccagctactagggaggctgaggcaggagaatcgcttgaactcaggaggcagagcttgtggtgagccgagatcgtgccaagccgagatcgtgccactgcactccagcctgggtgacaagagtgcaactccatctcaaaaaaaaaaaaaaaaaatttattcaaatgacagcaaaacggtgtatttctaccaatgatagaaaaatactctctgatggttttttctttttctgatgcttttttctttttaacctgtaaaatacatcttggagattatttcacattagcatgtatcgctagagataacttatttttttatatgtccaaatgatatgccatcatatggatgcaacataattttatcagtgccctactgatagttatgttattcaaagtaatctgttatcacaaatagtgccataacaaatattcttatatatatatccttatgtacacatttgtatatatctataaaagtcccagaatcagaattagaattatggatcaaaggtaggttttcagttttgataaattctaccaaattttatccataaggggcaatgtgtga

SEQ ID NO: 60698 - DNA, 601 bp, Human
tcagtgccctactgatagttatgttattcaaagtaatctgttatcacaaatagtgccataacaaatattcttatatatatatccttatgtacacatttgtatatatctataaaagtcccagaatcagaattagaattatggatcaaaggtaggttttcagttttgataaattctaccaaattttatccataaggggcaatgtgtgagaggaccacactaacagtgcattcgctttgcttgtaatctttgccaataaaaattaaaactagtgttgtctttgattttgccctgttttaacatyaggactaaacttaggcattttccattagcttaaaaccgtttctttttctgggaatgtctctccttcccctgcttttttggcctatttttctagtgggttgttggtgtttttcttattgattataagatgtattaatatatgaaggcatcaaacttttgtcagcatatgatgacatattctgtatatatcatcagtatatgagcaactttactgttgctcttttatttatgatttttttttttttttttttttgagacggagtctcactctgtcgcccaggctggagtgcagtggcgccat

SEQ ID NO: 60699 - DNA, 601 bp, Human
tatgcatacactaccaggctgtgagactgtggtcaccctcgtgcaagtcaacagacagctgtcagcatagtcaccgagccatttctttctctctttttttttttttagcgacaggctctcattctgtcactcaggctggggtgcagtggtacaatcaaggcttactgcagccttcacctcccagactcaagtgatcctcccacctcagcctcccaagtagctgggactacaggtgtgtgctaccatgcccagctcgttttaaaattttttgtacagatggggtctcgttatgttgtccacrttggtctcaaactgccgagctcaagcaatcctcctgcctcggcctcccaatatgctgggattataggagtgagccactgcacctggcccaagccatttctcatccttaccaaaatgtattcttaccaaactgtcaggccatttttgccctgcttgatggaagttttgctatcattaaagtccattacaccttcaaatgcaaaatagagcagatattttcatgcaacaaaagatgctttttcatttgcaagacaagaaataggatataaactacttttgaccaatggtatatgtccagtat

SEQ ID NO: 60700 - DNA, 601 bp, Human
gctttaaactataggatgtaagagagaagaggttttctctctttcagtccttattcattcattccacaaatgtttgttgagcatgcattccatgcctggcactattccaggcacttgggatataggagtaagtgaaacatttaaaaaaatccatcctcgtgggtgttatatcctaatcaagggagacatatactaaacaatatcgtaagtaaattatatgttagaaggtaaaaacactaataggctgggcgtggtggctcacacctgtaatcccagcactttgggaggccgaggcacatgtatctcttgaatccaggagttcgagaccagcctgggcagcatggtgaaactccatctctacagaaaatacgaaaaattagttgggcatggtggtgcgcacctatagtcccagctactcaggaggctgaagtgggtggatcccttgagctcaggagacagaggttgcagtgagccaagattgtgccactgcactccagcctgagtgacagagtaagaccctgtcaaaaaaaaaaaaaaaaaaaagaaggtaaaagcactatttttaaaaaagtagaacagggtaagtgagattggaaatacc

SEQ ID NO: 60701 - DNA, 601 bp, Human
ctctttcagtccttattcattcattccacaaatgtttgttgagcatgcattccatgcctggcactattccaggcacttgggatataggagtaagtgaaacatttaaaaaaatccatcctcgtgggtgttatatcctaatcaagggagacatatactaaacaatatcgtaagtaaattatatgttagaaggtaaaaacactaataggctgggcgtggtggctcacacctgtaatcccagcactttgggaggccgaggcacatggatctcttgaatccaggagttcgagaccagcctgggcarcatggtgaaactccatctctacagaaaatacgaaaaattagttgggcatggtggtgcgcacctatagtcccagctactcaggaggctgaagtgggtggatcccttgagctcaggagacagaggttgcagtgagccaagattgtgccactgcactccagcctgagtgacagagtaagaccctgtcaaaaaaaaaaaaaaaaaaaagaaggtaaaagcactatttttaaaaaagtagaacagggtaagtgagattggaaataccgctgcaatcaatgggggttacaatttgaaataggatgg

SEQ ID NO: 60702 - DNA, 601 bp, Human
ggctgggcgtggtggctcacacctgtaatcccagcactttgggaggccgaggcacatggatctcttgaatccaggagttcgagaccagcctgggcagcatggtgaaactccatctctacagaaaatacgaaaaattagttgggcatggtggtgcgcacctatagtcccagctactcaggaggctgaagtgggtggatcccttgagctcaggagacagaggttgcagtgagccaagattgtgccactgcactccagcctgagtgacagagtaagaccctgtcaaaaaaaaaaaaaaaaaaaagaaggtaaaagcactatttttaaaaaagtagaacagggtaagtgagattggaaataccgctgcaatcaatgggggttacaatttgaaataggatggttgcagaagacctcattgagaaagattttgagcaaagacttagaggaggtgatagagttagaagggtagaaatctaggggaggagagtgtctggtacctctgaggaatatcaaggggcccaacaaggttagagccgaaagaagggagagcgaggtggcagggagagggtgtagagatcagcggaagaggacgttactaacaaag

SEQ ID NO: 60703 - DNA, 601 bp, Human
ctcttgaatccaggagttcgagaccagcctgggcagcatggtgaaactccatctctacagaaaatacgaaaaattagttgggcatggtggtgcgcacctatagtcccagctactcaggaggctgaagtgggtggatcccttgagctcaggagacagaggttgcagtgagccaagattgtgccactgcactccagcctgagtgacagagtaagaccctgtcaaaaaaaaaaaaaaaaaaaagaaggtaaaagcactatttttaaaaaagtagaacagggtaagtgagattggaaataccgcygcaatcaatgggggttacaatttgaaataggatggttgcagaagacctcattgagaaagattttgagcaaagacttagaggaggtgatagagttagaagggtagaaatctaggggaggagagtgtctggtacctctgaggaatatcaaggggcccaacaaggttagagccgaaagaagggagagcgaggtggcagggagagggtgtagagatcagcggaagaggacgttactaacaaaggagacttagaaggaacagccaatgggaaaagagaaagaccaagagggagtggtttcttgga

SEQ ID NO: 60704 - DNA, 601 bp, Human
ctgggcagcatggtgaaactccatctctacagaaaatacgaaaaattagttgggcatggtggtgcgcacctatagtcccagctactcaggaggctgaagtgggtggatcccttgagctcaggagacagaggttgcagtgagccaagattgtgccactgcactccagcctgagtgacagagtaagaccctgtcaaaaaaaaaaaaaaaaaaaagaaggtaaaagcactatttttaaaaaagtagaacagggtaagtgagattggaaataccgctgcaatcaatgggggttacaatttgaaayaggatggttgcagaagacctcattgagaaagattttgagcaaagacttagaggaggtgatagagttagaagggtagaaatctaggggaggagagtgtctggtacctctgaggaatatcaaggggcccaacaaggttagagccgaaagaagggagagcgaggtggcagggagagggtgtagagatcagcggaagaggacgttactaacaaaggagacttagaaggaacagccaatgggaaaagagaaagaccaagagggagtggtttcttggaagtcaagttgagaaaatgaagagaggac

SEQ ID NO: 60705 - DNA, 601 bp, Human
cctgaccaacatgatgaaaccccatctctactaaaaatacaaaaattagctgggcatggtggtgggcacctgtaatcccaactactcaggaagctgaggcaggagaatcgcttgaacccgggaagcggagattgcagtgagccgggatcgccccattgtactccagcctggatgcagagtgagactccatgtcaaaaaaaaaaaaaaatcatgtcatctgtcatcatcagtagatatatattaaaggcctagaaaattttcccaaaacacacatacacatacataatgttctaattttttwaaattacttagcctatgactgaaatccaaaactcaaaataatatcaaaattgcccctctaattttaactttttcaaaatggttcctttggacaatgtcaaattttgcaaatattgagcagaggctcttctataaactgtaaatagccatcataccctcatgttaaggaataatttggtggtaacagcattttgatatgttcgttttttaaaaaaatgaaagtcacatgtctgaacttcttgcctactatttgtactttataataacttcagcttcagtactgaaaaccagcaactgttcc

SEQ ID NO: 60706 - DNA, 601 bp, Human
acttagcctatgactgaaatccaaaactcaaaataatatcaaaattgcccctctaattttaactttttcaaaatggttcctttggacaatgtcaaattttgcaaatattgagcagaggctcttctataaactgtaaatagccatcataccctcatgttaaggaataatttggtggtaacagcattttgatatgttcgttttttaaaaaaatgaaagtcacatgtctgaacttcttgcctactatttgtactttataataacttcagcttcagtactgaaaaccagcaactgttccttttgmactgaaagaagacacttgaatcctagccactttcaggcaggatgagctgccgaccagtctactgaaggccagcttgccaaagttctattcattttcagcaaagagagaaaaacttaaatagccggtgtcttggcttctattgttttccgattctaatctactttcccttgtagataagtaatgaaaagaatgcttggtgatgctgagatactctgaagtgaggaaaatttcagaggagcagccaagtctttccacaaaacagcattctattaatgaatgtaaaatgagccctcggtgtac

SEQ ID NO: 60707 - DNA, 601 bp, Human
ttcaggcaattcttctgcctcagcctcccgagtagctgagattacaagcgcccaccaccatgcctggctaatttttgtatttttagtacagacagggtttcaccatattggccaggctggtctcttggccaggctggtctcgaattcctgacctggtgatctgcctgcctcggcctcccaaagtgctgggatttcaccgtgagccactgcgcctggcccaaattcgaaaatttatagatgtgtgtgagagagagcaagcgagcgtgcctaaagcttagcaaagacatagctaagcattacraaactatcacgatgcctttatgatcgttagaaatggctatacctatgaccaacaaacagaaaaaacatatgcttttgattaacaaaaacatcagatgcatgtaggaatttgtcctagcttttctttttatgagcagacacatgcatggcacttgaaatttgactgctaaaggtttactcctaactctgtggatccaatttgttatatactcattttacaaagggaggaattagccagggagttatttatatgacttgcatttggctatgcaatgagtcccctgcttcgtggccttgctca

SEQ ID NO: 60708 - DNA, 601 bp, Human
tgtatttttagtacagacagggtttcaccatattggccaggctggtctcttggccaggctggtctcgaattcctgacctggtgatctgcctgcctcggcctcccaaagtgctgggatttcaccgtgagccactgcgcctggcccaaattcgaaaatttatagatgtgtgtgagagagagcaagcgagcgtgcctaaagcttagcaaagacatagctaagcattacaaaactatcacgatgcctttatgatcgttagaaatggctatacctatgaccaacaaacagaaaaaacatatgcttytgattaacaaaaacatcagatgcatgtaggaatttgtcctagcttttctttttatgagcagacacatgcatggcacttgaaatttgactgctaaaggtttactcctaactctgtggatccaatttgttatatactcattttacaaagggaggaattagccagggagttatttatatgacttgcatttggctatgcaatgagtcccctgcttcgtggccttgctcaggtagcttctctatgtctcagttttctcatcagtaaaaatgaagataatcgaaattacattaggtaatacttgtg

SEQ ID NO: 60709 - DNA, 601 bp, Human
ttgagattttcatcatcgtatgaatttgaataataattacacgacagtttgcaaactaaggtatacaatgtttatgcaactgtcccgcatcttggcacgctatgtcatttttcagtgtttagagtcaggatctctcatcagtacatagttgatgattttattgttattattttgagacagggtctccctctgtcacccaagctggagtacagtgttgtattctctgctcactgcagcctctgcctcctaggttcaagcgattctcctgcctcagcctcccgagtagctgggaccacaggcrcctgccaccacgcctggctaatttttgtatttttagtagagatggggtttcaccatgttgccccggctggtcttgaactcctggcctcaagtgatctgcctgcctctgcctcccaaagtgctgggattacaggcatgagccagcatgcagcccatagtttatgattttatttatgaagaaaccagtaaagcagagaatagcaattcagatttcttgcatctacattgcaccagagaacagaaggtaattctaaactgtgaaaagagatgacaacaccatgaaaaatgaaagaattatctc

SEQ ID NO: 60710 - DNA, 601 bp, Human
aacacaatttgggatccaagatgccgctatgaaataggcttacaactcttatcttttgggctttaaaagagaaaaatacaagaatgctccaaaatactgatgctgaaaatatagatgactgtgaaacagcagagtacagcatcaaaacagcaaagtatataaattttttaaagcattaaagaaaaagggtggccaggtgtagtggctcaagccagtaatcccagcactttgggaggccgaggtgggcagatcacctgaggtcaggagttcaagaccagaccggtcaacatggcaaaaccggctctactgaaaatacaaaaattagccgggcctggtggcgcatgcctgtaatttcagctactctggaggctgaggcaggagaatcacgtgaacctaggagacagaggttacagtgaggcaagattgagccactgcactctagcctgggcaacagagtgagactatctcaaaaaagaaaaaagaaaaaagaaagggtgacgctttcttgtgtgaacgttagacataaaagtggaaaaacaatgaaaccccgtctctactaaaaatacaaaaattagccgagtgtggtggtgcacatctgtaa

SEQ ID NO: 60711 - DNA, 601 bp, Human
acaactcttatcttttgggctttaaaagagaaaaatacaagaatgctccaaaatactgatgctgaaaatatagatgactgtgaaacagcagagtacagcatcaaaacagcaaagtatataaattttttaaagcattaaagaaaaagggtggccaggtgtagtggctcaagccagtaatcccagcactttgggaggccgaggtgggcagatcacctgaggtcaggagttcaagaccagaccggtcaacatggcaaaaccgtctctactgaaaatacaaaaattagccgggcctggtggcgcrtgcctgtaatttcagctactctggaggctgaggcaggagaatcacgtgaacctaggagacagaggttacagtgaggcaagattgagccactgcactctagcctgggcaacagagtgagactatctcaaaaaagaaaaaagaaaaaagaaagggtgacgctttcttgtgtgaacgttagacataaaagtggaaaaacaatgaaaccccgtctctactaaaaatacaaaaattagccgagtgtggtggtgcacatctgtaatcccagctactcaggaggctgaggcaggagaattgcttgga

SEQ ID NO: 60712 - DNA, 601 bp, Human
ggaaacgaccgccagctgttcctgactgaagactacttgaggcacgatgacccagaaagtccatatgtttccaaagataaaagcttaattagatatatcacttctaactgaataaatccacactcccacaagaaaggagattaactgtaaggcatatgtcaggagggtgactttcaaacatgcaacagcttcagatactgaaacatgctactatttaactgtggctgtctttggatgggagactttcaggggatcgttatttgtgtgtctttcaatgctgggtgcatataacttctataaygaaaaatattttgaggctgggtgaggtggctcacacctgtaaacccaacactttgggaggctgaggcaggaggattgcttgagcccaggagtttgagaccagccagcctgggcaacatagtgagacccatctctacaaaaaataatttaaaaattagctaggaatgggagcacatgcttgtattcccagctgcttgggaggctgaagccggaggatcactttcgcccaggaggtcaaggctgcagtaagccatgattgcatcactgcagtctatcaagcctgggtgacagtgagactgtc

SEQ ID NO: 60713 - DNA, 601 bp, Human
gaggtggctcacacctgtaaacccaacactttgggaggctgaggcaggaggattgcttgagcccaggagtttgagaccagccagcctgggcaacatagtgagacccatctctacaaaaaataatttaaaaattagctaggaatgggagcacatgcttgtattcccagctgcttgggaggctgaagccggaggatcactttcgcccaggaggtcaaggctgcagtaagccatgattgcatcactgcagtctatcaagcctgggtgacagtgagactgtcacacacacacacacacacacacctacacacacacacacacacacacaattgtttttgtgtgaaagtatatactatcagagatacaaggaatgaaggtaatccagctctttctatgcttctatgaactactctaaagatcaattggtagtcacatcctgtattataaaatagtcaagccattgccaaaagtcattgaagagatttttgtttttaactgctatttaaacctggaaacaggtctcaaagtgactatgcaatgtaaaagctccatctgaatattagcaaaggactttttatatcttattttaaaataatgaatgaga

SEQ ID NO: 60714 - DNA, 601 bp, Human
caacactttgggaggctgaggcaggaggattgcttgagcccaggagtttgagaccagccagcctgggcaacatagtgagacccatctctacaaaaaataatttaaaaattagctaggaatgggagcacatgcttgtattcccagctgcttgggaggctgaagccggaggatcactttcgcccaggaggtcaaggctgcagtaagccatgattgcatcactgcagtctatcaagcctgggtgacagtgagactgtcacacacacacacacacacacacatacacacacacacacacacacamaattgtttttgtgtgaaagtatatactatcagagatacaaggaatgaaggtaatccagctctttctatgcttctatgaactactctaaagatcaattggtagtcacatcctgtattataaaatagtcaagccattgccaaaagtcattgaagagatttttgtttttaactgctatttaaacctggaaacaggtctcaaagtgactatgcaatgtaaaagctccatctgaatattagcaaaggactttttatatcttattttaaaataatgaatgagaccgggaatgcgaccgcgggaatg

SEQ ID NO: 60715 - DNA, 601 bp, Human
gagagaaggtttcatctgaaacagaaacagacacacataccacgagcccgattactatagaaccgaagagacctttccagctgtttacacttcggatgtaaaatggcaatttgacatagactaacagtgtgatgtgagcatctgcgtaaaaaggcgacatatggagcatgcccagtgtgggagtgcgtcctcctccctccgcctcccccctccccctcgagatctccaaagataaggcttgaactttgcacttgcaaatgtcactgcatacgtttttgcactagtttttttttttttttttctgcgattcttttacaactaatttcttttaacaatttgagcgcagggaagagaatgtttagggttatgagatgcattaagtttagaacgagttgatgctcggcttttgaatgcacttgtcttctttatttttaaagcaatataaagcactcgagtgtgtgttttcagcccctcctggaatgggaaaataagaatctccctggatgggagtcctctggggcagggagtgaaagccccggaggcagaaagggacggagaacaggggcttgcccagagcatggataggaaaggagctggggtt

SEQ ID NO: 60716 - DNA, 601 bp, Human
aaaggatccttgaatttgccaagaggaaaaactgcacctaatatcaacatgttttacttcatttccacagtaaactatatctctgttaagaaaaaaaaaaaaaacagactgacttcaagctattgtttattttcttagacttgaacagtttttcccctgaattttacttcataggtgttttatgttagtatcctgtattttcaaaatggattacattatgcttttccaaaagcaacagaggattttattgatttttaaaagtttcttctcttagaacatgttcttctccattccatcttartaaagtgtgtatatatggaggggagactgcaaagcagctatgaaatagatagttacaggattcatctcaggccatgtctcatttcagtcattgcagtgatttgaattctttctcccatgctgtccttggaatagtggctatttctaaagcatagattgttcgagttgaaggtggcttggtttgtgggatactcagtcacttctcaatgaacctattttaacatggttgttgattttcctttgaaaaacttgttttgaaaaaggctaagtgccttgttgatcatgctagaaataccaggat

SEQ ID NO: 60717 - DNA, 601 bp, Human
ttcctttatattaaaatcatggtttggtaagtctggtttattaatcccaatatccttgaagaaataatgcaaaatagggattgtagaaggctagttccctctataaatttttattgttatctataaaaataacctcattctttgccagaatttcatcttgccttaatgaaacctacttcaaaatgaaggcttaaagtttaaaaacataacaattcatgctatttaactttaaatagttaaaaacactttgcacagccattttggaagaatcagacattttctacatttacttcgtaaccawcgaagcatctctcaaacagaaagactctacaagtcagtgcttttactcaccttacagatcacatgtaataaataagtctgtgcagatgacgttagcagtgctttcagatcctggtcctgtataaatacaaacacattatccactaattgcctaataatacctctgtgaaataacgtgattagcaagaagtgagactagagatactgtcttttaaaatttaagtgacctacaaaaggttatataacgaagtactctgtgctgtcaataaacctattactctccactaccactttgttaagg

SEQ ID NO: 60718 - DNA, 601 bp, Human
cagccaggcacaatggctcatgcctgtaatcccagcaatttgggaggccgaggcgggtggatcacctgaggtcaggagtttgagaccagcttgggcaacatggtgaaacgctgtctctactaaaaatataaaaattagctgggtttggtggtgtatgcctgtaatcccagctacttgggaggctgaggcaggagaatcacttgacgctgggagggaaaggttgcagtgagctgagatctcttgctctcacgtgtgcaacagagcaagactctgtcaaaaacaaacaaacaaacaaacaaaaaaaaaacgatggactcaatgtgatcttcttagccgaatagaataaccttcaatcttgagtccattgttcttttatcatcgaatatctactatattaaagaaaatgttaggcccagttggtgaataggagagactgcaaggccggagccacaaagaagaaattggcaggtcttttgcctgcaagaagcttccattgtttgttttgggagaaagttgtggtcataaaaggtggaatacaataggttgtggggaagggagggatagagaggtctgtgagcacccaggtttagactgcatccta

SEQ ID NO: 60719 - DNA, 601 bp, Human
gcacaatggctcatgcctgtaatcccagcaatttgggaggccgaggcgggtggatcacctgaggtcaggagtttgagaccagcttgggcaacatggtgaaacgctgtctctactaaaaatataaaaattagctgggtttggtggtgtatgcctgtaatcccagctacttgggaggctgaggcaggagaatcacttgacgctgggagggaaaggttgcagtgagctgagatctcttgctctcacgtgtgcaacagagcaagactctgtcaaaaacaaacaaacaaacaaacaaacaaaaaaygatggactcaatgtgatcttcttagccgaatagaataaccttcaatcttgagtccattgttcttttatcatcgaatatctactatattaaagaaaatgttaggcccagttggtgaataggagagactgcaaggccggagccacaaagaagaaattggcaggtcttttgcctgcaagaagcttccattgtttgttttgggagaaagttgtggtcataaaaggtggaatacaataggttgtggggaagggagggatagagaggtctgtgagcacccaggtttagactgcatcctactggcag

SEQ ID NO: 60720 - DNA, 601 bp, Human
cttttatcatcgaatatctactatattaaagaaaatgttaggcccagttggtgaataggagagactgcaaggccggagccacaaagaagaaattggcaggtcttttgcctgcaagaagcttccattgtttgttttgggagaaagttgtggtcataaaaggtggaatacaataggttgtggggaagggagggatagagaggtctgtgagcacccaggtttagactgcatcctactggcaggaagagaaaatccttcttggaggaggtagtggcttaaaagtagacctcacagcaggggttcrtattctgttaggaaccaggctacacagcaggaggtgaacagcagcagccagacaggaagcttcatctatatttacagccactccccactgctcacataaccacctgagctccgcctcctgtcagatcaatggcagcattaggttctcataggagtgcaaacccttttgtgagctatgcatgtgagcgatcgaggttgcgcactccttatgagagtctaatgcctgacgatctgtcactgtttgccatcacccctggatgggaccatctagttgtaggaaaacaagctcagggttcctact

SEQ ID NO: 60721 - DNA, 601 bp, Human
ctgtcgcccaggctggagtgcagtggtgccacctcagctcagtgcaactccacctcccgggttcaagcgattctcacacctcagccttctgagtagctggcattacaggcacgcaccaccacacccagataatttttgtatttttagtagagacagggtttctccatgttttccaggctggtctcaaattcctgtcctcaagtgatccatccgcctcggtctcccagagtgctaggcttacagatgtggcccaccatgcccggcctgttctgtctttaagtttttgatttttgtttttttwaaatctctaatattttgggaactgatcttcctttggtattttgacattttgacatgacatgccttggtgtgcacctttttgtttattgtacttggcttctcatgcattcattgtgaagggctgatcagttcagttctggaaactgcccctttttttggaataatttcttcccctatattgtcctctttttactggctctctggtttgtgcgatatttgatttgagcctctgtgtaatcatttttctcactttttctccatctttttgttgtacctgaatttttctcaacttctaacccat

SEQ ID NO: 60722 - DNA, 601 bp, Human
gggctgagactctgtctgactctggacaatgtttaatttttgatcatctattcataattaagaggaagacattgtaaagctgattggaagctccaaatgcagtggcaaagcttcttgacaggtcatcttgtatagggtaattggggagggactgaagaactggtaggagtgggcaccattatcttttaatctggccaatgccccagagaggactcccccagtctcctgtcttgctctattggaccgctcacaggcttttggcagttgtccaagaaaaggtggctagagtttcatcacttasgatggagatcttataattatttaatcctcctatgttcagtatgtcactcgcctttactctcagctatccttctgattgtctgaaatctcctggtcatcctctccagagaataaacctttggtcttctggaagtgaggggagagagaaagtggattctgataagtccaatgtccagtcagtgctgttttcagccccagccatacttcatccttcagaggtgcctgttacctccagttccacctccttgccagggccctgcagctgcaatcagctttctactccttagccgtcctgcccgcc

SEQ ID NO: 60723 - DNA, 601 bp, Human
tcccatcagcctgaagatagtttatttcaaaaaaatattaaacatgttttaaaaatatgtcttattgtgaacattatatgggaggtaggagagaaatatacacatatgtctataatgcgtatgttcttaaacctacaagatagactactggagaatccagagaataggtggcaggtgtgaaactagagggctacttatggggaaaaaaaaaatgtgttggctgggcgcggtggctcatgcctgtaatcccagcactttgggaggccaaggcaggtggatcacaaggtcaggagtttgagascagcctggccagcatggtgaaaccccatctctactaaaaatacaaaaattagctaggcatggttgtgggcacctgtaatcccaactactctggagactgaggcaagagaatcactggaacccaggaggcagaggttgcagtgagctgagatcacgccactgcactccagcctgggcgacagagcaagactccatttaaaaaaaataaaaaagaaagataaaaatccagcagcgataccttatgaaaaacgcaagcacaaaatatgtcacacattcttattaaaatattttaggctgaaat

SEQ ID NO: 60724 - DNA, 601 bp, Human
acctgggatggcttgtcacatgtgtctggaggctgatagctgtcagcatgtgtgtctcgttctcttccatatggttgtttatcctccaacaggctggctagggttcgcatgctggtcccagggctgcttcatgagagagcaagctccaagggggtgataatcatatctctacttatgtcatgtttgctaatgtcccattggccaaagcaagtcaccggcctaagcctggagtcaaatgggaattaccaagggtgtggattcaggtgggatatgttgcaaccactttctgcaaacaacctgycacattcatcttttttcttccttacccctttggaagaagaaatatctgcatgccttgtgaaataaacaacgctgtcctcccttctgtcctatttttttcccttctttctactgccaaccttatcaccccaggctttattctcctgcttcaatttcttccctacttactctttaacaccgtgaaactgatttctgtctccatctctttactgagggtctctagtgacttcctaatcacaaagccactgaccttttattaaacctccccttgacatctctgcaaacttcaatttgtttttct

SEQ ID NO: 60725 - DNA, 601 bp, Human
tggttgtttatcctccaacaggctggctagggttcgcatgctggtcccagggctgcttcatgagagagcaagctccaagggggtgataatcatatctctacttatgtcatgtttgctaatgtcccattggccaaagcaagtcaccggcctaagcctggagtcaaatgggaattaccaagggtgtggattcaggtgggatatgttgcaaccactttctgcaaacaacctgccacattcatcttttttcttccttacccctttggaagaagaaatatctgcatgccttgtgaaataaacaacrctgtcctcccttctgtcctatttttttcccttctttctactgccaaccttatcaccccaggctttattctcctgcttcaatttcttccctacttactctttaacaccgtgaaactgatttctgtctccatctctttactgagggtctctagtgacttcctaatcacaaagccactgaccttttattaaacctccccttgacatctctgcaaacttcaatttgtttttcttctctgctaagtcacttttgtcttgcaggtgctggtacacacaaagtctacttctactaccactctggtgg

SEQ ID NO: 60726 - DNA, 601 bp, Human
cctgcttcaatttcttccctacttactctttaacaccgtgaaactgatttctgtctccatctctttactgagggtctctagtgacttcctaatcacaaagccactgaccttttattaaacctccccttgacatctctgcaaacttcaatttgtttttcttctctgctaagtcacttttgtcttgcaggtgctggtacacacaaagtctacttctactaccactctggtggttcctgttcagtctcttctgtttcgacttttagttccctcacctgaaatgtggaagtccattcaaccaaaygctcaggccttggcctcctgatgtttgttgctttaggcatgtcattggtttccagactgagctctgtagagccccaagagatccatggattcttctggagtcactgcagaggcttagggatgcccagcaggctgtggtctgtgcgttgtacccaggattcagccagaacaatgctaccttcacatgttttattttattgtgttgtatttttattttttattttttgagatggagttttactcttattacccaggctagattgcagtggcacgatcttagctgactgcaacttctgccccc

SEQ ID NO: 60727 - DNA, 601 bp, Human
aagggtcaacaaatcttttcctgggaattatcagaagggaaatattgcaggggcaggggtcatgcattctctatgcaactgctcagaaacctggatttggattccatctctgccatggaatggctgcctgactttttgataaattacaggtgaagctaagttttgccatttgtaaaaggacactaacctctgtttgacaggattccagtgataattgaataagctgttacgtataaagcacaaggttcctggacctgtctttccctactctagcccttgtgatgggcacaggcaactgggrcacacagcacctgccgtggagcagttcagggtgttgtgaggaatctgaatggaaagtaatgaaacaagtgtctttgcctcctctgtagttatgtgcggtcttacactattttacatggtcactatcagcttagttgtttgtcacttgttggtgactgctgtaaggtagatttgagatgtccagggactgcagagctgcctgggatatgactggcattgacacacttgcttgatctcacagcagttgccatggcaggtcaggttgcatccccacccatcccagtgacgaaggcatgggcct

SEQ ID NO: 60728 - DNA, 601 bp, Human
gcaaaaatggggtttcaccaggttggccaggctgctctcatagacttctggctattttaaaaccataaatagattaaggaaggattattataaattgcagttcaagctttttttttttatcttagagcactataactgaatgtctttgttgtatcattgtaaacacagcaataaatatgcagttcttccctccctttttctccaccagatgttaacagggaacgacatgaagacttttacgcagagcttaaaacagtcaaccctctctgttcttacaagtttttgccccatcaatggctamataaaagatgttgaaaactgtggaaaaaagtagaatgtatttaattagcaaacatttgatgagtggtatcatgctatcgagttggaatttaaggaagggaaattgaagatgtgttagatgtggtggtttcttcctcaagaagctcatggtctaatggtcatgctaaaaatgtgtatcactgagtaatgtggtagctatcagacttaaagcactgtaggcttggcatggtggctcatgcctgtaatctcagcacttcgagaggctgaggtgggagaaaagctttaggccaggagtttgaga

SEQ ID NO: 60729 - DNA, 601 bp, Human
agtttattgtcattacaccattgatgtgaaacaagtcaatttttacacttcaacattatttaaacaaaaatcttgagctaaaaattccttttttttttttttttttttttttgagacgaagtttcactgttgttgctcaggctggaatgcagtggcgcgatctcggctcactgcatcctctgcctcccgggttcaagcgattctcctgcctcagcctccctagtagctgggattacgggcacacaccaccacacccggctaatttttgtatttttagtagagacaggtttcaccatgttgrccaggctgctctcaaactcctgacctcaagtgatccacctgccttggcctcccgaagtggagataaaaattcttgaatttaatatgttgttagttaaaggaagaccttccaggatgtgctgtgtatatccttttcatggttaaatggagatacaaatggaacgtacttaatactatttgaatatgccttttcctgtagagaaatggaaaaataatcaaatatctaggaaatagattgtatgaagaatgctgaagaaacaaaatttaaatagagcaaggaagagaaaattgaagttaaaat

SEQ ID NO: 60730 - DNA, 601 bp, Human
cgtaaggggaaaaaaacgaaaggaacaaactaaaaattacagcagccaaaaatataaagttagatgtaacaattgactagagaaacatgaagacgagttataaaggaagattaggagactgctgtagtgcaggagtgcagggttgtggttttttgtttgtttgtttatttgtttgtttttgagatggagtttcgctctgtcgccaggctggagtgcagtggcgccctcttggctcactgcaacctctgcctcccatgttcaggcgattctcctgcctcatcctcccgaggagttgggactwcaggcgcacgccactatgctcagctaatttttgtatttttagtagcaatggggtttcacgatattagccaggatggtctcgatctcttgacctcgtgatccacccgccttactaaactccatttttaaggaaggaaaatgaatcgcacaatccgctgtcagttgtttattctgatttcctactaaaaattatttcaattgatatttgcaggattaacacatgttaaagcaaactaaatatggcctgagaaggcctccttacttctacatttgagtcctcgtggatgaactgtaatctagc

SEQ ID NO: 60731 - DNA, 601 bp, Human
gggaaaaaaacgaaaggaacaaactaaaaattacagcagccaaaaatataaagttagatgtaacaattgactagagaaacatgaagacgagttataaaggaagattaggagactgctgtagtgcaggagtgcagggttgtggttttttgtttgtttgtttatttgtttgtttttgagatggagtttcgctctgtcgccaggctggagtgcagtggcgccctcttggctcactgcaacctctgcctcccatgttcaggcgattctcctgcctcatcctcccgaggagttgggactacaggcrcacgccactatgctcagctaatttttgtatttttagtagcaatggggtttcacgatattagccaggatggtctcgatctcttgacctcgtgatccacccgccttactaaactccatttttaaggaaggaaaatgaatcgcacaatccgctgtcagttgtttattctgatttcctactaaaaattatttcaattgatatttgcaggattaacacatgttaaagcaaactaaatatggcctgagaaggcctccttacttctacatttgagtcctcgtggatgaactgtaatctagcttaata

SEQ ID NO: 60732 - DNA, 601 bp, Human
tgtttgtttgtttatttgtttgtttttgagatggagtttcgctctgtcgccaggctggagtgcagtggcgccctcttggctcactgcaacctctgcctcccatgttcaggcgattctcctgcctcatcctcccgaggagttgggactacaggcgcacgccactatgctcagctaatttttgtatttttagtagcaatggggtttcacgatattagccaggatggtctcgatctcttgacctcgtgatccacccgccttactaaactccatttttaaggaaggaaaatgaatcgcacaatcygctgtcagttgtttattctgatttcctactaaaaattatttcaattgatatttgcaggattaacacatgttaaagcaaactaaatatggcctgagaaggcctccttacttctacatttgagtcctcgtggatgaactgtaatctagcttaataggcagataagattgaaaacctaacttggaagtatgtgcctgtaacagtaactgagtcttggccaatcccagcggccgtacttcaaccactcacagactgctaagtgttcaaactgtgttcaaataagacaaacgccaatatgtagcc

SEQ ID NO: 60733 - DNA, 601 bp, Human
ggagtgcagtggcgccctcttggctcactgcaacctctgcctcccatgttcaggcgattctcctgcctcatcctcccgaggagttgggactacaggcgcacgccactatgctcagctaatttttgtatttttagtagcaatggggtttcacgatattagccaggatggtctcgatctcttgacctcgtgatccacccgccttactaaactccatttttaaggaaggaaaatgaatcgcacaatccgctgtcagttgtttattctgatttcctactaaaaattatttcaattgatatttgcrggattaacacatgttaaagcaaactaaatatggcctgagaaggcctccttacttctacatttgagtcctcgtggatgaactgtaatctagcttaataggcagataagattgaaaacctaacttggaagtatgtgcctgtaacagtaactgagtcttggccaatcccagcggccgtacttcaaccactcacagactgctaagtgttcaaactgtgttcaaataagacaaacgccaatatgtagccagtccagctatttctgtacctcactgccgatttctgtatgtcacttcccttttttt

SEQ ID NO: 60734 - DNA, 601 bp, Human
gttcttgaatatttgacaccagtatcatggtctcatcctgccctccctagactggacaggaagtgaattcaacaggaagtaggcaaaaatgtacagtctaatcttctcgtctttggctttctcgtttcattccctggatttttaaacaaccaactatccctttgtcttcttagaggaactgtaatcatccctgaatgaaatatttattggatcagttgtaagcttacatttgagtcaacctacattccttacagttgagggttaagtttcaagatcctttatgaggcaactcagtgacackcatccccaggcagaattaaaggagatctttggctgtgacaatctaaagctctttggctatgacagaacaaggaaagttaccgtggttgaactagatgggaagaactacttgcttctcctctgagcgtactgtgacttgcttaattctatgagtttaagtagcctgaggattcaataggtcacataatggatatgcaaaatggagtatagaaaccctttaataagtaaaaatctccaggtgctgtattcagcatacttgcatggatccctgacactgtggtgtatgttaggctaagacata

SEQ ID NO: 60735 - DNA, 601 bp, Human
gagaagtatatggagatttattataagaaattggtgcacatgattatggaagctaagaaatcccatgatctgatctgccaactgtaactggggacccaggaaggctgatggtataattccagctccaagagcagagaaaagatcgatggatgtctcaccacaagcaggcaggcagaaagaaaaatgagtgaattcctccttcttctaccttgtattctattcaagcccccaacagattggatcaagctcatccacattggagaaggcagtcaacttactcagtccaccaattcaaatgctwatttcaccccaaacaccctcacagacatacccagaaatattgtttaaatttgcaccctgtggtgcaatcaagttgaccataaaattagccatcacagtcagctaattgaagttattactctacttatatgaccatcttcagtctagaatttagttaaacattcgagttggaccattatctgtaggaatttgggttccaggaaatacaagaagaactgaaaataattttttaaaaaaatttaaaccatagtcatgtttatgcctgaaaataatactttaaattttttcctaaatattctag

SEQ ID NO: 60736 - DNA, 601 bp, Human
aagtatatggagatttattataagaaattggtgcacatgattatggaagctaagaaatcccatgatctgatctgccaactgtaactggggacccaggaaggctgatggtataattccagctccaagagcagagaaaagatcgatggatgtctcaccacaagcaggcaggcagaaagaaaaatgagtgaattcctccttcttctaccttgtattctattcaagcccccaacagattggatcaagctcatccacattggagaaggcagtcaacttactcagtccaccaattcaaatgctaatytcaccccaaacaccctcacagacatacccagaaatattgtttaaatttgcaccctgtggtgcaatcaagttgaccataaaattagccatcacagtcagctaattgaagttattactctacttatatgaccatcttcagtctagaatttagttaaacattcgagttggaccattatctgtaggaatttgggttccaggaaatacaagaagaactgaaaataattttttaaaaaaatttaaaccatagtcatgtttatgcctgaaaataatactttaaattttttcctaaatattctagaaa

SEQ ID NO: 60737 - DNA, 601 bp, Human
acagattggatcaagctcatccacattggagaaggcagtcaacttactcagtccaccaattcaaatgctaatttcaccccaaacaccctcacagacatacccagaaatattgtttaaatttgcaccctgtggtgcaatcaagttgaccataaaattagccatcacagtcagctaattgaagttattactctacttatatgaccatcttcagtctagaatttagttaaacattcgagttggaccattatctgtaggaatttgggttccaggaaatacaagaagaactgaaaataattttttmaaaaaatttaaaccatagtcatgtttatgcctgaaaataatactttaaattttttcctaaatattctagaaattaaagtttaccaaacatgaaccatttgttattaatattatacttttgatgaatgacttgataaaatacaaaagaaggaaatgtattttttaggagaggaatttgaataatttttccccaaaaaattcatatgtatgtaaaatatcttcatcttagtaaaggtccattagcccttgttaactctggtccaagaaaatctatcaattcaagttagaaaaacaggtactc

SEQ ID NO: 60738 - DNA, 601 bp, Human
aaatattctagaaattaaagtttaccaaacatgaaccatttgttattaatattatacttttgatgaatgacttgataaaatacaaaagaaggaaatgtattttttaggagaggaatttgaataatttttccccaaaaaattcatatgtatgtaaaatatcttcatcttagtaaaggtccattagcccttgttaactctggtccaagaaaatctatcaattcaagttagaaaaacaggtactcaataatcttagcccttgacatttttctttaaatttctctgaaatacatatttttttttytgtttccttggctgaaaaatgttcattgtaatattaccagtgtggttttttttgtttttttgtttttttttttctaagacagaatttcactcttgttgcccaggctggagtacaatggtgcaatcttggccccctgcaacctctgcctcccaatttcaagtgattctctggcctcagcctccggagtagctgggattacaggaatgcaccaccacacccggctaattttttgtattttttagtagagacagagtttctccatgttggtcaggctggtctcaaactcccgacctcaggtga

SEQ ID NO: 60739 - DNA, 601 bp, Human
aatattctagaaattaaagtttaccaaacatgaaccatttgttattaatattatacttttgatgaatgacttgataaaatacaaaagaaggaaatgtattttttaggagaggaatttgaataatttttccccaaaaaattcatatgtatgtaaaatatcttcatcttagtaaaggtccattagcccttgttaactctggtccaagaaaatctatcaattcaagttagaaaaacaggtactcaataatcttagcccttgacatttttctttaaatttctctgaaatacatatttttttttctgtttccttggctgaaaaatgttcattgtaatattaccagtgtggttttttttgtttttttgtttttttttttctaagacagaatttcactcttgttgcccaggctggagtacaatggtgcaatcttggccccctgcaacctctgcctcccaatttcaagtgattctctggcctcagcctccggagtagctgggattacaggaatgcaccaccacacccggctaattttttgtattttttagtagagacagagtttctccatgttggtcaggctggtctcaaactcccgacctcaggtgat

SEQ ID NO: 60740 - DNA, 601 bp, Human
tttttccttttagagtggctgatgcttgaagaactatggaacgttggggtgtattcctttgctctcagatacttgaggagatcaccacataaattcttagagttctgggtttagctgtagtgtttagtctagtgtcgaagcagaggttgggcaaatatacactactgtaaatactttcttgtgctatagctgttaagcatgttctagtttaaacagttgtcagtgattagcgattttgatgttccgttttaagattttgtaatggtctagacgaacatgaacaaaaccaaaagaccgtttsaagttcagcagatagtaggagctaatcttttctgtggtttggtttggtcgcctgccttaggttggtttactagtctgtgactttctgagttgctttatcttgtgctaacttctatcagatacaatctccatattgattcctgtttattcttgcctggatgatctattccatttagatagctagaacattcagtagctctcttgagggaatcccacctgtgggttgcagaagggtaacctacagatgcccgattgtcctttttccctggattaaaaagaaaccatttgccatttttctggc

SEQ ID NO: 60741 - DNA, 601 bp, Human
tcctttatcttacctgttttacctgttttatggggttatgtcttgtctctacaattacatgtgacctcagtgaggaatcaggattgtcaattatgtctccattcccagtgtagtgagtgatatgtagaatgacttttggttgcattatgacactctttagtgaaaagtaatgattaaatagtttggggtggagataacatgaagagatctttttagaaactttctgtttggtgcagtaggttaccaaggcatgggccggaggaagatatagtaggaggtggtctctgccaggagaaagaaytccccctgtaggaagccaagttcctgactagcagttgccaaggctttctgtgtcctgccataagcaacggtcccttcaagcccagttcctgcaaagctgttctgttacataaagatgaaattataaatacactggggtatctttcaagtaaaattaactctatatattaaaattcaccttatatgtattccacaagcaaatgtcctgaattcttggtccatgtgaagtttgattattgcaattttgggaataattagggaagagaatatatagtaacataaaggactcaagcataagaca

SEQ ID NO: 60742 - DNA, 601 bp, Human
ggaaagaattcaagggcaagccagagggagaggaaaacagctttactgaagaagtgttacagctcctctactgcccctgcagagcaaggctaccctgtaggcagagagtaacagctgaggggagttttgcagtcgtattcatacgcactttcaattgcatgcagattaaggggctattcgtgcagaaatctctaagggagaagtagtaatcattgggtcattgccacggaaaggtgtggtaacgcctgggtgttgccatggcaatggtaaattgacatggcacactggtgggcgtgtctgwttgaaagctgctttcccctgggccctgttttaactagtcctcagtctggtcgggtgtccgagacccccacctcctacctcaaccccctctatcagagtttatcattatgctgaatgtggtgtttcccactcccttcctgttcataacattatgtcttaccatctatatttattttctacatgacatactggttagtttttctgtgttcaaaccattatttaagtagaataatcaaggtgttcttttgagactgcttttttggctcaacattaaatgtgtaaaattcattcttgttgattt

SEQ ID NO: 60743 - DNA, 601 bp, Human
cactttcaattgcatgcagattaaggggctattcgtgcagaaatctctaagggagaagtagtaatcattgggtcattgccacggaaaggtgtggtaacgcctgggtgttgccatggcaatggtaaattgacatggcacactggtgggcgtgtctgattgaaagctgctttcccctgggccctgttttaactagtcctcagtctggtcgggtgtccgagacccccacctcctacctcaaccccctctatcagagtttatcattatgctgaatgtggtgtttcccactcccttcctgttcatwacattatgtcttaccatctatatttattttctacatgacatactggttagtttttctgtgttcaaaccattatttaagtagaataatcaaggtgttcttttgagactgcttttttggctcaacattaaatgtgtaaaattcattcttgttgatttgtatcaccataatttctttttaccaatatgtggtcttccagtaggggatgtggcacaatcaatctgttctctgtccatgggcatttaaggaattgcagataatcccagtctggaagcatttatccgtgtctcctgatgcatgtgt

SEQ ID NO: 60744 - DNA, 601 bp, Human
tgacatactggttagtttttctgtgttcaaaccattatttaagtagaataatcaaggtgttcttttgagactgcttttttggctcaacattaaatgtgtaaaattcattcttgttgatttgtatcaccataatttctttttaccaatatgtggtcttccagtaggggatgtggcacaatcaatctgttctctgtccatgggcatttaaggaattgcagataatcccagtctggaagcatttatccgtgtctcctgatgcatgtgtgcaagagtttctcttgggtatgttaattagcagtgraattgtaggttgataaagtatgtgtatctttacctttactgggcagtttttaaagtgtttgccttcatttacactcatactatcactgtaggagagttttcactccaccattactttcattgaatacttttcatatattaaccttttgttttcttctgtgaaatgacagtgcatggctttggacttctttttaattattaaattgtatttttctataaacgtacaagaggactttctatattttatatgtcattatttttgttggttatttgtattgctgaaagggtttaatttgtagct

SEQ ID NO: 60745 - DNA, 601 bp, Human
accttttgttttcttctgtgaaatgacagtgcatggctttggacttctttttaattattaaattgtatttttctataaacgtacaagaggactttctatattttatatgtcattatttttgttggttatttgtattgctgaaagggtttaatttgtagctgctcttgtcacatttatatagcattcttaataccaatcaagtccgatgtatctatcttttctgtcactatttttgcttttgggctcttgtttaagaaattctttcctggccaggtgtggtggctcaatcctgtaaccccawtactttgggaggccaaggcaggaggactgcttgagctgaggaatttcaaaccagcccggacaatctaacagtacttcgttactacaaataattgaaatattagctggccaatggtgacagacaccactggtcccagctacttgggaggctgagttgggggggttgcttgagcccaggaggtcaaggctgcagtgagccgacattggaccactgcactccagcctagacaacagagcaagaccatgtctcaaaacaaaacaaaacaaaaagcaaaaaaggaaattctttcctaccttagcc

SEQ ID NO: 60746 - DNA, 601 bp, Human
ggacaatctaacagtacttcgttactacaaataattgaaatattagctggccaatggtgacagacaccactggtcccagctacttgggaggctgagttgggggggttgcttgagcccaggaggtcaaggctgcagtgagccgacattggaccactgcactccagcctagacaacagagcaagaccatgtctcaaaacaaaacaaaacaaaaagcaaaaaaggaaattctttcctaccttagcctcataaagaattcttctatctttatttctaacagttttaaaatttcatctttcatctktaattcctcgatctttctggaactggcttttgtataaggagtgagataggaatctgacttcatgtagaatacctgtttgttccagagctattttttgaatggcttcttatctccccttggtctgaaatgcctgctcagtcataaaccaattttccacatatgagtaggtctgtatctgagctgctattcatgtttcaatgccatactacctgaatttctgtagttttaaaataaagattgatagagtttggacatatcaacccatcatatttttcaggattgaactgactattcttggac

SEQ ID NO: 60747 - DNA, 601 bp, Human
aaatattagctggccaatggtgacagacaccactggtcccagctacttgggaggctgagttgggggggttgcttgagcccaggaggtcaaggctgcagtgagccgacattggaccactgcactccagcctagacaacagagcaagaccatgtctcaaaacaaaacaaaacaaaaagcaaaaaaggaaattctttcctaccttagcctcataaagaattcttctatctttatttctaacagttttaaaatttcatctttcatctgtaattcctcgatctttctggaactggcttttgtatawggagtgagataggaatctgacttcatgtagaatacctgtttgttccagagctattttttgaatggcttcttatctccccttggtctgaaatgcctgctcagtcataaaccaattttccacatatgagtaggtctgtatctgagctgctattcatgtttcaatgccatactacctgaatttctgtagttttaaaataaagattgatagagtttggacatatcaacccatcatatttttcaggattgaactgactattcttggacctttctgttccatataaattttagataccatatatga

SEQ ID NO: 60748 - DNA, 601 bp, Human
agtaggtctgtatctgagctgctattcatgtttcaatgccatactacctgaatttctgtagttttaaaataaagattgatagagtttggacatatcaacccatcatatttttcaggattgaactgactattcttggacctttctgttccatataaattttagataccatatatgaagtccaacaaaaaaagaaaaagaaaaaacacaaacataccctgctgacattttgtttggggttgcatttaagtctgtagatcaacttggaggaaaatgcctttgttataatattgagtcatcttayccataaataggaactatctctccattaatttagctgttgaatgtcttagaatattttcgataaaggtcatatattttttagatttgtttctagatatgttaattttttagttactacagtctctctcacctttctctctcaagttacagtttctgttggctaatatggagaaattcagttgattttgtctgaaaagctttgtatttatcagtctttctaaacttattaaatgcttatgaattttctgtagattcttgggttttctatcagacatagataggacagtcatagcatgtgaat

SEQ ID NO: 60749 - DNA, 601 bp, Human
atatcaacccatcatatttttcaggattgaactgactattcttggacctttctgttccatataaattttagataccatatatgaagtccaacaaaaaaagaaaaagaaaaaacacaaacataccctgctgacattttgtttggggttgcatttaagtctgtagatcaacttggaggaaaatgcctttgttataatattgagtcatcttacccataaataggaactatctctccattaatttagctgttgaatgtcttagaatattttcgataaaggtcatatattttttagatttgtttcyagatatgttaattttttagttactacagtctctctcacctttctctctcaagttacagtttctgttggctaatatggagaaattcagttgattttgtctgaaaagctttgtatttatcagtctttctaaacttattaaatgcttatgaattttctgtagattcttgggttttctatcagacatagataggacagtcatagcatgtgaataacggaaattctatttctggttgagcacagtgtctcacacctgtaattctagcaattttggaggccaaggtaggaggatcacctgaggcca

SEQ ID NO: 60750 - DNA, 601 bp, Human
tattttttagatttgtttctagatatgttaattttttagttactacagtctctctcacctttctctctcaagttacagtttctgttggctaatatggagaaattcagttgattttgtctgaaaagctttgtatttatcagtctttctaaacttattaaatgcttatgaattttctgtagattcttgggttttctatcagacatagataggacagtcatagcatgtgaataacggaaattctatttctggttgagcacagtgtctcacacctgtaattctagcaattttggaggccaaggtrggaggatcacctgaggccaggagttcaagactagcctgggcaacctggcgagaatgtgtctataaaaaaattaaaaataaattaaaaaataaaattctgtttcttccactccagtccttttaacttttcaattatttttcatcttaccgtactggctagactcctcaccgcaacattaggttattcttgtcttagtggtactctttaaaagcatgtatttgatttgggttttctatagaggtactttagcatgttaaggaagttttcttctatttctagtttgctgtttttttcttaaaa

SEQ ID NO: 60751 - DNA, 601 bp, Human
ctctctcacctttctctctcaagttacagtttctgttggctaatatggagaaattcagttgattttgtctgaaaagctttgtatttatcagtctttctaaacttattaaatgcttatgaattttctgtagattcttgggttttctatcagacatagataggacagtcatagcatgtgaataacggaaattctatttctggttgagcacagtgtctcacacctgtaattctagcaattttggaggccaaggtaggaggatcacctgaggccaggagttcaagactagcctgggcaacctggygagaatgtgtctataaaaaaattaaaaataaattaaaaaataaaattctgtttcttccactccagtccttttaacttttcaattatttttcatcttaccgtactggctagactcctcaccgcaacattaggttattcttgtcttagtggtactctttaaaagcatgtatttgatttgggttttctatagaggtactttagcatgttaaggaagttttcttctatttctagtttgctgtttttttcttaaaaattatgaattggtactgaattttatcaaatgtcccttttctacattttt

SEQ ID NO: 60752 - DNA, 601 bp, Human
agttacagtttctgttggctaatatggagaaattcagttgattttgtctgaaaagctttgtatttatcagtctttctaaacttattaaatgcttatgaattttctgtagattcttgggttttctatcagacatagataggacagtcatagcatgtgaataacggaaattctatttctggttgagcacagtgtctcacacctgtaattctagcaattttggaggccaaggtaggaggatcacctgaggccaggagttcaagactagcctgggcaacctggcgagaatgtgtctataaaaaarttaaaaataaattaaaaaataaaattctgtttcttccactccagtccttttaacttttcaattatttttcatcttaccgtactggctagactcctcaccgcaacattaggttattcttgtcttagtggtactctttaaaagcatgtatttgatttgggttttctatagaggtactttagcatgttaaggaagttttcttctatttctagtttgctgtttttttcttaaaaattatgaattggtactgaattttatcaaatgtcccttttctacatttttttttttttttttgagactgag

SEQ ID NO: 60753 - DNA, 601 bp, Human
ttttcttctatttctagtttgctgtttttttcttaaaaattatgaattggtactgaattttatcaaatgtcccttttctacatttttttttttttttttgagactgagttttgtacttgttgcccaggtgggagtgcagtggtgcgatctcggctcacggcaacctccgcctcccgggttcaagcgattctcctgccttagcctccctagtagctgggattacaggcatgcgccaccacgcccggctaattttgtatttttagtagacacagtgtttctccatgctggtcaggctggtctmgaactcccaacctcaggtgatccacctgcgtcccttttctatatctttaaaggtggtcatatgatttttttgttgaatttcttattgcggcaaattttattaatagattttctacatggaactgtttacttggataaacaacattttcatgatgtttttaacatcacctttttttaacatgtcgctggatttgactcttgaagattttgggggagggtgggggacttactgtatgtataatcatgagggaaactggcctctaattttcctttcttatcctttcctcaagcgatttgacac

SEQ ID NO: 60754 - DNA, 601 bp, Human
tgaattggtactgaattttatcaaatgtcccttttctacatttttttttttttttttgagactgagttttgtacttgttgcccaggtgggagtgcagtggtgcgatctcggctcacggcaacctccgcctcccgggttcaagcgattctcctgccttagcctccctagtagctgggattacaggcatgcgccaccacgcccggctaattttgtatttttagtagacacagtgtttctccatgctggtcaggctggtctcgaactcccaacctcaggtgatccacctgcgtcccttttctayatctttaaaggtggtcatatgatttttttgttgaatttcttattgcggcaaattttattaatagattttctacatggaactgtttacttggataaacaacattttcatgatgtttttaacatcacctttttttaacatgtcgctggatttgactcttgaagattttgggggagggtgggggacttactgtatgtataatcatgagggaaactggcctctaattttcctttcttatcctttcctcaagcgatttgacactgaagcttactgctgtcttaaagtttttgtttgtttctttgt

SEQ ID NO: 60755 - DNA, 601 bp, Human
ggctaattttgtatttttagtagacacagtgtttctccatgctggtcaggctggtctcgaactcccaacctcaggtgatccacctgcgtcccttttctatatctttaaaggtggtcatatgatttttttgttgaatttcttattgcggcaaattttattaatagattttctacatggaactgtttacttggataaacaacattttcatgatgtttttaacatcacctttttttaacatgtcgctggatttgactcttgaagattttgggggagggtgggggacttactgtatgtataatcrtgagggaaactggcctctaattttcctttcttatcctttcctcaagcgatttgacactgaagcttactgctgtcttaaagtttttgtttgtttctttgttttgatctctcttcttgggaagagtttgttatgttctgattatgtattccttgagtattttctataactcactgggaaaattcctaaacgtactgtgttttttgtgctttgggaagatttgactattgattcaaattctttaacagaaccctttagggttttcactctcttctcatgccagtttgggcattatagcttcct

SEQ ID NO: 60756 - DNA, 601 bp, Human
gtgtgctaattcccaaagatatgcaggtgatcctactgttgtcatttctgtctctgatttcaggtttgtacatttcaaatgggagagagctcttttttttatttttttagtttagtgggacaatatttatctttttaaaatgtagcatttactcgtcttactttggttgtgattacacatgtttgcacttagtttccactacaatcttattttgtcctttttgcatgctgcagtttttcttcatcaccccttatctccctatttctttctttaagaattactttctggccaggcatggtgkctcacgcctgtaatcccagcactttgggaggccaaggcgggcagatcacttgaggcctggaggttgagaccagcttggccaacatggtgaaaccccttctctacaaaaatagaaaaattagccagacgtggtggcggacacctgtaatcccagctactctggaggctgaggtatgagaatcgcttgaattcaggaggcagagtttgtagtgagcccagatcacaccactgcacttcagcttgggtgacaaagcgagacactgtcaaaaaaaaaaaaaaaaaaaaaaaggaatgattttat

SEQ ID NO: 60757 - DNA, 601 bp, Human
aaggcgggcagatcacttgaggcctggaggttgagaccagcttggccaacatggtgaaaccccttctctacaaaaatagaaaaattagccagacgtggtggcggacacctgtaatcccagctactctggaggctgaggtatgagaatcgcttgaattcaggaggcagagtttgtagtgagcccagatcacaccactgcacttcagcttgggtgacaaagcgagacactgtcaaaaaaaaaaaaaaaaaaaaaaaggaatgattttatttatttattttaatcaggtttttaccctttattrgtttggaagttacacattatagttctgggcttgtttaaatggataccttagaaatttcagcatgcattcttaaaatctaaagttaaccagttaaggactttggagcatttaaggctgataactcctacttgatttatatttttgccaataatttggttttatgttttcttaaccttacacaccaaatatttttaccatttaacttttaaaagtaagtctgtatttgtttacatttattcacttaattactactgccttttctaaccatttctttcacatatcaaagattccttttgatat

SEQ ID NO: 60758 - DNA, 601 bp, Human
gtatgagaatcgcttgaattcaggaggcagagtttgtagtgagcccagatcacaccactgcacttcagcttgggtgacaaagcgagacactgtcaaaaaaaaaaaaaaaaaaaaaaaggaatgattttatttatttattttaatcaggtttttaccctttattagtttggaagttacacattatagttctgggcttgtttaaatggataccttagaaatttcagcatgcattcttaaaatctaaagttaaccagttaaggactttggagcatttaaggctgataactcctacttgatttayatttttgccaataatttggttttatgttttcttaaccttacacaccaaatatttttaccatttaacttttaaaagtaagtctgtatttgtttacatttattcacttaattactactgccttttctaaccatttctttcacatatcaaagattccttttgatatcactgttgttcttgaagcttgtcattgacaagtttctttcatgagaagatttttgacaatgaagtctctttatgtgtctgaaggaaacttatttatagaagatagttttgttgaaaatgattgtaggtttatacttt

SEQ ID NO: 60759 - DNA, 601 bp, Human
cagcttgggtgacaaagcgagacactgtcaaaaaaaaaaaaaaaaaaaaaaaggaatgattttatttatttattttaatcaggtttttaccctttattagtttggaagttacacattatagttctgggcttgtttaaatggataccttagaaatttcagcatgcattcttaaaatctaaagttaaccagttaaggactttggagcatttaaggctgataactcctacttgatttatatttttgccaataatttggttttatgttttcttaaccttacacaccaaatatttttaccatttawcttttaaaagtaagtctgtatttgtttacatttattcacttaattactactgccttttctaaccatttctttcacatatcaaagattccttttgatatcactgttgttcttgaagcttgtcattgacaagtttctttcatgagaagatttttgacaatgaagtctctttatgtgtctgaaggaaacttatttatagaagatagttttgttgaaaatgattgtaggtttatactttttcctggaacttgaaagatggtatttgattgacagttggcttctgactgttgaggagtcaactct

SEQ ID NO: 60760 - DNA, 601 bp, Human
tgtcaaaaaaaaaaaaaaaaaaaaaaaggaatgattttatttatttattttaatcaggtttttaccctttattagtttggaagttacacattatagttctgggcttgtttaaatggataccttagaaatttcagcatgcattcttaaaatctaaagttaaccagttaaggactttggagcatttaaggctgataactcctacttgatttatatttttgccaataatttggttttatgttttcttaaccttacacaccaaatatttttaccatttaacttttaaaagtaagtctgtatttgyttacatttattcacttaattactactgccttttctaaccatttctttcacatatcaaagattccttttgatatcactgttgttcttgaagcttgtcattgacaagtttctttcatgagaagatttttgacaatgaagtctctttatgtgtctgaaggaaacttatttatagaagatagttttgttgaaaatgattgtaggtttatactttttcctggaacttgaaagatggtatttgattgacagttggcttctgactgttgaggagtcaactctcattataaccatgtcagctctttgt

SEQ ID NO: 60761 - DNA, 601 bp, Human
ttcctgcttcggattcattgtgcctcctgaatatgaggatttgagaattttgtcaaccctggaaaaccctcaaccattagctcttaaaagttgaaaagtaaatgaagtcatccagcattgttaggtattcttcagtggaatgtttgttcaaaatgtcaagttaggccaggcatggtgactcatacctgtaatcctggcactttgggaggccaaggcgggggtatcacttgtgcccaggagttcaagaccagcttgggcaacatagcaagactccgtctctaccaaaaaaaaaaaaaaaaamcaaattaaccaagaatgatgttgtacacctgtatcccaggtactcaggaagctggggtgggaggatcacttgagcccaggagttcaagaccagcttgggcaacatagcaagactccgtctctaccgaaaaaaaaaaaaaaaaaacaaattaaccaagcatgatgttgtacacctgtatcccaggtactcaggaggctggggtgggaagatcacttgagcccaggagttcaaggctgcaatgagctgtgatcgcgccactgcactctactgtgggtgacacagaaagaccctgtctcaaaa

SEQ ID NO: 60762 - DNA, 601 bp, Human
tacacctgtatcccaggtactcaggaggctggggtgggaagatcacttgagcccaggagttcaaggctgcaatgagctgtgatcgcgccactgcactctactgtgggtgacacagaaagaccctgtctcaaaaaacaaaacaaaaaaagtcaacttagctccattgccagaattcgcagatacatgaatgaggttttaccccacattattttatctgaattttggtataatcttctatttattttacaattatttacttaagcagaaaatcaagaagatgttaaaaaaaaaaaaagggacrtattacctaaaatactagggaagaagaaaccgtgttttttaagtagaataggccaaatgtcaacagacatccagggtactagaaaatattgagacgcgtctaaacacacaaacctgtcttcgaacctctagtcacacagcatgtttgcattctatatttccatgaaacttggagtgaggagggagagaaaatacatttatttttatcctctttagttaaaattgcatatcaggatttctttttttaggagttgcaggttaacttctaaagttatctcccacctgcactacatagggagac

SEQ ID NO: 60763 - DNA, 601 bp, Human
agggattaagaagataatctctatcatttatatttgggtctggtcagatgcttttgtaattatatttctatttgatgcctcctttatctgagattttatatatttttttaaatctggagacaggatctcactctgtcacccaggttggagtgcagtggcatgatcatatagtagctcactgtaatctcagcctcctgggttcaagcaatcctctcacctcagtctccagggtagctgagatacaggagtgtactactacatctggctaatttttaaatgtttttgtagcgatggggtctcrgtgtgttgcacagcctcgtctcaaactcctgggcaagtgatcctcctgccatggcctcccaaagtgctgggattttaggcgtgaaccaccattcctggcctgtctgagattttataatacttaaaacaaccacacagtgttggctcatttaacttcttcatccattcacatttgcttgtgggtccagaatgaatctgcttttctactgatgcctcaagtaggtcccaacttcttttataaatatgtaaaaatctattgccttttcctgtggttactgcttgtgagagaaaacatactcga

SEQ ID NO: 60764 - DNA, 601 bp, Human
tgcagtgacttacacctgtattcccagcactttgggaggccagaggcaagcagattgcttgagctcaggagttccagaccagcctgggcaacatggtaaaaccttgtctctacaaaaaaaatacaaaaactagcccagcatggtggagtgtacctgtagtcccagctacttgggaggctaaggcgggaggatggcttgagccaggaggcagaggttgcaatgagccaagactgtgccattgtactctaccagggtgacagagtcagccctgtctaaaaaaacaaacaaacaaacaaacaaccaaacaaaaaactgtagtaaaaagaaattcattgatgttgtatttcaaagcaataggaaatatagccaaagaaaatattttaacacctttgagataaaagagagatagagatgactggtgtcagctatcttttatgactgcccaaatatcgcttccctttgggcttcctgtttctgtgtttacatttttttttaccttgttagaaagtaactgtttagataacactatttattcattaaaataaatatatgtatatgcgtgtattgatatatatatatatatatatttgaaatcctatta

SEQ ID NO: 60765 - DNA, 601 bp, Human
tcccagctacttgggaggctaaggcgggaggatggcttgagccaggaggcagaggttgcaatgagccaagactgtgccattgtactctaccagggtgacagagtcagccctgtctaaaaaaacaaacaaacaaacaaacaaacaaacaaaaaactgtagtaaaaagaaattcattgatgttgtatttcaaagcaataggaaatatagccaaagaaaatattttaacacctttgagataaaagagagatagagatgactggtgtcagctatcttttatgactgcccaaatatcgcttccctytgggcttcctgtttctgtgtttacatttttttttaccttgttagaaagtaactgtttagataacactatttattcattaaaataaatatatgtatatgcgtgtattgatatatatatatatatatatttgaaatcctattaagtacaaggcagtatgccaatgccacatgcagatagatatagcaagatgatcaagatagagtatttcatgcaaggggaccggcatattcccaagagcaggagagagagcaagattggttttagaaatggcaagcagtttaatataactggatcagcgac

SEQ ID NO: 60766 - DNA, 601 bp, Human
tgggaggctaaggcgggaggatggcttgagccaggaggcagaggttgcaatgagccaagactgtgccattgtactctaccagggtgacagagtcagccctgtctaaaaaaacaaacaaacaaacaaacaaacaaacaaaaaactgtagtaaaaagaaattcattgatgttgtatttcaaagcaataggaaatatagccaaagaaaatattttaacacctttgagataaaagagagatagagatgactggtgtcagctatcttttatgactgcccaaatatcgcttccctttgggcttcctstttctgtgtttacatttttttttaccttgttagaaagtaactgtttagataacactatttattcattaaaataaatatatgtatatgcgtgtattgatatatatatatatatatatttgaaatcctattaagtacaaggcagtatgccaatgccacatgcagatagatatagcaagatgatcaagatagagtatttcatgcaaggggaccggcatattcccaagagcaggagagagagcaagattggttttagaaatggcaagcagtttaatataactggatcagcgaccacaaaaaaac

SEQ ID NO: 60767 - DNA, 601 bp, Human
aatactagatgtaatgaaatgatgggtctgtgagtgatatttaaggtttataactatatttttttcttaagctagtcaagtacagtgttgagaaggaggaaagagtggaacaaggagtccaatctgtaacttgtagctacattacaaaaataagaattatgtaaatacttatagggaacagtaaacgtgttatggcaagtttgaaactgtctatcccctaatccttttttctaccatcaaaactattgtcttaaatcagattttgttgttgttgttgttgttgttgttgttgttgttgttgttttaatagcttggaacttcttggaacacaattgtgttagaacatactgtgctacagtattcctatccattccagcaagagcttcggtagagttgtatataaagctttaccagttaattttgagctttctctgaaaagcatatggcatgttttatacagaaaaaccattttaaaacatagaacattgggaattttggccatgaactgaaagaaaatggtttgaagatatgatcttctaattcgttataggagtggggaagaggtttctcatatggtatgattttaaagatctattaaaaa

SEQ ID NO: 60768 - DNA, 601 bp, Human
tttattttttccatatgcacttagagaatatgcaaaaataaatgtccagaaataaaaatttgccaaagattgccacatatgcctgaatataagatgaggcttttttcccctcagaattattcttcagaaaagagagagtcaccttatatttgaaatctcacaagatctcccatggtgcaagaagtacattttccattactttattttgaacaacaatgtgctgcttgctggagatacatgggcctgcatgatgtcaatcaatcttattttggtgtgtttatataagtcacctgatacattygacttaaatgtttaaatagagatttaacatttacttctagagacatgacgtcacacttgtaaatattggatgctatggtaaactcaaacattcaaaacaaatactgtttccaattagttgaaaggaagttcccattagaaaggggttaggtgacccagtatctctcctgatatccacaagacagatgagaagttttcagaggattttttaaaaattaaatatggataaggatgtggagagagggatacttctaagttagtgcagttggccattgaacaatgagaggttatgggcatggac

SEQ ID NO: 60769 - DNA, 601 bp, Human
atacatgggcctgcatgatgtcaatcaatcttattttggtgtgtttatataagtcacctgatacatttgacttaaatgtttaaatagagatttaacatttacttctagagacatgacgtcacacttgtaaatattggatgctatggtaaactcaaacattcaaaacaaatactgtttccaattagttgaaaggaagttcccattagaaaggggttaggtgacccagtatctctcctgatatccacaagacagatgagaagttttcagaggattttttaaaaattaaatatggataaggatktggagagagggatacttctaagttagtgcagttggccattgaacaatgagaggttatgggcatggaccccctacaaagccaaaatccatgtgtaacttttgactcctaaaaaaaccaaatagcgtatcgttgacccaaagctttaccaatatcataaaaggttggttaacacatattttgtgtgttatatactgcatactgtctccacagaagagagaaaacatgagaagatcacaaaggtccttttgttgccaggctggaaaatggcaggcatcattctccacgcatttcactggccaa

SEQ ID NO: 60770 - DNA, 601 bp, Human
agacatgacgtcacacttgtaaatattggatgctatggtaaactcaaacattcaaaacaaatactgtttccaattagttgaaaggaagttcccattagaaaggggttaggtgacccagtatctctcctgatatccacaagacagatgagaagttttcagaggattttttaaaaattaaatatggataaggatgtggagagagggatacttctaagttagtgcagttggccattgaacaatgagaggttatgggcatggaccccctacaaagccaaaatccatgtgtaacttttgactcctmaaaaaaccaaatagcgtatcgttgacccaaagctttaccaatatcataaaaggttggttaacacatattttgtgtgttatatactgcatactgtctccacagaagagagaaaacatgagaagatcacaaaggtccttttgttgccaggctggaaaatggcaggcatcattctccacgcatttcactggccaaaattcaatcacgtgggccaatctaactgcaaggaaggctagaaatttagttgtctgtattctgaggaagaaaatggagttagtaagcatcttggatctctgccacagt

SEQ ID NO: 60771 - DNA, 601 bp, Human
aacacatattttgtgtgttatatactgcatactgtctccacagaagagagaaaacatgagaagatcacaaaggtccttttgttgccaggctggaaaatggcaggcatcattctccacgcatttcactggccaaaattcaatcacgtgggccaatctaactgcaaggaaggctagaaatttagttgtctgtattctgaggaagaaaatggagttagtaagcatcttggatctctgccacagtatctgactatctttgacagcactgagagtcagccacaaggtatttattctttgttaaatgtgacatcaccttatatttggaatctccttctatttgggcatatatagcagttgcctcaaaacttcgaagtcatagaaaattatttatggctagatcttttaaagagtttttgtaatcgaggcaaattgacatagaacatggaaatgtatctaaaatgattggaaacttattataattagaaatgtattaaaactcaggggaatggccctgagtctgggggtgtcgggatacctggcccagttggatttttttttttttctctttttttttttttttgagatgaagtctcgctctgtcacc

SEQ ID NO: 60772 - DNA, 601 bp, Human
ttctgttagagcattcggatttatatagaacgaaagtttgctttgctttaaaacatcaattccttgatcccagttctgttctccctgggccttatggagtatacgatcaccttcttcctctttagattttttcttctctgggctaaaaatctcaaagtcctcatgtgacatgtttttatgccctcttacctgatttcctcccatgtgagtgtgctataaatacagctcttccaaagcagaacacatcagattaaatacttgtgatctggcagggcacggaatagaatggcgtaggccagcrcgtgaattggtggtaaactgaaggtcatcggggagaaaataacttctctaccctcttcggtgtagtatttaaggccagtgaattaaactaacaaaaggcacatctcacaggatacgagacatgcaattttattaacattttacatgcactggagttcacagaaaaggagtgaaagtcgaagtgggaggattgggggcttatataccattttaaacaaagaaaagggtgtctgcatttcacgagatgctgaattgcaggaaggtgactaggaagaatatgcggaagctaatggaagatgag

SEQ ID NO: 60773 - DNA, 601 bp, Human
atttatatagaacgaaagtttgctttgctttaaaacatcaattccttgatcccagttctgttctccctgggccttatggagtatacgatcaccttcttcctctttagattttttcttctctgggctaaaaatctcaaagtcctcatgtgacatgtttttatgccctcttacctgatttcctcccatgtgagtgtgctataaatacagctcttccaaagcagaacacatcagattaaatacttgtgatctggcagggcacggaatagaatggcgtaggccagcacgtgaattggtggtaaastgaaggtcatcggggagaaaataacttctctaccctcttcggtgtagtatttaaggccagtgaattaaactaacaaaaggcacatctcacaggatacgagacatgcaattttattaacattttacatgcactggagttcacagaaaaggagtgaaagtcgaagtgggaggattgggggcttatataccattttaaacaaagaaaagggtgtctgcatttcacgagatgctgaattgcaggaaggtgactaggaagaatatgcggaagctaatggaagatgagggttattttagtaaggtg

SEQ ID NO: 60774 - DNA, 601 bp, Human
gtatacgatcaccttcttcctctttagattttttcttctctgggctaaaaatctcaaagtcctcatgtgacatgtttttatgccctcttacctgatttcctcccatgtgagtgtgctataaatacagctcttccaaagcagaacacatcagattaaatacttgtgatctggcagggcacggaatagaatggcgtaggccagcacgtgaattggtggtaaactgaaggtcatcggggagaaaataacttctctaccctcttcggtgtagtatttaaggccagtgaattaaactaacaaaagrcacatctcacaggatacgagacatgcaattttattaacattttacatgcactggagttcacagaaaaggagtgaaagtcgaagtgggaggattgggggcttatataccattttaaacaaagaaaagggtgtctgcatttcacgagatgctgaattgcaggaaggtgactaggaagaatatgcggaagctaatggaagatgagggttattttagtaaggtgtgtttctgcatctcatctccatgccaactcaccatctccagcagtaagacacaacttttctgttcctggtacagcagagg

SEQ ID NO: 60775 - DNA, 601 bp, Human
gcataatcttattcatgggggccccacactcatgacctaactaccttgttaaagccccacctgctgataactatagccttggagattaagtttcaacatatgaattttgggggaacatgttcagtccatagtaaaaactaagaaggtaaagaggatgaggagttggggagtgataaaaatggcttctgtgggccaagcgcagtggctcacaccagtaatcccagcatttgaagtgtctgaggcgggaggattgccagagctcaggagttggagaccagattgggcaacatagtgtgacccctcatggcaaaaaatcaaaaattaactggcatggtggtccacatctgtggtgccagctactcgggaggatcacttagaggttgcagtgagttgtgatcatgccactgcactccagcctgggtgacagagcaaggccctatcccccaccccccagagaaaagcttctgtgaaggtgacatttgatcaaaattgtgaatggagtgagaatgtgtccatgtggatatttgaggatagattatttcaggcagtggaaaccataaaggcaaagctctgaagcacattctaggaacagcccagatcc

SEQ ID NO: 60776 - DNA, 601 bp, Human
cctttggactatgttgtgaatgttagaacatctgatggaaggtgctgagcaagagtggcatgatttgatataaacttcaaatcttaaaagccctcataaaagaaaaacactgattgctttgtggggaaaaagccatgggattgggaaccagtgtggaagcgggaaatgggtcaggtggccagtagttgaggggtgttgttgacctcagtccttactccagtttaataaccatccggctgggtgtggtggctcacgcctgtaatcccagcactttgggaggccaaggagggtagatcacccrggtcaggaggtcgagaccatcctggccaacatggtgaaaccccgtctctactaaaaatagaaaaaattagctgggtgtggtggcgcatgcctgtaatcccagctactcaggaggctgaggcaggagaattgcttgaaccagggagtcagaggttacagtgagctgatatcgcgtcactgcactctagtctgccgacagagcaagattccatctcaaaaaaataaataaccatccaaaaactgaactatatggcttccttgatggggtttgtttttcatcaacttttgctggctcctagca

SEQ ID NO: 60777 - DNA, 601 bp, Human
tcacgcctgtaatcccagcactttgggaggccaaggagggtagatcacccaggtcaggaggtcgagaccatcctggccaacatggtgaaaccccgtctctactaaaaatagaaaaaattagctgggtgtggtggcgcatgcctgtaatcccagctactcaggaggctgaggcaggagaattgcttgaaccagggagtcagaggttacagtgagctgatatcgcgtcactgcactctagtctgccgacagagcaagattccatctcaaaaaaataaataaccatccaaaaactgaactatayggcttccttgatggggtttgtttttcatcaacttttgctggctcctagcaattctgcttttcatctttttctttttgttactacaaaatttccttttttcttttttttgctggctttactgaggtataattgacaaataaaaattgtatatacttatgatacatagtgtgtgtggttttctgggatttttgttgttgctttttaaattttttttaaagacagggtctcactgtcgcccaggctggaatgcaatggcacagtcacagcgccctgcagccttgatctcctgggttcaagcca

SEQ ID NO: 60778 - DNA, 601 bp, Human
aattatagtggagactattaaagagcttgagtgtatccatgttgttgggtctacatgtaaaaacaatatatatatatatatgtatatatatatatatgtgtatatatatatatgtatatatatatgtgtatatatatatatgtatatatatatgtgtatatatatatatgtatatatatatatatatatataaataaggaacttaactatacataattttctgcagtatgaaggctgaacagatcttaattttttctacacatttttgtttttactttagcatgcatttgactgagtcgtraagtttttaagggtgtgagatatgcttttttatgttttaatccccaattcagtgcctgaatgctgacgggtgctacacagacagtgaatcagtgggtctgtgcaaacgagggccagtgagaaacaccctagtgtcctaactgaaggaagaggccatttccagtgacagcacactcatcagttcacctggagtaccggaggcacgttttcaggttgactagggaaccaatgaggcttctgacaagcaggggacttgggtgcagggccagcaggagcccaggcctcctttctagcaagctgt

SEQ ID NO: 60779 - DNA, 601 bp, Human
ttgtcttaaataatttgagtaactaataggcattaagtaatttgagcaaatattgttctccagaggttgagaatcctttattgtccctttcctcccaggaccactcagtataatgttggaagagagccttctgtccttatccaggtgcagggaatgaaccagatgattcaattcctacataccttttttttttttttttttaaacagagtctcactctgtcacccaggctggaatgcagtggcatgatctcagctcactgaaacctccacctcccaggttcaagagattctcctgcctcarcctcccaagtagctggggttacaggtgcctgccgccacacctagctaatttttgtatttttaatagagacgaggtttcgccatgttggccagactagtcttgaatgcctaacctcgagcaatccgcccgccttggcctcccgaagtgctggaattacaggcgtgagccaccacacccagccacgccctttcttagactagaccctgaaaaaggatcccttttcatcactcccactgctcttaaggattctccctgctgtggtctaaatgttcgtgtccccagaattcaaatgttgaaatc

SEQ ID NO: 60780 - DNA, 601 bp, Human
ttttcatcactcccactgctcttaaggattctccctgctgtggtctaaatgttcgtgtccccagaattcaaatgttgaaatcctaacgccaaaggtgatggttttaggagggggtgccttagggaggtgatgagctcatgagggtggagccctcatgaatgggattagtgcccttagaaaagaagccccagagagcttcctcatcctttccaccaggagaggatgcagagagaaggtgtcattctttccactgaggacagtcgagtgcaaagagccagaacgatctgggttaacatcccarttctatcacttatttcactgtgtgtccttcagcaagttactgaattgattgtattttctgtttatttaacaaatatttatacaaagagcttaccattgccaagcattattctaagtccttcacagatgataattcatttaatgcttgcaataactgcaaaaaatagaaactctcagtatccaagttttatggcgggagcagtggggagactgtgaagtcacttgtgcaacgtcccacagctaggaaaaaagtaagcaggactgcaacctacgtatttagtactagaggtgtttagtaccc

SEQ ID NO: 60781 - DNA, 601 bp, Human
ccactgctcttaaggattctccctgctgtggtctaaatgttcgtgtccccagaattcaaatgttgaaatcctaacgccaaaggtgatggttttaggagggggtgccttagggaggtgatgagctcatgagggtggagccctcatgaatgggattagtgcccttagaaaagaagccccagagagcttcctcatcctttccaccaggagaggatgcagagagaaggtgtcattctttccactgaggacagtcgagtgcaaagagccagaacgatctgggttaacatcccaattctatcacttrtttcactgtgtgtccttcagcaagttactgaattgattgtattttctgtttatttaacaaatatttatacaaagagcttaccattgccaagcattattctaagtccttcacagatgataattcatttaatgcttgcaataactgcaaaaaatagaaactctcagtatccaagttttatggcgggagcagtggggagactgtgaagtcacttgtgcaacgtcccacagctaggaaaaaagtaagcaggactgcaacctacgtatttagtactagaggtgtttagtacccgagtgagttcac

SEQ ID NO: 60782 - DNA, 601 bp, Human
ccagaacgatctgggttaacatcccaattctatcacttatttcactgtgtgtccttcagcaagttactgaattgattgtattttctgtttatttaacaaatatttatacaaagagcttaccattgccaagcattattctaagtccttcacagatgataattcatttaatgcttgcaataactgcaaaaaatagaaactctcagtatccaagttttatggcgggagcagtggggagactgtgaagtcacttgtgcaacgtcccacagctaggaaaaaagtaagcaggactgcaacctacgtrtttagtactagaggtgtttagtacccgagtgagttcacttaatccgctctgctatgctactctagatttccgtaatttgtaagtaatttgtaaaataacagcttgacaaagattgctgtgagaattcagccaatgctagctagcttccttctccccttccatttcatagagagggtaaagtaacacactggtttgagtattagtgaaagatgatggcatttagaattgtaaattgagggaacaaagtaatcaatgatatcatgagaagcaaaaaagacttttttggacttttgcagttgt

SEQ ID NO: 60783 - DNA, 601 bp, Human
gatctgggttaacatcccaattctatcacttatttcactgtgtgtccttcagcaagttactgaattgattgtattttctgtttatttaacaaatatttatacaaagagcttaccattgccaagcattattctaagtccttcacagatgataattcatttaatgcttgcaataactgcaaaaaatagaaactctcagtatccaagttttatggcgggagcagtggggagactgtgaagtcacttgtgcaacgtcccacagctaggaaaaaagtaagcaggactgcaacctacgtatttagtwctagaggtgtttagtacccgagtgagttcacttaatccgctctgctatgctactctagatttccgtaatttgtaagtaatttgtaaaataacagcttgacaaagattgctgtgagaattcagccaatgctagctagcttccttctccccttccatttcatagagagggtaaagtaacacactggtttgagtattagtgaaagatgatggcatttagaattgtaaattgagggaacaaagtaatcaatgatatcatgagaagcaaaaaagacttttttggacttttgcagttgtactaagt

SEQ ID NO: 60784 - DNA, 601 bp, Human
tacaaagagcttaccattgccaagcattattctaagtccttcacagatgataattcatttaatgcttgcaataactgcaaaaaatagaaactctcagtatccaagttttatggcgggagcagtggggagactgtgaagtcacttgtgcaacgtcccacagctaggaaaaaagtaagcaggactgcaacctacgtatttagtactagaggtgtttagtacccgagtgagttcacttaatccgctctgctatgctactctagatttccgtaatttgtaagtaatttgtaaaataacagcttgrcaaagattgctgtgagaattcagccaatgctagctagcttccttctccccttccatttcatagagagggtaaagtaacacactggtttgagtattagtgaaagatgatggcatttagaattgtaaattgagggaacaaagtaatcaatgatatcatgagaagcaaaaaagacttttttggacttttgcagttgtactaagtttctatggttttaccatttgttttctggaaagattaaaaaccattttgttgaactggtaattccaagcttttaattttgttttcaccaagtgtttgttg

SEQ ID NO: 60785 - DNA, 601 bp, Human
aattttgttttcaccaagtgtttgttgctcatttattacacacattgaatttgccccagtttttccctaccacaagtatctaatacagtgagataggtgttttgcttctgcccatggttttttgggtaatacctgacatgctaacattattctgttattttttcagttcattattaaagttgtttgggggaatttgaacacatctgattcctctcaggaacgagaggggaaattgtctagcagctggcaccctgagaactggtacaaattactatgtccgatagtttatcttgaactacgrtgtttataactaccaacagagcatcaatttaacaaaaattgcagtacttagtattaaaagaggcttgcactttaaggaagaatgtggagaattttcttttccattacacacgtactggccatattttggcaacagagtttccagtgtcattggctctgaattgaaaaacatgagtgagtatcctttcctatgtacaggagatttccgaggtacgtaatgtgattgttattcattattcaggttacttctagagctctctaagcaagatgtgcatggggaaataaatatgaacgagagaga

SEQ ID NO: 60786 - DNA, 601 bp, Human
tatctaatacagtgagataggtgttttgcttctgcccatggttttttgggtaatacctgacatgctaacattattctgttattttttcagttcattattaaagttgtttgggggaatttgaacacatctgattcctctcaggaacgagaggggaaattgtctagcagctggcaccctgagaactggtacaaattactatgtccgatagtttatcttgaactacggtgtttataactaccaacagagcatcaatttaacaaaaattgcagtacttagtattaaaagaggcttgcactttaargaagaatgtggagaattttcttttccattacacacgtactggccatattttggcaacagagtttccagtgtcattggctctgaattgaaaaacatgagtgagtatcctttcctatgtacaggagatttccgaggtacgtaatgtgattgttattcattattcaggttacttctagagctctctaagcaagatgtgcatggggaaataaatatgaacgagagagaccgtctgtgtccttctgatgcttcattctgaagacggaaggccagatgtaacaagcacagtgaatacagtgctctg

SEQ ID NO: 60787 - DNA, 601 bp, Human
aactacggtgtttataactaccaacagagcatcaatttaacaaaaattgcagtacttagtattaaaagaggcttgcactttaaggaagaatgtggagaattttcttttccattacacacgtactggccatattttggcaacagagtttccagtgtcattggctctgaattgaaaaacatgagtgagtatcctttcctatgtacaggagatttccgaggtacgtaatgtgattgttattcattattcaggttacttctagagctctctaagcaagatgtgcatggggaaataaatatgaacragagagaccgtctgtgtccttctgatgcttcattctgaagacggaaggccagatgtaacaagcacagtgaatacagtgctctgggatgtcaaaaagagaagggataatttatgaccggggcaccaggaagccctgtagaagtggtgggattgggccaggtgtgatggctcacgcctgtaatcccagcactttgggagaccaaggcaggcagatcacatgacgtcagaagtttgagaccagcctggtcaacatggtgaaaccctgtctctaccaaaaatacaaaaattagctgggcgtggt

SEQ ID NO: 60788 - DNA, 601 bp, Human
gggagctttaaagtttggaaaataagacatgatcactggctttggaaagaattgttttattagaacatggtaggtgtggaagcccaatttaagaaatcttggagtgactttgaaaaaaaaaaaggcatgaacagaaagtacatcacatccctggttagagcattgttaatgatataaaataaagatttaatgaaagtttagaggaagaacaagattcagatttctttttaaaaaaatctttacattttgctcaacacagggaaattctttgcctccaaacccgagagctatttttgttttyttttaagggcatgggcaaaatgaacaggattaagtagaagaaaagaagcagaaaagaagggataatggagagggaaagacactttctttttgttttttaatagagatagggtcttgctctgttgcccaggctggagcgtagtggtacagtcacagctcactgtagcctcaaactcttgggcttaagcagtcctcccacttcagcctcccaaagtactgggattataggggtgagccactgtacctggacctactactaaaatccctggaatggtagttcttaaatgttagcttgggccgg

SEQ ID NO: 60789 - DNA, 601 bp, Human
atggtaggtgtggaagcccaatttaagaaatcttggagtgactttgaaaaaaaaaaaggcatgaacagaaagtacatcacatccctggttagagcattgttaatgatataaaataaagatttaatgaaagtttagaggaagaacaagattcagatttctttttaaaaaaatctttacattttgctcaacacagggaaattctttgcctccaaacccgagagctatttttgtttttttttaagggcatgggcaaaatgaacaggattaagtagaagaaaagaagcagaaaagaagggataayggagagggaaagacactttctttttgttttttaatagagatagggtcttgctctgttgcccaggctggagcgtagtggtacagtcacagctcactgtagcctcaaactcttgggcttaagcagtcctcccacttcagcctcccaaagtactgggattataggggtgagccactgtacctggacctactactaaaatccctggaatggtagttcttaaatgttagcttgggccgggcatggtggctcacacctgtaatcccagcactttgggaggccaaggtgggcagatcacctgagacc

SEQ ID NO: 60790 - DNA, 601 bp, Human
ggtagttcttaaatgttagcttgggccgggcatggtggctcacacctgtaatcccagcactttgggaggccaaggtgggcagatcacctgagaccagcctggccaacatggtgaaacaccatctctactaaaaacacaaaaattagcagggcatgatggtgggtgcctataatattatccagctactcaggagcactgaggcaggagaatcacctgaacctgggaggcggaggttgtggtgagctgagattgtgtcattgcactctagcctaggcgacaagagcaaaactctctctcatttaaaaaaaaaaaaaaaaaaaaaagaaaagaaaagaaagaaaggaaagaaaaaaaagttagactacagaattccctgcaggacttgtttaaatacaggcttcctggcctcagccccagagtctctgttcatcagaaactgggtacagcctaagaaccggcctttctaacaagttcccaggtgatgctgatgcagttgacctggggatgacaatttgacaacctccaccccagagaagggaaaaatgtagaatctaggttgcaggtcaaggtgtgccctgggagagagaaaaggcacatcttt

SEQ ID NO: 60791 - DNA, 601 bp, Human
ctcccacctggcccctgctctgtttcagattttgttcattgcagtcatggatagagagtttctgtcatgaagacacatcacatctgccacatcagtttagcactgttctaaactaggttgcgacagaatttgttcaatgtgaagtttttctgatttggtgtatattaggaaactcaatgtctttagggctgtgtttttccgataaacacatttttcccctgcagaggatgtttgaccattttctttgttactcctctcccagaagagaggaaacttctcacctgcaaggactttttgctcygcagttcccttcacactcacatattctcctgtgtcacagctctggggtatgtcttatgctcacccatcacgtagttcgttatcaccactacagatattgacaagctagtgaaacctgcgttttcattgcatttaactttgaaggcacacatctttgaacagaatgctaggtgctaatgtcatagcttacatctagatagggctctatttatgatgctgttatgttgtcttcataatctattgtggtattcagtttagctcataacagctgtataaattcaggttgccaagggtaaaagag

SEQ ID NO: 60792 - DNA, 601 bp, Human
agaggaaacttctcacctgcaaggactttttgctccgcagttcccttcacactcacatattctcctgtgtcacagctctggggtatgtcttatgctcacccatcacgtagttcgttatcaccactacagatattgacaagctagtgaaacctgcgttttcattgcatttaactttgaaggcacacatctttgaacagaatgctaggtgctaatgtcatagcttacatctagatagggctctatttatgatgctgttatgttgtcttcataatctattgtggtattcagtttagctcataasagctgtataaattcaggttgccaagggtaaaagaggtgacccaacctcccatctggctgtattccccttgcacactcatatacctgtctcttctcaatgccctaattctatctcctataaaaagtttgcatcttcatgaattattcctatcttagtaaattaataaatggcctttcagaacaagtcataataaaaatacagctgggcatagcgatgcacacctttaatcccaacactttgggagactgagcaggaggattgcttgatgacagatgctcgagaccagcttgggcaacaaag

SEQ ID NO: 60793 - DNA, 601 bp, Human
tcagggtcttgctctgttagccaggctggagtgcagtagcacaatcatagctcccctgtcacctcaaactcctgtgctcaagccatcctcccaccttggcctcctgaggagccaggactacaggtgcacaccaacacaccgggcaaggttagccttatagacagaagttctctacctaggatgatttctatatttttgttcaccaaaaaaggttctctggcctaccagcagcaccctggctgcttttgctgactctagtcattccttaatgagtatacctggtagattcttactggactayaccttagtgcagaaggatattagaatatcccacgcttgatagcagacctggttgaagaggccaacacaaaccagagtcagggataaaaccaagataaaaatctcatctccgctgacatcatagcatccatgcagttgctcaagccgaaagcatcctcgattcctctctgtttctctcccctgctcagatgatctgtactgatccacttttctccatctctgctgctacctcattagtccaagccatgttttgtctccctggaactattaatattagaacagccttttgacctgtctcctc

SEQ ID NO: 60794 - DNA, 601 bp, Human
ttcctctctgtttctctcccctgctcagatgatctgtactgatccacttttctccatctctgctgctacctcattagtccaagccatgttttgtctccctggaactattaatattagaacagccttttgacctgtctcctcctctctctcttgcttttcctgattttctctccccacgacagctggagggattttcttaacacttaaattggatcctgtctctgtcctacctaaaaacctattgtgactgtctattgctcttagacaaatcaaactccttctcatggtttaaaaggcagtrcgtaaactagctcgtgtcagcctgactttccagtgtccttcctgccagtcccacctcattgcctagcaggtactcttgtctccctccatcgcctccacaggcctgctcccttgagctctttctgtccctccatgaggcttggaatctctcccctcctacctactcactgtcatctatgtcccaactcattgtctcctcctcagagacttcttgagcactgccgctcgtatcaccctgtttatttcctccacagaacattaatgaaagagttcatagattgtctcgtacacatacttacca

SEQ ID NO: 60795 - DNA, 601 bp, Human
gtcctacctaaaaacctattgtgactgtctattgctcttagacaaatcaaactccttctcatggtttaaaaggcagtacgtaaactagctcgtgtcagcctgactttccagtgtccttcctgccagtcccacctcattgcctagcaggtactcttgtctccctccatcgcctccacaggcctgctcccttgagctctttctgtccctccatgaggcttggaatctctcccctcctacctactcactgtcatctatgtcccaactcattgtctcctcctcagagacttcttgagcactgccrctcgtatcaccctgtttatttcctccacagaacattaatgaaagagttcatagattgtctcgtacacatacttaccaatttcttgccttattttattttgagacggagtctcgctctgttgcccaggctggagtgcagtggcgcgatctcggctggctgcaacctctgcctcccaggttcaaatgattcttgtgcctcagcctcccaagtagctggggtcacaggcgtgcaccaccatgcctggctaattttttgtatttttagtagagaccaggtttcaccctgttggccagactcctg

SEQ ID NO: 60796 - DNA, 601 bp, Human
ctgttggccagactcctgtttgtcaaacttctgacctcaggtcatttgcctgcctgagcctcacaaggtgctgggattacaggtgtgagccaccatgaccagctgattacttgtctgtttttaaacaagtagcatggaggtgcctggaggcctgcgtttgtgtttcacttgtttctgattgtactcccaggaacaagcccagcgcctttcccacaataggtattgtataaataatgaatgaatgaagacagtctctattctcttgaaatgtaaacaggacagtgaggggtaaaataaaatkgacagttatcatgtagagtgatgggtgctttgatgggagaagggttctgtcccttaggaacattcaggggaagtagtaccaaatactcaggaattagagaaagggtccaacagaaaatgatatctacagatttcaaggatccctaataagtacctatattgtgttactgtattaacattaatgtttcatttaaaaccagcgtttttcaacctttgtcattaatcgcccccttaaggggccttttctaggcagtttttttcctaatcaccatccctccctccataaaatttcataccacag

SEQ ID NO: 60797 - DNA, 601 bp, Human
tgcacagtacttgcactttaaatgtcaatggactgtgtagtatttcaaaagcacacacatgcacaattttctttccaatggaggagacagatgatactggttttttcaaaagtgtgatatcgatggatactgtggctcacgcctgcaatctcagtattttgggaggccaaggcaggagaattgcttgaggccaggagttcaaggcctgcctgggcaacatagaaagactgccccccgctacaaaaaaattaaaaaattagccagacgtgatagcaggcacctgtggtcccagctgctgtgraggccaaggtgggaggatcactggagtgcaggagttcaaggctgcagtgagctatgactgtgccactgcagccttgggtgacagagtgagacccaatctcttaaaaaaaaaaaaaaaaagtggtattcatactcattgacgtgaaaagtcaacaccaaagtcataatgagagttcacataataatatccaccaatatgtgcctctggaaaaagcattaaaaggtgcatcagaggaacttatatttttaggaaaaagtgtgacagacaaatgcacagcagtcattgcacagtttggaaagg

SEQ ID NO: 60798 - DNA, 601 bp, Human
gcctgcaatctcagtattttgggaggccaaggcaggagaattgcttgaggccaggagttcaaggcctgcctgggcaacatagaaagactgccccccgctacaaaaaaattaaaaaattagccagacgtgatagcaggcacctgtggtcccagctgctgtggaggccaaggtgggaggatcactggagtgcaggagttcaaggctgcagtgagctatgactgtgccactgcagccttgggtgacagagtgagacccaatctcttaaaaaaaaaaaaaaaaagtggtattcatactcattgaygtgaaaagtcaacaccaaagtcataatgagagttcacataataatatccaccaatatgtgcctctggaaaaagcattaaaaggtgcatcagaggaacttatatttttaggaaaaagtgtgacagacaaatgcacagcagtcattgcacagtttggaaaggaacatgtgggggctggttgactccaagagtgcttggtgataggttgggttggtgacttagtaagaaagtgttgcctaagactttgatttagaaacggcacttaagttattaggtagatgagtgctgatagagttacttgg

SEQ ID NO: 60799 - DNA, 601 bp, Human
cccatctgtgttccagctgctgttctgcaactgcaaatggattctgctttagtatgataataagaaggtcataacccagcaaaagtggtgggcttctaactctatccttttagcagaatttcttttcattagctgagtagaattgagcttcactggttggcagtgaaatgaggcatggcctagcttgatggtccatgaaggatgctcactgagggtgacattttgttccattaaagctgatgtttctatttataccaaggatagtttgtgcagttacaccggaaataagatatttcctgcrtttacagacatctacatgcttgcctttttttccatttcccactgaaccagtctcgttgttgtcaattattcttcttcctctatttaatggaatctttactttcttgacagatgaatgtacatgaccactttcataatgcctctcccttaagaaactgcctactgatcttggccaggcacggtggctcacacctgtgatcccagcactttgggaggctgaggcgggcttatcatttcaggccaggagttcgagaccggcctgaccaaaaccccgcctctactgaaaataggaaaattagcc

SEQ ID NO: 60800 - DNA, 601 bp, Human
tggcagtgaaatgaggcatggcctagcttgatggtccatgaaggatgctcactgagggtgacattttgttccattaaagctgatgtttctatttataccaaggatagtttgtgcagttacaccggaaataagatatttcctgcgtttacagacatctacatgcttgcctttttttccatttcccactgaaccagtctcgttgttgtcaattattcttcttcctctatttaatggaatctttactttcttgacagatgaatgtacatgaccactttcataatgcctctcccttaagaaactkcctactgatcttggccaggcacggtggctcacacctgtgatcccagcactttgggaggctgaggcgggcttatcatttcaggccaggagttcgagaccggcctgaccaaaaccccgcctctactgaaaataggaaaattagccaggtgtggtggtacacacctgtaatcccagctacttgggaggctgaggcaggaggatcacttgaacctgggaggcgaagggtgcagtgagccaagatcacacccactacactccagcctggatgacagagcaagactccatctcaagaaaataaaat

SEQ ID NO: 60801 - DNA, 601 bp, Human
cgaagggtgcagtgagccaagatcacacccactacactccagcctggatgacagagcaagactccatctcaagaaaataaaataaacaaccagttctcatgagaatcctatcacgagaacagcgccaagatatagtgctaaaccattcataggccacccttatgagccaatcacctcccaccaggccccacctccaacactgaggattacaatttgacatgagatttgggtggggtcacagatccaaactgtatcactttccattcctccaggcctagcaaccactattctactttctgcrtctatgatgttgaccattctaactacctggtatgagtggaatcatatatttgtccttttgtgactggctaattttacttaggataatgtcctcagagttcacccatgttatagcatttatcagaatttctttcctttttaaggcagaataatattccaccgtatgcatataccacaattgggtttatttgattcatctattggtggacattcgggttgcttccaccttttggctactgtaaataatgcagccttcctcctgttccctttctccccttaagggcccttcagacctctgcct

SEQ ID NO: 60802 - DNA, 601 bp, Human
atgttatagcatttatcagaatttctttcctttttaaggcagaataatattccaccgtatgcatataccacaattgggtttatttgattcatctattggtggacattcgggttgcttccaccttttggctactgtaaataatgcagccttcctcctgttccctttctccccttaagggcccttcagacctctgccttctaccactgggcatagtctacacacagatcatgacttttggctactgtcagtaatgatgctatgagcatgggtgcacaaatacacctccaagaactttgggtgtgggtgtatgtttagacagagtttcactctgtgtccaagctgcagtgcagtgtgcagtcatggttcactgcaggctcaacctcctggggctgcgtgatcctcctgcctcagcttcctgggtaaccaggactacagacatgcgccaccacaaccaactaatttttcattttctatagagacgggacctctgtatgttgcctaggctgattttgaactactgggctcacagtatcctcctgccttagcctcccaaagtgctggaattacaggcatgagccaccacacttggccctccaagaac

SEQ ID NO: 60803 - DNA, 601 bp, Human
tacaacagtatcatttagaaactcttccatagtctttcttcatgccttaacatggaattaataaacaaaattttaagaaatgtcctacatataagacaaaaaggtcccaaaggatataaataatagtcctaataaaatcaagattttttttcacttgttattagcatcctaactgcaatggccaactaattcaaaggcctatgcatactattatactattaacagtaggaaaaaagtaaggtgaacttttttttttttttttttttgagacagagtctcactctgttgcctaggctggagkgcagtggtatgatcttggctcactgcaacctccgcctcccaggttcaagcaattctcctgcctcagcctcccaggtagctaggattacaagcacccgccatcatgcccagctaatttttgtatttttgtagagatgggttttcaccatgttggccaggctggtcttgaactcctcacctcaggtcatctccccgcctcggcctcccaaagtgctgggattacaggcgcgagccactgcacctggcccaagatgaactttcacaaacattttttaaaaagacttctgctcctgttgatagc

SEQ ID NO: 60804 - DNA, 601 bp, Human
acagtatcatttagaaactcttccatagtctttcttcatgccttaacatggaattaataaacaaaattttaagaaatgtcctacatataagacaaaaaggtcccaaaggatataaataatagtcctaataaaatcaagattttttttcacttgttattagcatcctaactgcaatggccaactaattcaaaggcctatgcatactattatactattaacagtaggaaaaaagtaaggtgaacttttttttttttttttttttgagacagagtctcactctgttgcctaggctggagtgcartggtatgatcttggctcactgcaacctccgcctcccaggttcaagcaattctcctgcctcagcctcccaggtagctaggattacaagcacccgccatcatgcccagctaatttttgtatttttgtagagatgggttttcaccatgttggccaggctggtcttgaactcctcacctcaggtcatctccccgcctcggcctcccaaagtgctgggattacaggcgcgagccactgcacctggcccaagatgaactttcacaaacattttttaaaaagacttctgctcctgttgatagctcaa

SEQ ID NO: 60805 - DNA, 601 bp, Human
gggtgaaaaagcaagatctttccaaaaaaaaaaaaaaaaatccactttttgctctatttcttttctttcctttttcttttttgagaccgagtttcgttcttgttgcccaagctggagggcaatggcgtgatcttggctcactgcagcctccgcctcctgggttcaagctattctcctgcctcagcctcccgagtagctgggattacagtcatgcgccaccacgcccagaaaattttgtgtttttagtagagatggggtttctccatgttgatcacccatccttacctgatctgcacacctyggcctcccaaagtgctgggaatacaggcatgagccactgcgccctgcctttcttgctctatctttacaccagcatcccttcttcaattacacacaattctttcgatccctatcctcaaggtgccaggcgttattccacctttatcttttgaactttatccagagtgactgtcttgctgtaacagatcactctctggtcagacccctttcaaggctttaactttcttgtttgatagcattctcccttttcagttcctttcaaatccagtgttcatgacttccctgattctatcaagatata

SEQ ID NO: 60806 - DNA, 601 bp, Human
agtatttttagcatctctttttactgttaaaaagtgaaaagtatctctttcattttttagtattttatattttttacttacgtattttattttttatttttatttatttatttttgagacagaatctcactctgttgcccaggctggagtgcagtgacacgatctagtctcactgcaacctccacctcccaggttcaagagattctcctgcctcagcctcatgagtagctgggattacaggtgtgtgccaccacgcccagctaatttttgtatttttagtagagacggggtttcaccatgytggccaggctggtctcgaactcctgacctcatggtccacccaacttggccttccaaagtgttaggattacaggcaagagccaccgcacccggccacttatttcatttattgacctcacttcatgctccactaagaaataaaaacttcacagatagcaacagcctcatcttgccaccaccaaatctgtaaacctgcctttatctgtgccccttgtgtgttctccttcttccctcctgttagaagaagcatctctcctcctgtcagaatcctcctgttcttggccaggcatggtggctcaca

SEQ ID NO: 60807 - DNA, 601 bp, Human
gttgcccaggctggtctcaaactcctgaccacaagcaatgctcctgcctcagcctgtcaatattttacctgtatttctcatcagcttggttttttggtcatggttgttaatttttgaattatatgaaagtcctacatagaaggttctctcctggtgttttggcagatgtaagaaaattgatttcgtttgtagctgttaatttgagaatccattgtagatactagcaatttctgaaggaataagagattcacactttaatgggacttcacaatctttcatctaaaaattctagctcctggtrgggagacaagttccagacccacaactattagaaatatgttaataaactgggccccggattgaagcatgtctaaacaaactatggaatttaataatgtccgaataatgtggaaataatgttttcagtggaataggatgaggctgggtgtggttctcacacctgtaatcccagcactttgggaggccgagacgggcggttcacttgaggtcaggagctgagagcagcctggccaacatggtgaaatcctgtctctactaaaaatacaaaaattagccggtcatggtggcaggtgcctgtaat

SEQ ID NO: 60808 - DNA, 601 bp, Human
ttgatttcgtttgtagctgttaatttgagaatccattgtagatactagcaatttctgaaggaataagagattcacactttaatgggacttcacaatctttcatctaaaaattctagctcctggtagggagacaagttccagacccacaactattagaaatatgttaataaactgggccccggattgaagcatgtctaaacaaactatggaatttaataatgtccgaataatgtggaaataatgttttcagtggaataggatgaggctgggtgtggttctcacacctgtaatcccagcactktgggaggccgagacgggcggttcacttgaggtcaggagctgagagcagcctggccaacatggtgaaatcctgtctctactaaaaatacaaaaattagccggtcatggtggcaggtgcctgtaatcccagctgctagggaggctgaggcgggagaattgcttaaactcaggaggcggaagttgcagtgagccaagatcacaacactgcactacagcccaggcaacagagcaagactctgtgtttgttaaataaataaatggaataggatgaaacagaaaaacattgtcattttttgaaaac

SEQ ID NO: 60809 - DNA, 601 bp, Human
tctaaaaattctagctcctggtagggagacaagttccagacccacaactattagaaatatgttaataaactgggccccggattgaagcatgtctaaacaaactatggaatttaataatgtccgaataatgtggaaataatgttttcagtggaataggatgaggctgggtgtggttctcacacctgtaatcccagcactttgggaggccgagacgggcggttcacttgaggtcaggagctgagagcagcctggccaacatggtgaaatcctgtctctactaaaaatacaaaaattagccggkcatggtggcaggtgcctgtaatcccagctgctagggaggctgaggcgggagaattgcttaaactcaggaggcggaagttgcagtgagccaagatcacaacactgcactacagcccaggcaacagagcaagactctgtgtttgttaaataaataaatggaataggatgaaacagaaaaacattgtcattttttgaaaactctgaaataatctattctaaagtaattcaattgaaataataaattcactttgcattctccttttgccacaagattcaaatatttactaactggcatcaacac

SEQ ID NO: 60810 - DNA, 601 bp, Human
ctattagaaatatgttaataaactgggccccggattgaagcatgtctaaacaaactatggaatttaataatgtccgaataatgtggaaataatgttttcagtggaataggatgaggctgggtgtggttctcacacctgtaatcccagcactttgggaggccgagacgggcggttcacttgaggtcaggagctgagagcagcctggccaacatggtgaaatcctgtctctactaaaaatacaaaaattagccggtcatggtggcaggtgcctgtaatcccagctgctagggaggctgaggcrggagaattgcttaaactcaggaggcggaagttgcagtgagccaagatcacaacactgcactacagcccaggcaacagagcaagactctgtgtttgttaaataaataaatggaataggatgaaacagaaaaacattgtcattttttgaaaactctgaaataatctattctaaagtaattcaattgaaataataaattcactttgcattctccttttgccacaagattcaaatatttactaactggcatcaacactggtgttcaaattcagtattggcaatttcacacttgaagactgtctg

SEQ ID NO: 60811 - DNA, 601 bp, Human
ccattgacagtggcagtcaggaacctgggagcccaatttatttgtcccctcaacccaactcaaatgggtcctcccttgggaactttgctgccaacttgctcctcttctaaacccctccccaggcacagtctatcaaccccaactttgcaaaacttccattttttgttcttaactatgctaaagtactcacaatgcattgcaattgtttgtaagcctgtctcctctacaagattctgatttcctgttttgttatgttcatctttgaattcccctactgcttagtatgatacatacaatattrttagtgtccccaaaaagtgtttttttgtgaattaaagaaatgaatgaattcacaatgtatgacttgggccttaaggaagatggcattcctacatcttaaaattagtaaacagcatacctttaccaggcacatgttgatcagaaataaaggaaagtaagtagcctgtagaactggggtgctcaaacaccaatttttctcaggattactgaaaaacttaaatatacaggccaggtgtggtggctcacgcctgcaatcccaacattttgggaggctaaggcaggccgatttcttgagctcgag

SEQ ID NO: 60812 - DNA, 601 bp, Human
tatgacttgggccttaaggaagatggcattcctacatcttaaaattagtaaacagcatacctttaccaggcacatgttgatcagaaataaaggaaagtaagtagcctgtagaactggggtgctcaaacaccaatttttctcaggattactgaaaaacttaaatatacaggccaggtgtggtggctcacgcctgcaatcccaacattttgggaggctaaggcaggccgatttcttgagctcgagtttgagaacagcctgggcaacatggcgaaaacccatctccacaaaaaacactaaaaawattagctaggcatagtggcatgcatatgtagtttcagctacttgggaggctgaggcaggagaatcgcttgagcctgggaggtggaggttgcagtgagctgagatgacaccactgcattccagcctggagtcagatcctgtctcaaacaacaacaacagtaaaaacaaaacaaacagacaaacaacctttaagttatacagctaaatataaagttcaccccaaacttagtaaatctgaatctgcaggcattcaggcaaaactgcagactgagcgtctgattttttttgttttgttttattt

SEQ ID NO: 60813 - DNA, 601 bp, Human
agagaaagcacagagcctagtttgttatatcacccttgggggttcaaggtcagcaccatggacatcgccattggatgggttggtttttatcattccttccttcacaccagtctgtcaattaccccatcttcctttatttcgttgctaatatttatgcctctctagtgtcatcccacttgatgtatttaatatgttgttggcaagcatggcagttagctcaactttttagcagctgtattttgaatgaaaaccaacctcatgttccaagtcctcttgcttaattctagcaaattcctaaacygtatccaaatctagaagtctgacccctatgtggggtggttcttaggaaaacttatttagactgtattacaagtagttcggttctaacctcttaattttacatttgtacaaattgaggctcagagagatgacgttcttgagatggagagttactgataataaactaagttcaacagtgttttcatggtttggtccagaagttactataaaatcgtaaccacatccatggaaggaatatctagttactaataaaaataaatctaatggttgatacagtttctctaaatcctccctactcttt

SEQ ID NO: 60814 - DNA, 601 bp, Human
aattgaggctcagagagatgacgttcttgagatggagagttactgataataaactaagttcaacagtgttttcatggtttggtccagaagttactataaaatcgtaaccacatccatggaaggaatatctagttactaataaaaataaatctaatggttgatacagtttctctaaatcctccctactctttattaaaacctatttaaccacatttatacatgtttatgtacaatgttatccaccccaataagtcctgggatcttgaggttaagagtcctggttctattcatctttgaatayaccccaacaacaaaaacagagattaattatactcatattttttctttatcatgctataaatccactttgcagttaatatctatgaaaattaatgaacatttaaaataaagtattcaacttaggaattgaatatatattatatatttattgaatgcgttttcatctctatttaaggaaaccagataattgcactagccaaaataaaaaaatttaaaatccacattaaaaagaaatgtattcagggccaggcatggtgcctcatgcatgtaatcccagcactttgggaggctgaggctggag

SEQ ID NO: 60815 - DNA, 601 bp, Human
gttgatacagtttctctaaatcctccctactctttattaaaacctatttaaccacatttatacatgtttatgtacaatgttatccaccccaataagtcctgggatcttgaggttaagagtcctggttctattcatctttgaatacaccccaacaacaaaaacagagattaattatactcatattttttctttatcatgctataaatccactttgcagttaatatctatgaaaattaatgaacatttaaaataaagtattcaacttaggaattgaatatatattatatatttattgaatgcrttttcatctctatttaaggaaaccagataattgcactagccaaaataaaaaaatttaaaatccacattaaaaagaaatgtattcagggccaggcatggtgcctcatgcatgtaatcccagcactttgggaggctgaggctggaggatcacctgaggtctggagtttgaggttggcctggccaacatgtatataatatatatattgtatataatgtatagtatatatcatatagactgtgatatattgcatatattatatatagactatgatatacagcatgtgttacatatagtatataa

SEQ ID NO: 60816 - DNA, 601 bp, Human
tgaatgcgttttcatctctatttaaggaaaccagataattgcactagccaaaataaaaaaatttaaaatccacattaaaaagaaatgtattcagggccaggcatggtgcctcatgcatgtaatcccagcactttgggaggctgaggctggaggatcacctgaggtctggagtttgaggttggcctggccaacatgtatataatatatatattgtatataatgtatagtatatatcatatagactgtgatatattgcatatattatatatagactatgatatacagcatgtgttacatatastatataatatatggtgtatattatatgtggtatatattatatagagactgatatactgtattgtatatattacatatgatatactggatagactatgatatactgtgtatattatatatactatttacgttattctgtatatattatatatacactatatctctcacctttctatctaaacctgcttcagttgcattgcatggagcctttgcatacagtttgttcacccctaaattatacatgcagttcaccagatcctattacgctatgtctgttccccctttaaatcgatttttcaca

SEQ ID NO: 60817 - DNA, 601 bp, Human
ctggagtttgaggttggcctggccaacatgtatataatatatatattgtatataatgtatagtatatatcatatagactgtgatatattgcatatattatatatagactatgatatacagcatgtgttacatatagtatataatatatggtgtatattatatgtggtatatattatatagagactgatatactgtattgtatatattacatatgatatactggatagactatgatatactgtgtatattatatatactatttacgttattctgtatatattatatatacactatatctctsacctttctatctaaacctgcttcagttgcattgcatggagcctttgcatacagtttgttcacccctaaattatacatgcagttcaccagatcctattacgctatgtctgttccccctttaaatcgatttttcacaagcacttagcttggtgtcttcagcgtctggcacctggtaggcattgagatgtttgttgcaatctttctcaaatgctgggtgtggatggtggtggtgtcagcagcagaattaaaagataaaggaaaccatctgtccttaaaggaactcaccctggtcacagagact

SEQ ID NO: 60818 - DNA, 601 bp, Human
catatagactgtgatatattgcatatattatatatagactatgatatacagcatgtgttacatatagtatataatatatggtgtatattatatgtggtatatattatatagagactgatatactgtattgtatatattacatatgatatactggatagactatgatatactgtgtatattatatatactatttacgttattctgtatatattatatatacactatatctctcacctttctatctaaacctgcttcagttgcattgcatggagcctttgcatacagtttgttcacccctaawttatacatgcagttcaccagatcctattacgctatgtctgttccccctttaaatcgatttttcacaagcacttagcttggtgtcttcagcgtctggcacctggtaggcattgagatgtttgttgcaatctttctcaaatgctgggtgtggatggtggtggtgtcagcagcagaattaaaagataaaggaaaccatctgtccttaaaggaactcaccctggtcacagagactgacatgcaaggggaaagggtatgaatgtatgagccaagcatgccagtgtccgttctcctggttcccaac

SEQ ID NO: 60819 - DNA, 601 bp, Human
cagcgtctggcacctggtaggcattgagatgtttgttgcaatctttctcaaatgctgggtgtggatggtggtggtgtcagcagcagaattaaaagataaaggaaaccatctgtccttaaaggaactcaccctggtcacagagactgacatgcaaggggaaagggtatgaatgtatgagccaagcatgccagtgtccgttctcctggttcccaacaacagtgttaattttatggtagatgccatttcaagtcccacagccatcgatgtggtcaaatgaaaggtgttacacagggccgggtgyggtgggtcacacctgtaatcccagagctttgggaggccaaggtgggtggatcaccttaggttaggagttcaagaccagcctggccaacatggtgaaaccccatctctactaaaaatacaaaaaattagctgggcatggtggcgggtgcctgtaatcccagctactcgggaggctgaggcaggagaatagcttgaacccaggaggcggaggttgcattgagccaagatcatgccacagcactccagcctgggcaacaagagtgaaactccatctcagaaagaaagaaaggaagaaaggtat

SEQ ID NO: 60820 - DNA, 601 bp, Human
taaagactacccttttccctacagaatgtaattaagatatttattttttataacctaaaaattcgtctttgtcagtatcattttctgcaagataggaagctattatcctgcagccactggtttttgtgaaactgcccatggtttacgcctttgtatttttttcctgtgtcctctggagcactagttagccaaagtctaaaattggagcagaaattatggggcagtggagttggaattacagcttagactcctgtctctaccacatgtaactatggcctgccatctgatgttcttcatttgyaaagtgggaataatagtacttaatatacctgttgaaaatatttgactttctgactcagaagggatcttaaaaatgtccttttataattgaggtaaagaagaaatcgctaggtaggaaatgtatgtagtaaatgatgaaatctgtaaagatgttttaaaaattgtaaatacctctacaaatatcatatactactcaagcaacatcctaacatcactaggcatttgttttctgtttaactgcctttggaagacctgcatgtaaagtaacaaatatgtctcaccccagacgtgttcaactccc

SEQ ID NO: 60821 - DNA, 601 bp, Human
ttttttttttgacatggagtctcgctctgtcacccaggctggaatgcagtgctgggatctcggctcactgcaacctctacctcctgggttcaagtgattcttttgcctcagcctctcgagtagctgggactacaggtgcacgccaccatacatggctaatttttgtatttttagtacagatggggtttcaccatgttggccaggctggtcttgaattcctgacctcaggtgatccgcccgccttggcctcccaaagtgctgggattacaggcatgagccactgtgcctggcccccagcccrtttttctacgcttcttgcctaccttggttccatgataaaagccacctccttagcctgttaacccatacaatggaggtttagggagtgggtggaagagctttagtgtctttggtttaaatttaggtctgttttaaaattgtgtctgatacaaccacatctccttaataaacgtattggtttactattttcagttcagtctttagaaaacaagcagcctttcaggaagaatttcagagaggtttggttctcaaattttgtgtgcttctaaatattctttataccttgcttcaaaatgtagct

SEQ ID NO: 60822 - DNA, 601 bp, Human
atccgcccgccttggcctcccaaagtgctgggattacaggcatgagccactgtgcctggcccccagcccatttttctacgcttcttgcctaccttggttccatgataaaagccacctccttagcctgttaacccatacaatggaggtttagggagtgggtggaagagctttagtgtctttggtttaaatttaggtctgttttaaaattgtgtctgatacaaccacatctccttaataaacgtattggtttactattttcagttcagtctttagaaaacaagcagcctttcaggaagaattkcagagaggtttggttctcaaattttgtgtgcttctaaatattctttataccttgcttcaaaatgtagctacctgagctcacctttctgtagccatttcagtttattaggtttggggtgaaatgtgccatttgtattttcaacaagccccaccccagctgctgaaaatgatgcaaaatcaaatttgagcatcgctgctgtagaatacattctctctttcttccaatggagagttccattcctgaatgtgggatatgttgaaatggtgcagccaaatttgcattgttgttcggtaatatcag

SEQ ID NO: 60823 - DNA, 601 bp, Human
gaagaaggagattgactttacagttgtgtttgcttctttaaaaaatatacttatcttttcctagctgtaaaatagcaatcgaaaactgccatctaaagtgaaaaataattccctaaggtttcaatagggtttttcttgtatcagaaccagggccagggtgtaactggatttaagtgccagacaaggagctagaagctgcaggtgcagctccccgccacgctgctctctgtgaccttgagtgagacacaaaattgctgggcttccgtttttcattttaaaatgcgagggttggatttgctcrctaagagctcttttatctctaatagttaagatgatggaacatgatgttttgagatgttttgctgaaatttctcacatagaaaatgggccttctgaaaacatataattatagttttgggtaggaagaagctgtcatggtggcgaaggggaacattgcaaatctgaacatgaccgcagctggcgggagaataatgtgttagaattgaaaggcaccctgcagacttgctgtttaatgtacaaagaagcctagggccggaggggcagggggactctcagggacagtggaatctggctcaacggt

SEQ ID NO: 60824 - DNA, 601 bp, Human
gctcctaaactaaggtgcaattaggcaatcagcatggattgttagactgtacaaaggtggagatgccaattccccaactgttttcctaggggttgtgttcccacacacgcactttctccttagtaacagcgcacggctcctgacctggatgggtggccttagatctgtgaagcacatctaccttgccttgagaaagatgcaactcaatgttggcttccttagctccgtgccactcagcattgcagcaccgaaaggaaaactgtttcctctctactctcccactactctcaattcttccaamaacagatgtgggttgttttcccccccaacagcaagcagttctccagttctctgcagatgctaatgccacgtcctgcaattcaattctgaccttatctacctggagttagtgcagacccaacaggttgaaggctgagtcccaaaagactgtccccacttcagatgccagtcgcacaagtgatgagtctccaggttatcctcaacttctgtccaactcaactacagatcagaggttcccatggccccctactcaggttctataatttgctagaagggctcataaaactcaagagaacagccg

SEQ ID NO: 60825 - DNA, 601 bp, Human
ggcaatcagcatggattgttagactgtacaaaggtggagatgccaattccccaactgttttcctaggggttgtgttcccacacacgcactttctccttagtaacagcgcacggctcctgacctggatgggtggccttagatctgtgaagcacatctaccttgccttgagaaagatgcaactcaatgttggcttccttagctccgtgccactcagcattgcagcaccgaaaggaaaactgtttcctctctactctcccactactctcaattcttccaacaacagatgtgggttgttttcccycccaacagcaagcagttctccagttctctgcagatgctaatgccacgtcctgcaattcaattctgaccttatctacctggagttagtgcagacccaacaggttgaaggctgagtcccaaaagactgtccccacttcagatgccagtcgcacaagtgatgagtctccaggttatcctcaacttctgtccaactcaactacagatcagaggttcccatggccccctactcaggttctataatttgctagaagggctcataaaactcaagagaacagccgacttactagatgactagtttatt

SEQ ID NO: 60826 - DNA, 601 bp, Human
ctgacctggatgggtggccttagatctgtgaagcacatctaccttgccttgagaaagatgcaactcaatgttggcttccttagctccgtgccactcagcattgcagcaccgaaaggaaaactgtttcctctctactctcccactactctcaattcttccaacaacagatgtgggttgttttcccccccaacagcaagcagttctccagttctctgcagatgctaatgccacgtcctgcaattcaattctgaccttatctacctggagttagtgcagacccaacaggttgaaggctgagtcycaaaagactgtccccacttcagatgccagtcgcacaagtgatgagtctccaggttatcctcaacttctgtccaactcaactacagatcagaggttcccatggccccctactcaggttctataatttgctagaagggctcataaaactcaagagaacagccgacttactagatgactagtttattataagaggatacaactcaggaacagccagaggagagagggatgggagagggtgcagaacatccatgccatatctaggtacgccacccttccagcacggccctggggtcacacacct

SEQ ID NO: 60827 - DNA, 601 bp, Human
gcacatctaccttgccttgagaaagatgcaactcaatgttggcttccttagctccgtgccactcagcattgcagcaccgaaaggaaaactgtttcctctctactctcccactactctcaattcttccaacaacagatgtgggttgttttcccccccaacagcaagcagttctccagttctctgcagatgctaatgccacgtcctgcaattcaattctgaccttatctacctggagttagtgcagacccaacaggttgaaggctgagtcccaaaagactgtccccacttcagatgccagtcrcacaagtgatgagtctccaggttatcctcaacttctgtccaactcaactacagatcagaggttcccatggccccctactcaggttctataatttgctagaagggctcataaaactcaagagaacagccgacttactagatgactagtttattataagaggatacaactcaggaacagccagaggagagagggatgggagagggtgcagaacatccatgccatatctaggtacgccacccttccagcacggccctggggtcacacacctggaagctctcagatctccatccttttgggttt

SEQ ID NO: 60828 - DNA, 601 bp, Human
gagaaagatgcaactcaatgttggcttccttagctccgtgccactcagcattgcagcaccgaaaggaaaactgtttcctctctactctcccactactctcaattcttccaacaacagatgtgggttgttttcccccccaacagcaagcagttctccagttctctgcagatgctaatgccacgtcctgcaattcaattctgaccttatctacctggagttagtgcagacccaacaggttgaaggctgagtcccaaaagactgtccccacttcagatgccagtcgcacaagtgatgagtctcyaggttatcctcaacttctgtccaactcaactacagatcagaggttcccatggccccctactcaggttctataatttgctagaagggctcataaaactcaagagaacagccgacttactagatgactagtttattataagaggatacaactcaggaacagccagaggagagagggatgggagagggtgcagaacatccatgccatatctaggtacgccacccttccagcacggccctggggtcacacacctggaagctctcagatctccatccttttgggtttttatggaagctttgttac

SEQ ID NO: 60829 - DNA, 601 bp, Human
gttggttcctctggcacccaggccccatcccaaggctctccaggagaccccagccaccagtcattcattagcatgccaaaagacacttaacactttggagagtataagagttttaggagctgcattccagtaaacaggtgtgcagatcagataagcatttcttattgtattgcagtatcagagatgatgctcaccgctggaccacattccaagatatggctccacttattgatctttgaatgaaggggtaccttattgatcctccccctgaccttaccccaaataacaaatcataccagtmctaaactggcagaactcaagattggttaggaaagatcctctgaaacttcgtataatgacagttaccttgttttgagtgtgtcccctgtgccaggcactgtgctgagagctttgtgtgttcagactcacttcacagttacaaaaccctctttaatatgtgggaactgggcttgaaatggtttaggtacacggtccagttcatagccaatgttgtgttactagaaagggatcccaatacagaccctgagagtgggttcttggaccttgtgcaaggaagaattcagggcaaggccatagagta

SEQ ID NO: 60830 - DNA, 601 bp, Human
ttaccccaaataacaaatcataccagtactaaactggcagaactcaagattggttaggaaagatcctctgaaacttcgtataatgacagttaccttgttttgagtgtgtcccctgtgccaggcactgtgctgagagctttgtgtgttcagactcacttcacagttacaaaaccctctttaatatgtgggaactgggcttgaaatggtttaggtacacggtccagttcatagccaatgttgtgttactagaaagggatcccaatacagaccctgagagtgggttcttggaccttgtgcaagraagaattcagggcaaggccatagagtaaggtgaaagcaatttgttagagaagttaaaaaaagaaaaaagaatggctactccataggcagagcagcagcatgggctgcttaactgaatatacttatagttatttcttgattatatactaaacaagcagtggattgttcatgagttttccaggaaaggtgtgggcagttcctgaaactgagggttcctcccccttttagactatatagggtaacttcctgacattgccatggcatctataaactgtcctggcactggtaggagtgtctttta

SEQ ID NO: 60831 - DNA, 601 bp, Human
agggtgtccacgttcttggcgtcttcaacaaagaattggacaaaacccacaaagcaaggaaagaatgaagcaacaaaagcagagatttattgaaaacaaagtatactctacatagagtgagagcagccaaagcaagcagctcaagagcccggttacagaattttgtggggtttacgtaccctctagaggtttcctgtgtttgcttggtatacacgctatgtaaatgaagtagcgactctccatcagtctgattggttgtaggaggagactaatcagaggctgaagcgatgttatgaagttrcaccctatgcacacatctgattggctacagaaagtgaccaatcagatgctgaagtgaagttacaaagttatacccctttgtaaatgaaaacttggccccagaccagcctgaatggttgcaggagggttctaaacagaggtactttcaatttcagaggcagagcatggtggcttatgcctgtaatctcagcacttaaggaggctgaggcagcccaatcacttgaggtcaggagttctagaccagtctggccaacatggtgaaactccgtctctaccaaaaatatttatttaaaaaactagc

SEQ ID NO: 60832 - DNA, 601 bp, Human
aggagactaatcagaggctgaagcgatgttatgaagttgcaccctatgcacacatctgattggctacagaaagtgaccaatcagatgctgaagtgaagttacaaagttatacccctttgtaaatgaaaacttggccccagaccagcctgaatggttgcaggagggttctaaacagaggtactttcaatttcagaggcagagcatggtggcttatgcctgtaatctcagcacttaaggaggctgaggcagcccaatcacttgaggtcaggagttctagaccagtctggccaacatggtgaaactccgtctctaccaaaaatatttatttaaaaaactagccatgtgtagtggcacacacttgtaatcccagctactcaggaggctgagacaggagaatcacttgaacccgggaggcagagatagcagtgagccaagattgtgccactgcactccagtctgggtgacagagtgagattgaatctcaaaaaaaaaaaaaaatacagttctcatctgccacacagaaaaaggagggggagggtattgcaaagggcgtagcctttggtccttttgttatttgagcgtggaaagttggggtttttct

SEQ ID NO: 60833 - DNA, 601 bp, Human
aagtgaccaatcagatgctgaagtgaagttacaaagttatacccctttgtaaatgaaaacttggccccagaccagcctgaatggttgcaggagggttctaaacagaggtactttcaatttcagaggcagagcatggtggcttatgcctgtaatctcagcacttaaggaggctgaggcagcccaatcacttgaggtcaggagttctagaccagtctggccaacatggtgaaactccgtctctaccaaaaatatttatttaaaaaactagccatgtgtagtggcacacacttgtaatcccagstactcaggaggctgagacaggagaatcacttgaacccgggaggcagagatagcagtgagccaagattgtgccactgcactccagtctgggtgacagagtgagattgaatctcaaaaaaaaaaaaaaatacagttctcatctgccacacagaaaaaggagggggagggtattgcaaagggcgtagcctttggtccttttgttatttgagcgtggaaagttggggtttttcttttgatttagttttaggaagtcagcgtgaatcagccttaggttccctgtctccaggccctattctcctgc

SEQ ID NO: 60834 - DNA, 601 bp, Human
aacccgggaggcagagatagcagtgagccaagattgtgccactgcactccagtctgggtgacagagtgagattgaatctcaaaaaaaaaaaaaaatacagttctcatctgccacacagaaaaaggagggggagggtattgcaaagggcgtagcctttggtccttttgttatttgagcgtggaaagttggggtttttcttttgatttagttttaggaagtcagcgtgaatcagccttaggttccctgtctccaggccctattctcctgcctcataataaataataataataaacagggaagwcgaccagagatcactttcatcaccatcttgatttaggtgggatttggccggcttctttactgcatcttgttttatcagcaaggtctttgagacctgtatctggtgctgaactcccatgaataagaatgcctaaactcttgggaatgcagcccagtaggtctcagccttattttatccagcccctattcaaaatggagttgctgttgttagaatgtctctgacagctggactcatccaaagcctttttagtaatgccatgactgtgtaaatccagaagtctctgtgacaggtctcaatcaa

SEQ ID NO: 60835 - DNA, 601 bp, Human
gtagaaccctgacttctatttgaccacagctcaccattcttatatgttttgtgattttcattttcccttaagaattgtctccaattgcgacattcttcagaacttattaaagatatctgaagtgtatacggtgaaaaatgtatagaatggtggtgtcaccacttgatgttgagtgtgaaatgtgtgggtagtaaacttctgaagctgctgctgtaagggccaagggaaacttccccttcaccctgtgaaagtttgcagaaaaagcaactcactaagacaggttaattggagaaaaggcatrcaaatgtatttaacatgcacacggggagaatctcagattacttattccctaatagagttaagaagcttatacagcatcctggccaaacaagttatgggagtagggagaagaggaattccattgagaggatcactagggagaatgaatggatccaggaacagagataaatttgtaaatagtctcttgacagttaaggtttggttgcattcttggtattaacagggaggggaagcagaaaccattggtctctttggtgcctctgggtcctgggcagatacagcctttgctgtgggagggatg

SEQ ID NO: 60836 - DNA, 601 bp, Human
ctcaccattcttatatgttttgtgattttcattttcccttaagaattgtctccaattgcgacattcttcagaacttattaaagatatctgaagtgtatacggtgaaaaatgtatagaatggtggtgtcaccacttgatgttgagtgtgaaatgtgtgggtagtaaacttctgaagctgctgctgtaagggccaagggaaacttccccttcaccctgtgaaagtttgcagaaaaagcaactcactaagacaggttaattggagaaaaggcatgcaaatgtatttaacatgcacacggggagratctcagattacttattccctaatagagttaagaagcttatacagcatcctggccaaacaagttatgggagtagggagaagaggaattccattgagaggatcactagggagaatgaatggatccaggaacagagataaatttgtaaatagtctcttgacagttaaggtttggttgcattcttggtattaacagggaggggaagcagaaaccattggtctctttggtgcctctgggtcctgggcagatacagcctttgctgtgggagggatgtgggggaccttgaggcggcttcttcattt

SEQ ID NO: 60837 - DNA, 601 bp, Human
caggaggctgagtcgggaggatcgctctaagcccagtagttcaaggttgcggtgagttctgatcctaccactgcactccagtctgggtgacaaagtgagaccccgtatctaattaaaaaaaagaagacacctcttcaaattttgacagagtttaactctttcatcaaaatacctatatattttatgtaatatggatcatttatatatacacatatctgtgtgtacatattgttatctgtatacgtatatctgtattatataacatatataatctgtgtgtatatgtatatatctttttatrtgtctatccttcctgacacccattccctgaattcttttctgccaagataaatgcaaagagccagaaaatctgtgatcctatctcttaacagatctgtgctgagaaattactgtaggtatacctggagttcttaataaaaattctagttagatgacttttgagaaccataaaaaaaaacttaagagaacttctgggatctctagtagggactaactttctctttacaaatgttgacaaattgttgagattgtctgcggagatagtacatgatatggtttggctctgtgtccccacccaaat

SEQ ID NO: 60838 - DNA, 601 bp, Human
taggctgtattcattcagcttggctttgagtgactctgggctgtttgctaaaactaatttgtcctcaaaggaaagcgagttatgaataggggcattcaaaattttatgactttggttctgatgatactttcaaaaaatgaattttaaataattttcaaatgagagaaacaatcctcaaatatatgttcatttttttccaagggttttttgaaggggttcccattcacttggataggtttgtatatgcttgacattttttaattactcaaattatttgaggatcacaattcacttttaattktttttttaatattggagatgtgggatttgtttttttctcttttggttgtcaacctggttactaacagactgattctccttgagcatccagaataagacaagcccgttggtttaatagttatctgtggtaagtaccgtcatacacagtgtgtctcctttgtaaaacttaagtgcaatgaatgatgttgttactagtccaacgtgtttctctcttgctagaataatagcctcacagagcaaaatctctgtcttgttgagttctgtgttcccactgccaagaaagtatcctgagcctaagagg

SEQ ID NO: 60839 - DNA, 601 bp, Human
tttagtagagatggagttttaccatgttggccaggctggtctcaaactcctgacctcaagtgatatgcccgcctcggcatcccaaagtgctgggattacagacgtgagccaccgtacccggcccatcattcctttaacagagtgtcttgagatgtggcttatggcttctcagaagatagtccagaaggattgagccatcaatcaatcacacctagtagcagccaagtctattacagcccctcagatggtctcttcctctccttccctgattccttctctggcccctctcttctattccctsagattgtactcttatataagctcagtgcctcagtatctgctgtctggagagctgagaagttgtcttgttgattaaataagctatatcatcttttaagtggctacagatatggacagccattacaactgacatgaaaaggcaataaatgaaataagctggtcacaattttttttctgagacagagttctgttgtgttgcccaggctggagggctggagtgcaatggcgcgatctcggcttactgcaacctgtgcctcctgggttcaagcaattctcttgcctcagcctcctgagtagctgg

SEQ ID NO: 60840 - DNA, 601 bp, Human
cctgagattgtactcttatataagctcagtgcctcagtatctgctgtctggagagctgagaagttgtcttgttgattaaataagctatatcatcttttaagtggctacagatatggacagccattacaactgacatgaaaaggcaataaatgaaataagctggtcacaattttttttctgagacagagttctgttgtgttgcccaggctggagggctggagtgcaatggcgcgatctcggcttactgcaacctgtgcctcctgggttcaagcaattctcttgcctcagcctcctgagtagytgggattacaggcgcctgccaccatgccctactaatttttgtgggtttttttagtagagatggggttttgccatgttgtccaggctggtctcaaactcatggcctcaagcaatccatctcggctttccaaactgttgggaatacaagtgtgagccaccacaccttatctcttattggtttttacagagactaactgagatatatttaagcaacaggacttctacatagtaagcacaatatagttgcaaattaaggcagttattaattattacagtctaataatgtctgaaaaaaacaagt

SEQ ID NO: 60841 - DNA, 601 bp, Human
gctacttgggaggctgaggcaggagaatcacttgaacccgggaggcagaggttgcagtgacctgagatcacgccactgtactccagcctgggtgacagagccagactctgtctcaaagaaaaaaaaaaaatagatacagtattagagaaaaccaactaagaaatgggagagctaagtgagtgaagtgtaactgataagcaaagagaaggaataaaaataccaagttatcactcaggagttacaggcagcagctacacaaaagatgtagccaaccaagggaagaagagagtgctcaaattastgtgaacccagacacctgagaatccaaacttttcaatcgctgtagctaaagttctttggcccagtgtagacacaagctccctcactggggtctcaggatataaggattcaagccctgtctctcgtgccactctgtcctttcaaccacgcagtgctggattttaaacaggtagaaagtaaaatgtttattgtatttacccctttgcttaattcttaatcattttaaattttaataaatatctatatacacttgcacttacatatatatatgttgatcatataaaacaaaatcctggctggg

SEQ ID NO: 60842 - DNA, 601 bp, Human
atcctggctgggcgcgatggctcacgcctgtaatctgagcactttggaaggctgatgcaggcagattgcttgagtccaggagttggagaccagcctggacaacatagtgaaaccctgtctctacaaaaaatacaaaaagtagccagatgtcatagcgcatacctgtaatcccagctacttgggaggatcatttgagcatggaatgcagaggttgcagtggggcgagatcacaccattgcactcagccctgtgtgacagagtgagaccctgtcttaaaaaaagtatatatttgtttcaaaayatattgtaggaacttttgcccatatataaagaataaaataaagttgaaaagtttccttccttaatggaaggattatttattatcattgaaagttagcaagatgatagagagaagttataatcagacaaggataactagaaagtaagatatcagtaagtgctaaataaagcagatggctatgacctggttcctgtaagtatagtcagtacctcttcagttcctgggtgcttcctatataagacttgatagctacactcccacctgaggcatttaatataataaaagagtagaacaagtttt

SEQ ID NO: 60843 - DNA, 601 bp, Human
gtgaggttcattgtctcacggcagggaaatcgaggacgtggacgtggaagaaatgagtttaagagcggaggtttaataggtgaaagaaaaagagaatagctctctctctctcttgcaaagagagaagggctcccaagtgcgtcatctggtttcatggtgaaacgcatggggtttcatagttgagcttgagaaggcgctgtctgctttacatagggcgcgagagattgttcggaccaggtgtgacatttgcatggtgcatgaagatgctggccagcccaccctaatctttcatgcagatggsgtctcaacctggccagcaccatgttgtctgttcctcactgtacttgtggttgacaaacaaaagggaagatggagccaccaggttgcacatgcctggcccccaggtagcctttatctattggcacagctgcggcatttacctgtgcagacttttagcttgtttatctatgctttctgcttgatttttcaggctgctttttgttagaaaagaaacaatatgggggctgtgtttcattagaaggaagccttaccgaggactctcttaccctcactgtttgctgaaataatttatttctagctc

SEQ ID NO: 60844 - DNA, 601 bp, Human
atagttgagcttgagaaggcgctgtctgctttacatagggcgcgagagattgttcggaccaggtgtgacatttgcatggtgcatgaagatgctggccagcccaccctaatctttcatgcagatggggtctcaacctggccagcaccatgttgtctgttcctcactgtacttgtggttgacaaacaaaagggaagatggagccaccaggttgcacatgcctggcccccaggtagcctttatctattggcacagctgcggcatttacctgtgcagacttttagcttgtttatctatgctttcwgcttgatttttcaggctgctttttgttagaaaagaaacaatatgggggctgtgtttcattagaaggaagccttaccgaggactctcttaccctcactgtttgctgaaataatttatttctagctcatatatcagtaatagtgctggagtcagggtgggaagggaggtggtgaaaccaggtggttggtctcttcagcagccttctcaagatgagtgatttgtggaggggcgcggtggctcacgcctgttatcccagcactttgggagaccgaggtgggtggatcatctgaggtcaggagtt

SEQ ID NO: 60845 - DNA, 601 bp, Human
ctggacatggtggtgggtgcctataatcccagctactcagtgggctgaggcaggagaattgcttgaacctgggaggcggtggttgcagtgagttgagacctaaccattgcaccctagcctgggcaacaagagtgaaactccatctcaaaaaaaaaaaaaaaaaaaaaaatctttcacaaatgttgtcttaaaatttaactttttttttttttcagagaaaggatcttgcaatgttgcccaggctagattcaaacccctgaattcaagccatcctgttgcctcagcctcctgaatagctgaractacaagcgtgtgccacagtgaatggctgggagaacttttttgagcctcagtttcttcaccttggaataaaacaattgtagctggggttaaatgaaatgtagcaatctatgtataatatacagcacattgtttgtcccttggccgacattccgaaagtggtagctttcatcattttacagtaagtcctgtcatgtacaaggtaaagaaggacctagaagaagagaatatgaatttcttaacatctcttatcacttacacattcccttctcaacaaatattgattggaaacatactggag

SEQ ID NO: 60846 - DNA, 601 bp, Human
atgactatacacccaatactagcctggcctggtgcaatccattttctgtaatcccgttaccttaaagaatggcgctcttacccttgttttagccatgtgaacttatgcttaatgagactaaagaatttgcccaggccactcacctaataaatggcagaatcaacatccaaatccaggtccacttaaaatcccttgttcttgaacccatatgaatgaaattaatatggagaataccttccacattgtagacacactgcaagctgaagtgagaccagggaatcagaagtgacattgtcactgkcctctttggtttagcatcctggggtcttttatcttggctacatctgtcccccgcatcccttgactgtactctaattttagaaatatagttcctgaagtaaagatattgaggaataggtatctgctgctcttgtttcctagttctataaagctaattcccatataaaccacatctaatggtagcatcattggttacaggaggtgaggcaagaaaggaggcacgttccaacttaacatcttaatctaagagcataaaattattacctgtggtctctggaattatacaccaatttccaccacc

SEQ ID NO: 60847 - DNA, 601 bp, Human
tatgcttaatgagactaaagaatttgcccaggccactcacctaataaatggcagaatcaacatccaaatccaggtccacttaaaatcccttgttcttgaacccatatgaatgaaattaatatggagaataccttccacattgtagacacactgcaagctgaagtgagaccagggaatcagaagtgacattgtcactggcctctttggtttagcatcctggggtcttttatcttggctacatctgtcccccgcatcccttgactgtactctaattttagaaatatagttcctgaagtaaagmtattgaggaataggtatctgctgctcttgtttcctagttctataaagctaattcccatataaaccacatctaatggtagcatcattggttacaggaggtgaggcaagaaaggaggcacgttccaacttaacatcttaatctaagagcataaaattattacctgtggtctctggaattatacaccaatttccaccaccactttaatttctttttcctttttcagtcccctctttctgctactcagatgattgaaaagtgataaaaagttggtagaagtcataagattttctatggggtctt

SEQ ID NO: 60848 - DNA, 601 bp, Human
aatgtacacatttatttacgtgtatttttaattcccataattccacacaagaagcaggatccctggtatcactaaaaattaaagtggatgtcattcgagaccagcctggccaatatggtgaaactccatctctactaaaaatacaaaaattagccaggcatgatggcgggtgcctgtagtcccagctacttgggaggctagggtagaagaatcgcttgaacctggaaggcagaggttgcagtgagctgggatcgtgccactgcactccagcctgggcatcacagtgagactcagtctcaaaaaaaaaaaaaaaaaaaaaaaattacagtgaatgtcaataactggcttccaaatatttaactccacctcatgtctattgtgcctatatccagaatttggttttcctttcccaatctgcaaattgtgactagaccatagtaacatcagggatcttaagtcagtcttaacccagacaagaggcaggtagaacaaattaacttcggaaaatttggaaatgaaaatgggttctctctactccaactcccctgtgtcttctctggcaagtccaggtagagagcgcattgaatagggagaaactgct

SEQ ID NO: 60849 - DNA, 601 bp, Human
tgccaccacacctagcctaatttttgtttttgatttttagtgagaagaggtcttgctatgttgcccaggctgatcttgaactcctagggtcaagcaatcctcttgccttggcctcacaaaatgctgggattacaggcatgagccaccactcctggccctttatctgtaaaatttcaaagcatcaaataaggaaagagatcttaattaatatctttagtagctgaacaaactcaagtaggagaaataatagaagaaaaagtcattgctttcataattcgttgcagccatgaatgagagttgmtatagttgtagcatattttccccggctcttttctcattcaatgattgtacctttcggaattatgtctttaatgattaattaattaaagtagatgtttggggtagcaaggcagtgactaagtcctttccactgaaacggaagaactggggattttattcatgtttgtgtttcctgatttacagttgctacaagcgccaatgttgaaaacacatatttccgtggctcttcttcaccttcattacttgtagtgctttcaaagagaacaatggcctttttctagttcagaaatgggtgttatgt

SEQ ID NO: 60850 - DNA, 601 bp, Human
tataacacacataactaaatcaatggctctcaacctctgctaatataaatataccttttaaagtggaaagaagtcacaggcctcttgcaataacttcagcgctccctggggctctgtggcccagaaattgggaactgctagagtagatgatccttttttatgcttaacctatacttttttttaatgtttcaccttgactaggtgtagtttttcctgatgcctgaagtctaggcatctggggagggtttaataataatatctagaattcatgactcttctctctgctgacagtgtctcaatwcaaactactgatgacctttttcctccttaaatgctaaatttctgcagtgggtgagagaatggtaagaattgacaccaataaggcaacaaagaggtatcaggaaaagtccttttcctacatgctaaatgtctccaccttctagtgagcaatgacacaacctgcaaattggaaactttcatccttaattaaggtttgtttggagtcaacatttatcaaatgcctgccttgtggagcactgtgtaaactgaccagaaatttcccctgtagaatattctcagtgtgtgatcctgaggtttttct

SEQ ID NO: 60851 - DNA, 601 bp, Human
acacaacctgcaaattggaaactttcatccttaattaaggtttgtttggagtcaacatttatcaaatgcctgccttgtggagcactgtgtaaactgaccagaaatttcccctgtagaatattctcagtgtgtgatcctgaggtttttcttggacctgaaggaatttatacttggagctcttccatctagggtatatataatatgtcataggaagtatgtgtaaatcgaaactcttcactgcactaaaggctgtcagcaaaggagttgataactgccgattaaaagaacctagggctgggcscggtggctcatgcctgtaatcccaacactttgggaggccaaggtgggcggatcacaaggtcaggagatgaagaccatcctggccaacatggtgaaccccgtctccactaaaaatacaaaaattatctgggtgtagtggcacatgcctgtaatctcagctactcgagaggctgaggcagaagaatagcttgaaccagcgagtcggaggttgcagtgagccgagattgcgccactgcacccgagcctggcgacagagtgagattctgtctcaaaaaaaaaaaaaaaaaaaaaaaaagaagaa

SEQ ID NO: 60852 - DNA, 601 bp, Human
aaattggaaactttcatccttaattaaggtttgtttggagtcaacatttatcaaatgcctgccttgtggagcactgtgtaaactgaccagaaatttcccctgtagaatattctcagtgtgtgatcctgaggtttttcttggacctgaaggaatttatacttggagctcttccatctagggtatatataatatgtcataggaagtatgtgtaaatcgaaactcttcactgcactaaaggctgtcagcaaaggagttgataactgccgattaaaagaacctagggctgggcccggtggctcaygcctgtaatcccaacactttgggaggccaaggtgggcggatcacaaggtcaggagatgaagaccatcctggccaacatggtgaaccccgtctccactaaaaatacaaaaattatctgggtgtagtggcacatgcctgtaatctcagctactcgagaggctgaggcagaagaatagcttgaaccagcgagtcggaggttgcagtgagccgagattgcgccactgcacccgagcctggcgacagagtgagattctgtctcaaaaaaaaaaaaaaaaaaaaaaaaagaagaacctagaagcct

SEQ ID NO: 60853 - DNA, 601 bp, Human
gagtcaacatttatcaaatgcctgccttgtggagcactgtgtaaactgaccagaaatttcccctgtagaatattctcagtgtgtgatcctgaggtttttcttggacctgaaggaatttatacttggagctcttccatctagggtatatataatatgtcataggaagtatgtgtaaatcgaaactcttcactgcactaaaggctgtcagcaaaggagttgataactgccgattaaaagaacctagggctgggcccggtggctcatgcctgtaatcccaacactttgggaggccaaggtgggyggatcacaaggtcaggagatgaagaccatcctggccaacatggtgaaccccgtctccactaaaaatacaaaaattatctgggtgtagtggcacatgcctgtaatctcagctactcgagaggctgaggcagaagaatagcttgaaccagcgagtcggaggttgcagtgagccgagattgcgccactgcacccgagcctggcgacagagtgagattctgtctcaaaaaaaaaaaaaaaaaaaaaaaaagaagaacctagaagcctgggtactatggctcatgcctgtaatccaagcactaag

SEQ ID NO: 60854 - DNA, 601 bp, Human
ctgccttgtggagcactgtgtaaactgaccagaaatttcccctgtagaatattctcagtgtgtgatcctgaggtttttcttggacctgaaggaatttatacttggagctcttccatctagggtatatataatatgtcataggaagtatgtgtaaatcgaaactcttcactgcactaaaggctgtcagcaaaggagttgataactgccgattaaaagaacctagggctgggcccggtggctcatgcctgtaatcccaacactttgggaggccaaggtgggcggatcacaaggtcaggagatsaagaccatcctggccaacatggtgaaccccgtctccactaaaaatacaaaaattatctgggtgtagtggcacatgcctgtaatctcagctactcgagaggctgaggcagaagaatagcttgaaccagcgagtcggaggttgcagtgagccgagattgcgccactgcacccgagcctggcgacagagtgagattctgtctcaaaaaaaaaaaaaaaaaaaaaaaaagaagaacctagaagcctgggtactatggctcatgcctgtaatccaagcactaagaacctagaagcctgggtacta

SEQ ID NO: 60855 - DNA, 601 bp, Human
atattctcagtgtgtgatcctgaggtttttcttggacctgaaggaatttatacttggagctcttccatctagggtatatataatatgtcataggaagtatgtgtaaatcgaaactcttcactgcactaaaggctgtcagcaaaggagttgataactgccgattaaaagaacctagggctgggcccggtggctcatgcctgtaatcccaacactttgggaggccaaggtgggcggatcacaaggtcaggagatgaagaccatcctggccaacatggtgaaccccgtctccactaaaaatacwaaaattatctgggtgtagtggcacatgcctgtaatctcagctactcgagaggctgaggcagaagaatagcttgaaccagcgagtcggaggttgcagtgagccgagattgcgccactgcacccgagcctggcgacagagtgagattctgtctcaaaaaaaaaaaaaaaaaaaaaaaaagaagaacctagaagcctgggtactatggctcatgcctgtaatccaagcactaagaacctagaagcctgggtactatggctcatgcttccaagcattttggaaggccgaggaaggcagatctct

SEQ ID NO: 60856 - DNA, 601 bp, Human
acatattccacctgcaagacataaattgtcaacatcacacaagtagagaaatcatctgtgaacatcgcattgtatatttataaaactgtttgcacaaaggtaaattgtcctgtgacatgaaatatttaaggtacacttcaatatttatctctttctctcaataattccaattggtctgattatataaggggaagatttctgtaacagtacttcctaaagatctcttggtaggatgggctgttattctttgaacccagagagcttatccctactcatggtgacagcagctgctgcaagggarttcagcctggtcctacggcagcaccaggacagacaaggaacgcagagcctttgatagattgctgaggacgctaaatgcatttcttacatgtgaaacccatgagccgaagggtttcttgaatgataatatttaaggcatagttaatggtcattgccatatttctctcgactgaaaatagtgtggaagaacaaggatttgaccttctgtgcactgatttttaatgcttttgattttgtgtttagaaatttaacaatgactggtggatagggcgattggtaaaagaaggctgtgaaatcggat

SEQ ID NO: 60857 - DNA, 601 bp, Human
ggtaggatgggctgttattctttgaacccagagagcttatccctactcatggtgacagcagctgctgcaagggaattcagcctggtcctacggcagcaccaggacagacaaggaacgcagagcctttgatagattgctgaggacgctaaatgcatttcttacatgtgaaacccatgagccgaagggtttcttgaatgataatatttaaggcatagttaatggtcattgccatatttctctcgactgaaaatagtgtggaagaacaaggatttgaccttctgtgcactgatttttaatgctkttgattttgtgtttagaaatttaacaatgactggtggatagggcgattggtaaaagaaggctgtgaaatcggattcattccaagcccagtcaaactagaaaacatgaggctgcagcatgaacagagagccaagcaagggaaattctactccaggtatgagacagatgtcaagtgtttgcataaaacttagattataccactatctgtgtactgttgtctgctgtattctgtatcctttattatgtattaacaaggaggctggtaatatggtttattgatagcatcacaaatcttgcattt

SEQ ID NO: 60858 - DNA, 601 bp, Human
acgcagcatgcctctcccaatgtgaaaggatgggacatgggcaaggcctttcttaaatacgaatcgctggatttctcttttctccatcttacatcttatttgtttatctaagatgcaaatccctttgtcagtgataatactttactgtgagcaagtatttttttcaagcatcagcagatgagtgaaacagaatatgctttgtggtttggaacacccatcctcattaactggcttttcataattgtcaagttcatttagttcagacggattcctctgtgttttgagacctccaccccagaaytgactttcattaattcctgggttattgagagcactcagatggtgagatgcattcagtcatataaaagtagaggcatgcataaaaaagaacaaagattggccgggcatggtggctcatgcctataatcccagcactgggaggccgaggcagacagatcacctgaggtcaggagttcaagacgagcctggccaacatggtgaaaccccatctctactaaaaatccaaaaattagctgggcatggtggcgggagcctgtaatcctagctactcgggaggctgaggcaggagaattacttgaat

SEQ ID NO: 60859 - DNA, 601 bp, Human
ctttgtcagtgataatactttactgtgagcaagtatttttttcaagcatcagcagatgagtgaaacagaatatgctttgtggtttggaacacccatcctcattaactggcttttcataattgtcaagttcatttagttcagacggattcctctgtgttttgagacctccaccccagaactgactttcattaattcctgggttattgagagcactcagatggtgagatgcattcagtcatataaaagtagaggcatgcataaaaaagaacaaagattggccgggcatggtggctcatgcctrtaatcccagcactgggaggccgaggcagacagatcacctgaggtcaggagttcaagacgagcctggccaacatggtgaaaccccatctctactaaaaatccaaaaattagctgggcatggtggcgggagcctgtaatcctagctactcgggaggctgaggcaggagaattacttgaatctgggaggtggaagttgcagtgagcccagattcgtgccactgcattccagcctgggcgacagagtgagactctatctcaaaaaaaaaaagaacaagatcatgtcttttgcagcaacatggat

SEQ ID NO: 60860 - DNA, 601 bp, Human
ttgcctaggctaacattagtgctccactcatctttgtaaggacctgtgggagcagtgggtattagatcttacaggtcacagatgagaaaacaggttaagagaagttagggaacttgatcgaggtcgcagagctagtaagcgtcagaaccaagatggtagcctgacctccacgctgtacagacttccatgctgcactgcagattaaggagccaggtcttgcctggcacagcaagcccaggacagatggttattgccatctgttattatttactttattagatatgttgttttgctcttgcattttttcccttaggactctgagttatccgtatttgagggaatgtaacatctcagaacttactccagagaactagattaccttttcttacagccatatatcttttcctttgattttcttcattttattttggcccaagattttgcctaagtatgtgaaaatacttttacttgctttcataggtttttacatttctctccttttgtgtgtgtgtgtgcgtgtgtgtgagacagagcctcgctctgtcacccaggctggagtgcagtggcgcagtctcgactcactgcaacctccgcctccccg

SEQ ID NO: 60861 - DNA, 601 bp, Human
taaggagccaggtcttgcctggcacagcaagcccaggacagatggttattgccatctgttattatttactttattagatatgttgttttgctcttgcattttttcccttaggactctgagttatccgtatttgagggaatgtaacatctcagaacttactccagagaactagattaccttttcttacagccatatatcttttcctttgattttcttcattttattttggcccaagattttgcctaagtatgtgaaaatacttttacttgctttcataggtttttacatttctctccttttttgtgtgtgtgtgcgtgtgtgtgagacagagcctcgctctgtcacccaggctggagtgcagtggcgcagtctcgactcactgcaacctccgcctccccggttcaagcgattctcctgcttcagcctcccaagtagctgggactacaggcatgcaccaccacgcccagctaatttttgtatttttagtagagacagggtttcactgtgttggccaggctggtctcaaactcccaaccttaggtgatccacccaccttggcctaccagagtgttgggattacaggcgtgagccaccgtgcccg

SEQ ID NO: 60862 - DNA, 601 bp, Human
cagaacttactccagagaactagattaccttttcttacagccatatatcttttcctttgattttcttcattttattttggcccaagattttgcctaagtatgtgaaaatacttttacttgctttcataggtttttacatttctctccttttgtgtgtgtgtgtgcgtgtgtgtgagacagagcctcgctctgtcacccaggctggagtgcagtggcgcagtctcgactcactgcaacctccgcctccccggttcaagcgattctcctgcttcagcctcccaagtagctgggactacaggcrtgcaccaccacgcccagctaatttttgtatttttagtagagacagggtttcactgtgttggccaggctggtctcaaactcccaaccttaggtgatccacccaccttggcctaccagagtgttgggattacaggcgtgagccaccgtgcccggcctctcctaacattttaaatgtagttttgttttgaggacataaccagaatccggcagtctttaaaaactctgatacagaaattagaaaaattgacagaactcaatggaaatggaattggggtaccgttcaagaacttggcattttaat

SEQ ID NO: 60863 - DNA, 601 bp, Human
tgtgttggccaggctggtctcaaactcccaaccttaggtgatccacccaccttggcctaccagagtgttgggattacaggcgtgagccaccgtgcccggcctctcctaacattttaaatgtagttttgttttgaggacataaccagaatccggcagtctttaaaaactctgatacagaaattagaaaaattgacagaactcaatggaaatggaattggggtaccgttcaagaacttggcattttaatagaattaaaagtcaaggacaaatctgcatcctggtcattgtcaccatttgcagyatttgtcacaattttacataaataatattttggctgttactaaaattcaaagggaatataaaacccatgaacttaaactgaaattagacttaatacttcagaaaaaaaaaaaaaacttctggggaaaaaaatgttttggtcttggtaataggtccttgtataactgccagaaactgcttctatagatatcacttgtcattaatttcacatactgtctgatgcccttattaaatgtatttgagtatctcttaagaaccttaaaaagatatacagccctcctgctaattgcctaataaagtt

SEQ ID NO: 60864 - DNA, 601 bp, Human
atgatcttcaaattattcctaaattaaccacgtttcattctccacgtgagtcacgcttgagaagtattctgggtactatctgatggctacatcatatcatattctgtttagtcatgtttcttcgtgtgtccgttagtggttggcaagttttcatatggctctgttgttctttgatagattgctcatgaaagcgtgagtgctttcaatcttagtgtactattaataaaataagcctaaaacagaggagctgaaaccaaacaagaaggaaatattaatcttgggtgttagccttaaggttctrtgcatcgcctctgagggtctctaaaataaaaagcaaaataaatctgtgctatttcactgtctgtgatctgggcaagtaacttgggggctgcagaaattacactggttctcttccattctctcaggtccttttaaaattaaaccttgaatttgaaatcagagaccatcatgtggctatttcaagtactccaggaatctccactgggaaatattgttttcctccttaaatgaaagataaatttaaagttgaataaaaccataatgaattatgtttactgaataatataaatgtttgaggatg

SEQ ID NO: 60865 - DNA, 601 bp, Human
ttaaaccttgaatttgaaatcagagaccatcatgtggctatttcaagtactccaggaatctccactgggaaatattgttttcctccttaaatgaaagataaatttaaagttgaataaaaccataatgaattatgtttactgaataatataaatgtttgaggatgcgaaataagtgtcagatttaatagaaatttttgctttactccagtaaatcaggaggaaattcatcatccagtttgggtgacatagtacctagttccagaaaatcaacacctccatcatctggtaagtaggtgataartgctgaataatacatactgcatttcatgctttccccagctctatccagttttgtgaatttacgtatacactgaatcactatgttaaccctacagatgttaaaaagaatcagaagtgagcatgcccttttggagttacaaacaatatggggaaatgtttttttctggctggaaaaagaagtatgtcaaagtgtttacattgctgtagatgatcaaaatgattaatgtatgtatttatttatttatttatttttttgagacagagtctcactctattgcccacgctggagtgcagtggcatg

SEQ ID NO: 60866 - DNA, 601 bp, Human
gaggaaattcatcatccagtttgggtgacatagtacctagttccagaaaatcaacacctccatcatctggtaagtaggtgataaatgctgaataatacatactgcatttcatgctttccccagctctatccagttttgtgaatttacgtatacactgaatcactatgttaaccctacagatgttaaaaagaatcagaagtgagcatgcccttttggagttacaaacaatatggggaaatgtttttttctggctggaaaaagaagtatgtcaaagtgtttacattgctgtagatgatcaaartgattaatgtatgtatttatttatttatttatttttttgagacagagtctcactctattgcccacgctggagtgcagtggcatgatcgcagctcactgcgcctctgcctccagggctcaagtgatccccccacctctgcttcccaagtagctgggactacaggtgcacaccaccatgcccggctaatttttgtattttttgtagagatggagtttcaccatgttgcccaggctggtctcgaactcctgagttcaagcgatccacctgccttaggctcccaaagtgctgggtttacagatg

SEQ ID NO: 60867 - DNA, 601 bp, Human
acagacaagaagtatagaaaaaagatgaaaatgtgtgtgggaacagtaactactgttttctttccaaagcagtgggttcatcctaatggttgctggataaaataaagcacacctacttaaatttgaatttcagataaacaataatttactagtttaagtacatattgcatggggcatacttacactaaaaatgtatggaacatacttatgctaaaacattgttttaaattcaaatttaactgcatttatatttgctaaatctgggaactctcctattctgtgtagaacatggaattctatrtagacaggagactaatgatttgaattgcaaaaaaaagcacatgattagtatcttagtttgctaagagaattgttattgggaatcagagtaagactgtaaaggttgactgccagggtgtttcagcaaaatgatactgtgtgtgatttctagaaagctggaaatgggaagagataaaaaacagagagttgtacaactatgcagaaatcaaagaactagtcacacagtgactgatgtgctttaaggacaggatttctctattactaataatcagcttcattcctgaatggtggtggcctttag

SEQ ID NO: 60868 - DNA, 601 bp, Human
taactactgttttctttccaaagcagtgggttcatcctaatggttgctggataaaataaagcacacctacttaaatttgaatttcagataaacaataatttactagtttaagtacatattgcatggggcatacttacactaaaaatgtatggaacatacttatgctaaaacattgttttaaattcaaatttaactgcatttatatttgctaaatctgggaactctcctattctgtgtagaacatggaattctatatagacaggagactaatgatttgaattgcaaaaaaaagcacatgatyagtatcttagtttgctaagagaattgttattgggaatcagagtaagactgtaaaggttgactgccagggtgtttcagcaaaatgatactgtgtgtgatttctagaaagctggaaatgggaagagataaaaaacagagagttgtacaactatgcagaaatcaaagaactagtcacacagtgactgatgtgctttaaggacaggatttctctattactaataatcagcttcattcctgaatggtggtggcctttagagaccaatcaaggacttcttagcaaaaactataggatttttttttt

SEQ ID NO: 60869 - DNA, 601 bp, Human
actaaaaatgtatggaacatacttatgctaaaacattgttttaaattcaaatttaactgcatttatatttgctaaatctgggaactctcctattctgtgtagaacatggaattctatatagacaggagactaatgatttgaattgcaaaaaaaagcacatgattagtatcttagtttgctaagagaattgttattgggaatcagagtaagactgtaaaggttgactgccagggtgtttcagcaaaatgatactgtgtgtgatttctagaaagctggaaatgggaagagataaaaaacagakagttgtacaactatgcagaaatcaaagaactagtcacacagtgactgatgtgctttaaggacaggatttctctattactaataatcagcttcattcctgaatggtggtggcctttagagaccaatcaaggacttcttagcaaaaactataggattttttttttttaagagaaggggtttcactatgttgcccaggctgttcttgaaactcctgggttcaagggatcctcctcctcagcctcccaaactgttgggatgacaggcatgagccaacatgcccagccattggcaaactaagata

SEQ ID NO: 60870 - DNA, 601 bp, Human
ctggaaatgggaagagataaaaaacagagagttgtacaactatgcagaaatcaaagaactagtcacacagtgactgatgtgctttaaggacaggatttctctattactaataatcagcttcattcctgaatggtggtggcctttagagaccaatcaaggacttcttagcaaaaactataggattttttttttttaagagaaggggtttcactatgttgcccaggctgttcttgaaactcctgggttcaagggatcctcctcctcagcctcccaaactgttgggatgacaggcatgagccamcatgcccagccattggcaaactaagatactgatcatgggctttttttgcaattcaaaccattgttctgtttatatagaattccaagttctacacagaatataggactttcaagtgagcaaaatctgagcacaataaatgaattgctttaggaagcaaattaatttcaaaaactatctacttataacttgaagcaagcaattctaagatgctcaaaattaagtaaaatagtatgcatgaaatgaaaatgaaaggccctgtaggtattatgtgaaacttataccttcccttgataattacgg

SEQ ID NO: 60871 - DNA, 601 bp, Human
catgaagagtgtaatatttaaaaaggtgatttaaatgttcaccaaggttttgtagagatacaccaactttcaagtgacttttctggtgactgagtcacttggagctataaccaactacaaaatgtataataagcatattaggactctgagacaatttttatatcaatagctcaactgatttaaaggaaaacttcagaaagctcgaaagagaagttctcccaatccacctccaggcacaactgctccaactatcaagtgtggatgggtctgtaatgatcattttcatcgtttccaaaggtcycatctattattctcctcactcattgccagaccaaagaatataagtatctgcctaaagtatatatgcttggatgctgtcaagaacttggaaaatttcccacttgacatctgggcatcggtgtcatagccagttgcagaatacatacatcgcacccacacacacgtgtgtacatatgtgtcaagcccaagctctgcttaacttgacccaaacctttaacaccaaaacttaaatttcaaaaaattgttctcggtgccatggtcacgcctgtaatcccagcactttgggaggctgaggcaggag

SEQ ID NO: 60872 - DNA, 601 bp, Human
acaaaatgtataataagcatattaggactctgagacaatttttatatcaatagctcaactgatttaaaggaaaacttcagaaagctcgaaagagaagttctcccaatccacctccaggcacaactgctccaactatcaagtgtggatgggtctgtaatgatcattttcatcgtttccaaaggtcccatctattattctcctcactcattgccagaccaaagaatataagtatctgcctaaagtatatatgcttggatgctgtcaagaacttggaaaatttcccacttgacatctgggcatyggtgtcatagccagttgcagaatacatacatcgcacccacacacacgtgtgtacatatgtgtcaagcccaagctctgcttaacttgacccaaacctttaacaccaaaacttaaatttcaaaaaattgttctcggtgccatggtcacgcctgtaatcccagcactttgggaggctgaggcaggaggatcacttgagcccaggagttcaagaccagcctggacaatgtaagtgagaccccgtttctaaaaaattagctgggtatggtggtgtacacctatagtcccagctacttgggaggct

SEQ ID NO: 60873 - DNA, 601 bp, Human
ctttgtttttttttgagatggagtctcactgtcacccaggctggagtgcagtggcacaatctcagctcactgaagcctccatctcccaggttcaagtgattctcccacctcagcgtcccaagtagctgggattacaggcaccggccaccacacctggctaatctttgtattgttagtagagacaggattttaccatgttggccaggttggcctcgaattcctgacctcaagtgatccacccaccatggcttcccaaactgctgggattacaggcatgagccaccatgcccagcctcactcktattttaaaaaacaaaaatacaactgatgatcacagcaggctagattcaatgggcaaatcacaaaattcaactcatgaacttgactgtccaagggtcctgtaaattctgacatccaactggttatcttcattttaggagagccctcaaagggtactatcccttgaatgtggtctttatgagcccaataaaagatgagaaagataaaacctgtgggaatttaccaccagcaaggaaactcttgattttggttaacatgtattgtaggaataatgaattcctgacgcagattttgtccttca

SEQ ID NO: 60874 - DNA, 601 bp, Human
cagattgagaagggacttcgcctggatgggcagtgtggtatagggacggttacagactcatttaggtgggcactgtggtatacggagggttatagactcacttacgcaggaggagtaggtctgaatcctgactgccaagtttttgccaagaacaagtcccttaaattttgagttttttaatcttaaaaataagagccttgaagttgatctttatttccatctctgactctgcagttgataaaattctgtagctatttcaattgcatgtggaaggattttgtaaaatttgaagtgagattaygcatctttttttcttgtaacactttttaagtactatattttcaggtggaacaatgggaaaagtaaatcatgtcaagcaacaaagctaaacctttcattttacagatgaggaaaccagtggcatatcctcttgggtcctcgtgcccttccactctgcctcttttgttaaacccagtggctttgcataagtcaccagaagtcttccaatgtcattttattagactgatttcactcggatatcttgggacccagtgttttcccattagtcttcatcagcctaaaatcatcttaatcctgtcct

SEQ ID NO: 60875 - DNA, 601 bp, Human
caccaaacagtgaccataacctttttttttttttttttttttttggtgcaagtttggctttggagcttctcagtccaacagctgagctggttgtcagtggttgtcatataaaatccaattttcgtcccacgtcacaatccgactgagaaatggttcattgttgttgcacagaataagagaagatgcttccaaacaacaatttatttttgcttggctcatgaggcacctacttattgagttttttcacctttccgatttgcttcaaatgtagaaagaccatagaatggtcaatgttgaattsttcagcaacttctcgtgtagttgtaagagaatcagctttgattattgttcttgagtagtcgctgtcaacttccaatggtcagccactatgctcctcatcttcaagtccctcgtctcctttgcaaagcttcgtgaaccaccaccgcactgtacgttcattagcagttcctgggccaaatgcattgttgatattgcaagttgtctccactgctttacgacccattttgaactcgaataagaaagtcactcaaattcgctttttgtctgacatcatttccatagtctaaaataaacataaaca

SEQ ID NO: 60876 - DNA, 601 bp, Human
ctttccgatttgcttcaaatgtagaaagaccatagaatggtcaatgttgaattcttcagcaacttctcgtgtagttgtaagagaatcagctttgattattgttcttgagtagtcgctgtcaacttccaatggtcagccactatgctcctcatcttcaagtccctcgtctcctttgcaaagcttcgtgaaccaccaccgcactgtacgttcattagcagttcctgggccaaatgcattgttgatattgcaagttgtctccactgctttacgacccattttgaactcgaataagaaagtcacwcaaattcgctttttgtctgacatcatttccatagtctaaaataaacataaacagcaagtaataagtcattagcaaaaacgcataaagcgagaaatgcgcattaaaatgatatataacataaccacatttatttaagaatgtattccaatatcaaatggcaaattccaacagtgcaaaaaccgcaattacttttgcattcacctataataaaggttttcaaagtagttgtttgttatctcaaagctggtttaagatattgtaatgaagtcaaatgttctgtactgcacttttatacagttg

SEQ ID NO: 60877 - DNA, 601 bp, Human
ctcctcatcttcaagtccctcgtctcctttgcaaagcttcgtgaaccaccaccgcactgtacgttcattagcagttcctgggccaaatgcattgttgatattgcaagttgtctccactgctttacgacccattttgaactcgaataagaaagtcactcaaattcgctttttgtctgacatcatttccatagtctaaaataaacataaacagcaagtaataagtcattagcaaaaacgcataaagcgagaaatgcgcattaaaatgatatataacataaccacatttatttaagaatgtatwccaatatcaaatggcaaattccaacagtgcaaaaaccgcaattacttttgcattcacctataataaaggttttcaaagtagttgtttgttatctcaaagctggtttaagatattgtaatgaagtcaaatgttctgtactgcacttttatacagttgatacagagaaaatcaacattatatttgaaactacagatttaaaatgtttctctgaaaatattcaagacgtctagcatgaaactgattcattcaagcaaacagattataagtgtatctttcagtttcattagatttgattacctt

SEQ ID NO: 60878 - DNA, 601 bp, Human
agcaggcagggcgcaatggctcacacctgtaatcccagccctttaggaggctgaggcaggtgcatcacctgtggtcaggagttttgagaccagcctggccaacatggtgaaacctcatctctgctaaaaatacaaaaaattagcctggcatggtggcaggcacctgtaatcccagctacttgggaggctgtggcagaagaattgcttaaacccggaaggcggagattgcagtgagccgagaccatgccactgcactccggcctgggcaacagagctagataactctgtctcaaaaaaaagaaaaaaaaaatcaagctaaatggggttaacagggaagagtagataaaaatgatggcgtcattcttcatagggcacaaagcaccaatattccatcaaataaggtaatttctgtagctaccctattgattaagaagctgattgattaccagcaacgggtgaccctttgctagttggcagttacagatcgaaggaaccaaagacctatcaaacactgggccacttcagaattaaagtcttgagataaaatttcttggtagctgttactaaaatgcaggaaatttacattcataatttcaacggt

SEQ ID NO: 60879 - DNA, 601 bp, Human
actggtaacaaatccaagggtcatatctagtgtgtcacgccaatgggcttggacttaatcctttctttctcctcctcttcccccggtcactattcaacttgcctcagtaagtatttattgagtatattctatgtgccaggcattgtgaggagcaaaaatagacaagggccttggctttgtggggcttaaagtctattgaaaggcagtcttgaatcaaataattaatgggtgccatcattgaatgttaagccagctcctgaagcatcaaagacatgactagagtccaaaatggaaacctcaragtttaagagtaggttattacaggggacctggaagatacagggctagtgtatatttctgtatttttaaccagataaatgcagtgcttctcttctccacattcctttcctcctcccatcctaacaatgcaactacaatagatcaggagtcccaaatccccgggtcacagatcagtactggtccatggcctgctaggggccacacagcagacggtgagtggcaggggagtgtgcaaagcttcatctgtatttacagtcactcctcatcactcacacattattgcctgagctcagcctcttgt

SEQ ID NO: 60880 - DNA, 601 bp, Human
gaactgaaaggagagagaatgaggaaaacaaaaactattataagtttcaaggtatgaaaagactttataatcaaggtcttctaaccaaatattcctaattagatttttttaattttccatatctttaagaaatatttttcagtttgtgacaggaaatagaccctttagcttggaccaaggctactaggcactggccaagtataaaaggcatagctctactctgctccatttagcttgtttctttatccttggctctgtcatttatcacaatttggaattgtcaacatgagcctgaacactaaaaaaattctgctaacaaaggcactgtgttttccatgcctgagtcaacccactgccctttcctaaatgccaaagatggggaaatgggatggaatttcctggattactacttgtacttaaacctgagtaagttttgaatttggaagacacattccagccagagagggtggattttggacccatgttcgagtgtatcagccacccagattggttttatttaagaaacagataaacaaaatatcttaaagtatctgttatttctagccagaagtaactttcatatggtttaattaatagacct

SEQ ID NO: 60881 - DNA, 601 bp, Human
tgaatttggaagacacattccagccagagagggtggattttggacccatgttcgagtgtatcagccacccagattggttttatttaagaaacagataaacaaaatatcttaaagtatctgttatttctagccagaagtaactttcatatggtttaattaatagacctgccttggctcatcttgacttacagagctggggttctatattctagccctgttctccccagttaacagtcctcagaggaagaaacgagtccataaggcagaatttaaaagctgtgtacaaatttaacatttttamccatggcaagacatctagagtaactgaattattgactgtctttgcttttggcaaggcaagacagcaatagaggatggaaattcaacaaaagtatcaggtgtgtatatacatatgacattctaaaagggaaaaatgaattattccttaatcatctattaaataagctaagtttattttttaaaaacgtttaagcccaagaggagaaaatatgaaaggaaatgttagttatgcgaaaggttctaggtagtcaagaattcctttttcttttctgaaacccacttaaattcatttgcagcagcc

SEQ ID NO: 60882 - DNA, 601 bp, Human
tcttaaagtatctgttatttctagccagaagtaactttcatatggtttaattaatagacctgccttggctcatcttgacttacagagctggggttctatattctagccctgttctccccagttaacagtcctcagaggaagaaacgagtccataaggcagaatttaaaagctgtgtacaaatttaacatttttacccatggcaagacatctagagtaactgaattattgactgtctttgcttttggcaaggcaagacagcaatagaggatggaaattcaacaaaagtatcaggtgtgtatrtacatatgacattctaaaagggaaaaatgaattattccttaatcatctattaaataagctaagtttattttttaaaaacgtttaagcccaagaggagaaaatatgaaaggaaatgttagttatgcgaaaggttctaggtagtcaagaattcctttttcttttctgaaacccacttaaattcatttgcagcagccctagggggttgtcagaatcacattctggttaagtagtgtcagtgtgtcagatcaaagaagaaataaatcatcctcctcctcctcctgttgtgtgcaataaagtagc

SEQ ID NO: 60883 - DNA, 601 bp, Human
ttggcagtcagattccccagagaagaatcttccattctgacccctggggatataaatataagcctggctaccaaaactgtacaatgagaagaaaggctgaagactcaacattcagaatcctttcttttccatccagtattccctgctcctgttctgtctagggtcccctggtcagaggccctcttgtattgcctgcaagataacaaatgtagggtcttgtaccacacaggaaaagaactgtcacctggctatttgatattgtgagggggcagtggagggctgtaactgaaacagacttttkaaccaaacttttccttttcgccctaacttcattctctaccttctttagaaatattgtgagccttcaattttgcttcacagctttttcctactgctgacttgaatattcagctttctgcagtctaagtcatttgctatttccagttcccaaattttgttgctctcatttctaccttatctaaaatgatactcccaattcaatattgtctctcataataccctgtatgttctttccacaacaatcatcatctttaattattttcctttattatttatctctgccactagaccattagctatc

SEQ ID NO: 60884 - DNA, 601 bp, Human
ccactagaccattagctatctgagggaagactggttcttatttatttttcatgcctatcacagcaatgaactatggcacagagactaggaatatagggtcaggagtctgggttcaaatcccagctctcccacttagttacatacatacccttggataaaaaatctctctgtgagtctcatttttcatcagcaacagtgggataatagtaaacgtttctcctagagctttttggatcatttagtaattcaaataaagtgctcagtacttatctgacacttgtaagcaacaagtaagtgcaaygtaaggcaggtgcaggatagggccgggcgcggtggctcacacctataatcccagcactttggaaggccgagggaggcggatcacttgaggccaggaattcaagaccagcttccatagtgaaaccccctctgtactgaaaatacaaaaattagccgggtgtggtggcacacacctgtagtcccagctactccagaggctgaggcaggagaatcacttgaacctgaaaggtggagattgcagtgagccgagaacgcaccactgcattgcagcctgggcagcctgggcgagactctgtctcaa

SEQ ID NO: 60885 - DNA, 601 bp, Human
caatgaactatggcacagagactaggaatatagggtcaggagtctgggttcaaatcccagctctcccacttagttacatacatacccttggataaaaaatctctctgtgagtctcatttttcatcagcaacagtgggataatagtaaacgtttctcctagagctttttggatcatttagtaattcaaataaagtgctcagtacttatctgacacttgtaagcaacaagtaagtgcaacgtaaggcaggtgcaggatagggccgggcgcggtggctcacacctataatcccagcactttggraggccgagggaggcggatcacttgaggccaggaattcaagaccagcttccatagtgaaaccccctctgtactgaaaatacaaaaattagccgggtgtggtggcacacacctgtagtcccagctactccagaggctgaggcaggagaatcacttgaacctgaaaggtggagattgcagtgagccgagaacgcaccactgcattgcagcctgggcagcctgggcgagactctgtctcaaaacaaacaaaaaacaaagtaaggcaggtgcaagataaaaatgaataagtaaaaagaaaaaaaa

SEQ ID NO: 60886 - DNA, 601 bp, Human
aactatggcacagagactaggaatatagggtcaggagtctgggttcaaatcccagctctcccacttagttacatacatacccttggataaaaaatctctctgtgagtctcatttttcatcagcaacagtgggataatagtaaacgtttctcctagagctttttggatcatttagtaattcaaataaagtgctcagtacttatctgacacttgtaagcaacaagtaagtgcaacgtaaggcaggtgcaggatagggccgggcgcggtggctcacacctataatcccagcactttggaaggcygagggaggcggatcacttgaggccaggaattcaagaccagcttccatagtgaaaccccctctgtactgaaaatacaaaaattagccgggtgtggtggcacacacctgtagtcccagctactccagaggctgaggcaggagaatcacttgaacctgaaaggtggagattgcagtgagccgagaacgcaccactgcattgcagcctgggcagcctgggcgagactctgtctcaaaacaaacaaaaaacaaagtaaggcaggtgcaagataaaaatgaataagtaaaaagaaaaaaaatgaat

SEQ ID NO: 60887 - DNA, 601 bp, Human
tggcacagagactaggaatatagggtcaggagtctgggttcaaatcccagctctcccacttagttacatacatacccttggataaaaaatctctctgtgagtctcatttttcatcagcaacagtgggataatagtaaacgtttctcctagagctttttggatcatttagtaattcaaataaagtgctcagtacttatctgacacttgtaagcaacaagtaagtgcaacgtaaggcaggtgcaggatagggccgggcgcggtggctcacacctataatcccagcactttggaaggccgaggkaggcggatcacttgaggccaggaattcaagaccagcttccatagtgaaaccccctctgtactgaaaatacaaaaattagccgggtgtggtggcacacacctgtagtcccagctactccagaggctgaggcaggagaatcacttgaacctgaaaggtggagattgcagtgagccgagaacgcaccactgcattgcagcctgggcagcctgggcgagactctgtctcaaaacaaacaaaaaacaaagtaaggcaggtgcaagataaaaatgaataagtaaaaagaaaaaaaatgaataagta

SEQ ID NO: 60888 - DNA, 601 bp, Human
ggcacagagactaggaatatagggtcaggagtctgggttcaaatcccagctctcccacttagttacatacatacccttggataaaaaatctctctgtgagtctcatttttcatcagcaacagtgggataatagtaaacgtttctcctagagctttttggatcatttagtaattcaaataaagtgctcagtacttatctgacacttgtaagcaacaagtaagtgcaacgtaaggcaggtgcaggatagggccgggcgcggtggctcacacctataatcccagcactttggaaggccgagggrggcggatcacttgaggccaggaattcaagaccagcttccatagtgaaaccccctctgtactgaaaatacaaaaattagccgggtgtggtggcacacacctgtagtcccagctactccagaggctgaggcaggagaatcacttgaacctgaaaggtggagattgcagtgagccgagaacgcaccactgcattgcagcctgggcagcctgggcgagactctgtctcaaaacaaacaaaaaacaaagtaaggcaggtgcaagataaaaatgaataagtaaaaagaaaaaaaatgaataagtaa

SEQ ID NO: 60889 - DNA, 601 bp, Human
ggtgcaagataaaaatgaataagtaaaaagaaaaaaaatgaataagtaagtatcctaacacatatggtttgaaaatatggttgctatatatatttcatacttagatgaatttggggcatacacttctatcccctttgattagaccaataaccttaaggtcttctgtgactttttcctccaacaggatatccatcacaagggtcaccgctgacatctcgcttgccaaacgctcggtattaaacaatcccagtaagcacgcaataatagaaagatccaacacaaggtcaagcttaggtaagtytgtgcaatgagcttaagctttttaaactctcctctcccgatgttgatgatgagaagacctaacaagatgataattccatgtgtcacagagtatagaaaaaacaggtgtgtgctgccagtcgctgttgctatggtcttactgatttcatggtgtggaaggatttgttatgatagtttcaagttaagaattccacaggctgtcagcattaatgttttggttgtggtttgttttcactaacatgagctttggtgtctgcagactctaagatctcctggctttgcatcagtgttaccatgagca

SEQ ID NO: 60890 - DNA, 601 bp, Human
gtgtggaaggatttgttatgatagtttcaagttaagaattccacaggctgtcagcattaatgttttggttgtggtttgttttcactaacatgagctttggtgtctgcagactctaagatctcctggctttgcatcagtgttaccatgagcaagtttattaaccttttgaagcctccatttcctcatcctaaaaaagaaataaaataactacctcatagaatcattgcaaggattaaacatgatatgtgctcaataaatgatatccattattatcctaaatattccttaattccagttatakatcaataatgaaatcattctcaggagagtataatttgtgggtgtggaaattagtaaaagatgaagtcaattcctggctatatttattgatagatatcaatatgtttgttttatttgtaaaaacagtgtagggagttattgtgtttacagagatggtatgtggatactgcttattaacgtatactgaattgatcacactgagacccttcagctgctatttaatctttttggtatgtgcttggagttttaggttaatcactgttacacatgttgcttactggatggttaggtttctgttttt

SEQ ID NO: 60891 - DNA, 601 bp, Human
ccagttatatatcaataatgaaatcattctcaggagagtataatttgtgggtgtggaaattagtaaaagatgaagtcaattcctggctatatttattgatagatatcaatatgtttgttttatttgtaaaaacagtgtagggagttattgtgtttacagagatggtatgtggatactgcttattaacgtatactgaattgatcacactgagacccttcagctgctatttaatctttttggtatgtgcttggagttttaggttaatcactgttacacatgttgcttactggatggttaggtytctgtttttataaagtaaactttctgagagttgtgtcagatctttgagcttaatttttctctgtttataggttagatatacaaatcctctgagaggctggtttctaacatagaagttcttcgtttactctgaagtatgattatataaataacagaaaaactattataaataataagctttatatgttagcaatgagcatgatacattatagaactcagttttgtttctcacctaacaacccttcgttggcaaaacttcagtaacaggtttagaaatatatttgaggaaaaaatgtaatca

SEQ ID NO: 60892 - DNA, 601 bp, Human
ttatccactccatcactgatgggcctttaggttgattccacatctttgctattgtgaatagtgctgcagtgaacatatacatgcgtgtatctttataatagaatgatttatatttctttgggtatatagccagtagtgggattgctgggtcaaatggtattcctatctttatgtctttgaggaattaccatactgtcttccacaatggtttaactaatttacactcccatcaacagtgtataagcgttcctttttctccataacctcaacagcatctgttattttttgactttttaataayagccattctaactggtgggagatggtatctcattgtggtttgatttgcatttctctaatgatcagtgttgtagcttctcttctttatctaagaggaaacattgttcctgttgttgtttatagatattagagatataaagcatagaaaggtgttcttcatttttcagtttaattcagtgggtataagaaactgtgggatgtggggagatgaggaaggcttgccccgtcttcaagatgctgagctgcattctttcattagctaggacaactggaaagaatcaaattgactttcagtttcaga

SEQ ID NO: 60893 - DNA, 601 bp, Human
ggacaactggaaagaatcaaattgactttcagtttcagaaacgaacattggggaagtttctgacatttctttattagagtaaattctgagcatgatatactctgtcaaaggaaaattcctagcatggatacatccatttttaaaagcatcatttttactttgaagtcaaaagtattatcagaatttgtcgtcgattcttaaggttgtatctactaatacagtgttgcaccaggattctgaaagtccactttaaaatattttaaaactctttccctttaattaacggagtgtaaagtatgtrtgtaaggctaccacaaatatctttatatatgtgtatatattaaaacatgttaatatattgacataatataaataatatccatatatgtaatatattttaaggctatccaggttttatacaatcagcacatattagggctgggcgcagtggctcacgcctgtaatgccagcactttgggaggctaaggcgggagatcacttgaggtcaggagtttgagaccagccttgccaacatggtgaaacgccatctctactaaaagtacaaaacattagctgggcctggtggcacatgccggtaatt

SEQ ID NO: 60894 - DNA, 601 bp, Human
aaaaggtaattgtaaatccacatttgctagcataaaagtctcatggaattcaacctccacgactgcagtgggaagtgaaagctatgtactatgctttatagacctatgctgcctagtaatagtagcttctgcctatttattaaattttaaaaatttacacgcctgttcaagtgctcagtagcccattagctgctgccacgctggaccacatacagagaatatttccctcattgcagaaaattcggtcagacagtccggtttttgagtctttggagatcacagaacagatgaactgaatgcmattttctcggagttcaactagatattctaatgttttgtgataagtttctataaattttatactttagatttctgtagtgctgcctctgaaaactgcccttttaaaacatgactactttggttggaaaatatgaggtgtgtttttggataagtttctttctggtgccattcacgtctttgctgttttattttgtatttcatcttgttaataaacatctagacggcatacaggtgacatgtaaacatagatcagcccgtgcactgaaaggaaaacctgtcatggttgctaatgcaaagtggt

SEQ ID NO: 60895 - DNA, 601 bp, Human
taactgaattgtttcgccctttacagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggtaagtaggactgctactgtttgctctataatcaaactttcctaaaatgtattttatgttctgctttctataattaggctattgtaatagcctttatgatgtatagagaatttgaggagacawgatagtcaagaatttttaaattgatatagtttcatggcttagaacagctgttctcaaagtgtggtccatggatccctggagagtgttgagacacttttagagggtccatttagtcaaaactacttccatgataatactaagacattatttgccattttcactgttttgatatttgcatggctgatgcaaaagcaatggtgggtaaaactgctggcgtctaaacataaatcaagactgtggtatcaaagtaccagcagttactgtattcaccgccaccatgctttcgcagtttgaggggaa

SEQ ID NO: 60896 - DNA, 601 bp, Human
tgtggtccatggatccctggagagtgttgagacacttttagagggtccatttagtcaaaactacttccatgataatactaagacattatttgccattttcactgttttgatatttgcatggctgatgcaaaagcaatggtgggtaaaactgctggcgtctaaacataaatcaagactgtggtatcaaagtaccagcagttactgtattcaccgccaccatgctttcgcagtttgaggggaaaaaaagccaatttcacttaatgtccttataaagtagtaaagtttattacttttattaaaycttgacttttaatattcagtgtactaaaacaaagtacacacaaagctcctgctgtataccaaaaagtaaggacaagcactggtttgattgagttgtgaactaaactagccatgtttttcatagaataccatttttatctcaaacaacaactgacaggctatgcttattccgacttggtgtagcagatattttcttggacaaaataagcctgtcacttaaaggagaacagcatgtgttgccaatgataaaactcaagctttcagacaacaatcagaattttagaaaacttgtatgcatctc

SEQ ID NO: 60897 - DNA, 601 bp, Human
ccagcctgggtaacagagtaagactctgtctcaaaaaaagaaaaagaaaaaagatatcacaatctttatgtcaagaacaggcttcttcctattctattctattctgttcaaatatatatacatctcttttctaccatagtatctatgcctttttcattgctgattgatagacaacttttctgggttgccatgtccttaacaactgttacctttctggccattatttattagttaagcattcagtgccctcaacaatgatttgaggtagtcagacacttcctaactaaataaaaagggagayagtagcagcacttatagaagcaggagcaagtacaaaggggtgcagctcatgagccccttcctcctcttatggaggtgggaagggggtgaaaactgggctggcatcaatgtggtctggaatgtctgcctctgcaggagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagcccca

SEQ ID NO: 60898 - DNA, 601 bp, Human
caatgtggtctggaatgtctgcctctgcaggagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacaggtaaggggagtttttatatatatctatatatacaatcttcatagaaaaaaggttgcctatggtgacacctctaggatccaagccsagtagcctgcttggggcttgttctagtatattaactcaaagcaagtccagcatgagctgtgtatgtacctgtaagaaaagcaccatcaacagaatatattgggaacatacacagactaccgaaactttctaaacagtagcatagactgtggaagtggatcacctagattcaaatcctggctgcacctcttaccacttgtggggtggataacctggggcaaatttcttaactgttcttacctcaggaataataatggcaacctgtccaagaggctgctggaattaataatctcaagagatg

SEQ ID NO: 60899 - DNA, 601 bp, Human
ataatctcaagagatgatcttatagggctgttgtattaatgagttattatatacaaagggtctacagaacagtgcctgtcccatactgtatcactgtatcaggtaagcatttgctatttttaatattctcacatacagtcaagcagaggtagttaagtttacaccgctgtatagaaaaatctcagggacctgcatctgtatttgagccacaggagaataaataaaagaacattttccctgctgctgcttttttttttttaaaggaaaaagttaccatgggcactgttctaggcacttacaraagtccaatttaatatagtatagtataaagccttataaatgccactggatgttaccaaagggatgaagctaggttagacttcatttcagcttttcggatgcttaaaaaggactctgcttgaatgcacttgctctgggacatgttctttacacactgaccttggttaacgcctggtgtgctcctttcgctgccagggttctcaaggtgatcagaggactgatcgctccgctcctatccgttctgcttcccaagctgaagaagaacctagtgtggaaccagtcaagaaatcccagcaccgct

SEQ ID NO: 60900 - DNA, 601 bp, Human
accgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttc

SEQ ID NO: 60901 - DNA, 601 bp, Human
gttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagtt

SEQ ID NO: 60902 - DNA, 601 bp, Human
atggtggcacatacctgtaatcccagctactcgggaggctgtaatcctagctactcgggaggctgaggcaggagaaccgcttgaacccgggaggcggagattgcagtgagctgagatcgcaccattgcacttcagcctgggcaacaagagcaaaactccatctcaaaaaaaaaaaaaacataaaagattaggtggaggttgcagtgagctgagatcgcgccactgcattccagcctgggcaacagagcaagactccgtctcaaaaaaaaaaaaaatttaaaaagcgtcttgaaggagttgsggggggagagaagacagggccgccagggctctgagcgcagcgccagcctgtgtggggcatgcaggctgtgccccacgcctgtgttgggagagagagtagatggggtgcctggccctgtgagtggttgtgagtatgtgtgtccgagggcaagggggactctgtcccggctgcatgggtgttaggtccacggcatgccccgggtgtgtgttgtgcgtgcgtgcacttgcacggcatgtgcgtgcatgttgacatggcagccggtgcacctgtggctcctgtcggcagacacgtgccctccag

SEQ ID NO: 60903 - DNA, 601 bp, Human
ctgtgccccacgcctgtgttgggagagagagtagatggggtgcctggccctgtgagtggttgtgagtatgtgtgtccgagggcaagggggactctgtcccggctgcatgggtgttaggtccacggcatgccccgggtgtgtgttgtgcgtgcgtgcacttgcacggcatgtgcgtgcatgttgacatggcagccggtgcacctgtggctcctgtcggcagacacgtgccctccagcctctcgctctctctcatccgttctctttctcatcctcaccctcttgctctcactccaccctcctragctgccatgtggccatcaccacctctgtggcctctgttctcagggcctttgtgtacctccttcccccagtgcctacctgaaccctcccttccatccccccatgctccagtctgtggtccggcagcctcctccccaggctccggggccaccctcggaaggcctggtgggctctgtcagggaaggggcccacaggactcctcgagggctgtggtcgtcaaccgctgagtgcagggtgtgagcgggactcggatactctctgagggcgggaactaggcagtgtctcaagagatgccaggtgc

SEQ ID NO: 60904 - DNA, 601 bp, Human
gacatggcagccggtgcacctgtggctcctgtcggcagacacgtgccctccagcctctcgctctctctcatccgttctctttctcatcctcaccctcttgctctcactccaccctcctgagctgccatgtggccatcaccacctctgtggcctctgttctcagggcctttgtgtacctccttcccccagtgcctacctgaaccctcccttccatccccccatgctccagtctgtggtccggcagcctcctccccaggctccggggccaccctcggaaggcctggtgggctctgtcagggarggggcccacaggactcctcgagggctgtggtcgtcaaccgctgagtgcagggtgtgagcgggactcggatactctctgagggcgggaactaggcagtgtctcaagagatgccaggtgcacaggggttgggggctgggttggggggagcacaggccctcgggagccagaaggggactggggctgtggctcaggccatggacagagcagaggcgcagggacctgaagaagcagagggagaagcctggccaacatagcgagaccccatctctactcaaaagacaaaaattagctgggtgtggt

SEQ ID NO: 60905 - DNA, 601 bp, Human
tgtgggtgctgtggccctgggcctgcttcctgggcagaagtgggaggaagtgcacacacctgtcagggaggccccctggccgagggacacctcaggtccccatctcgtttctccgtcagcgtagacttggggctccctctcccctgctagcctcctccatctctttccaggtcaggggatgagacaagggaccctgagaacagtctggggtgggagggagaccccagctcctccagcccagcagggcagggggctgtgccagcctagctcgggaaacccaggaggggaaggtgagggtccygacccctccctggagtgccagatgtggagctgacaccagctgggcgctgacccccctccctgccactggttctcacccccctagccctgcagctcccgctggccaacgatgggggcagccgctcgccatcctcagagagctccccgcagcaccccacgccccccgcccggccccgccacatgctggggctcccgtcaaccctgttcacaccccgcagcatggagaggtgagccaggggcccagcagggttgggtgggaagcagcattgaggggccaccgtgccagccctgggaggagggt

SEQ ID NO: 60906 - DNA, 601 bp, Human
acgacctggagaacttgggcgagatgggcagcggcacctgcggccaggtgtggaagatgcgcttccggaagaccggccacgtcattgccgttaaggtgagccttggcggctaccccggctgcgccccacaccccaggccggtgctgaggctccctcctgtccctgcctgtgcagcaaatgcggcgctccgggaacaaggaggagaacaagcgcatcctcatggacctggatgtggtgctgaagagccacgactgcccctacatcgtgcagtgctttgggacgttcatcaccaacgtgagtmcctggccgcgccctgcagcgtctcctcctccctcacccctgccccttcctagggagcagagcctctggggggtgggccggaagacacagctcccccgggtgcccctctccctgcagacggacgtcttcatcgccatggagctcatgggcacctgcgctgagaagctcaagaagcggatgcagggccccatccccgagcgcattctgggcaagatgacagtggcggtgagtgaccaggcggggcttgcactgggcaggatgacagaggcggtgagtgaccaggcggggcgtgcactgggca

SEQ ID NO: 60907 - DNA, 601 bp, Human
ctgcctgtgcagcaaatgcggcgctccgggaacaaggaggagaacaagcgcatcctcatggacctggatgtggtgctgaagagccacgactgcccctacatcgtgcagtgctttgggacgttcatcaccaacgtgagtacctggccgcgccctgcagcgtctcctcctccctcacccctgccccttcctagggagcagagcctctggggggtgggccggaagacacagctcccccgggtgcccctctccctgcagacggacgtcttcatcgccatggagctcatgggcacctgcgctgagtagctcaagaagcggatgcagggccccatccccgagcgcattctgggcaagatgacagtggcggtgagtgaccaggcggggcttgcactgggcaggatgacagaggcggtgagtgaccaggcggggcgtgcactgggcaagatgacagtggcggtgagtggccaggtggggcgtgcaccgggcaggtggccttgggtctgtgccccctgccacatgcacccccctctgcgtgcctgcagattgtgaaggcgctgtactacctgaaggagaagcacggtgtcatccaccgcgacgtcaagcc

SEQ ID NO: 60908 - DNA, 601 bp, Human
tgcagtgctttgggacgttcatcaccaacgtgagtacctggccgcgccctgcagcgtctcctcctccctcacccctgccccttcctagggagcagagcctctggggggtgggccggaagacacagctcccccgggtgcccctctccctgcagacggacgtcttcatcgccatggagctcatgggcacctgcgctgagaagctcaagaagcggatgcagggccccatccccgagcgcattctgggcaagatgacagtggcggtgagtgaccaggcggggcttgcactgggcaggatgacagwggcggtgagtgaccaggcggggcgtgcactgggcaagatgacagtggcggtgagtggccaggtggggcgtgcaccgggcaggtggccttgggtctgtgccccctgccacatgcacccccctctgcgtgcctgcagattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgt

SEQ ID NO: 60909 - DNA, 601 bp, Human
ccaacgtgagtacctggccgcgccctgcagcgtctcctcctccctcacccctgccccttcctagggagcagagcctctggggggtgggccggaagacacagctcccccgggtgcccctctccctgcagacggacgtcttcatcgccatggagctcatgggcacctgcgctgagaagctcaagaagcggatgcagggccccatccccgagcgcattctgggcaagatgacagtggcggtgagtgaccaggcggggcttgcactgggcaggatgacagaggcggtgagtgaccaggcggggcktgcactgggcaagatgacagtggcggtgagtggccaggtggggcgtgcaccgggcaggtggccttgggtctgtgccccctgccacatgcacccccctctgcgtgcctgcagattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcagtgagtggg

SEQ ID NO: 60910 - DNA, 601 bp, Human
cgtgagtacctggccgcgccctgcagcgtctcctcctccctcacccctgccccttcctagggagcagagcctctggggggtgggccggaagacacagctcccccgggtgcccctctccctgcagacggacgtcttcatcgccatggagctcatgggcacctgcgctgagaagctcaagaagcggatgcagggccccatccccgagcgcattctgggcaagatgacagtggcggtgagtgaccaggcggggcttgcactgggcaggatgacagaggcggtgagtgaccaggcggggcgtgcwctgggcaagatgacagtggcggtgagtggccaggtggggcgtgcaccgggcaggtggccttgggtctgtgccccctgccacatgcacccccctctgcgtgcctgcagattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcagtgagtgggggcc

SEQ ID NO: 60911 - DNA, 601 bp, Human
ctcccctgttctccagccaggagtgagggcttctgggggactcggagggaggagaacataaacctgtccagccctgcccgtctccctcccaggtggagctggcaacaggacagtttccctacaagaactgcaagacggactttgaggtcctcaccaaagtcctacaggaagagcccccgcttctgcccggacacatgggcttctcgggggacttccagtccttcgtcaaagactggtgagaacctccctccacttgggaggtcagggacagcccgctgctctgggcagctggggaggcaayggcaggaggggaatggaggccgcaccctgggatgggcggatgcgactgtgggcgggctcctggctggcggctgccacaggagctggagctggtgcccggggagccatgagctgggtttggacctagcctgaggggacagccagccctgtggcatttggcggggtggctgttggagattgtgagcacgcttctgcaacaagcacagctacaagttcaggagggccatgttcgattctctcaggggagccccacccacctttctgggggacctcagccagctctggccccccaagccaggcc

SEQ ID NO: 60912 - DNA, 601 bp, Human
gtggagctggcaacaggacagtttccctacaagaactgcaagacggactttgaggtcctcaccaaagtcctacaggaagagcccccgcttctgcccggacacatgggcttctcgggggacttccagtccttcgtcaaagactggtgagaacctccctccacttgggaggtcagggacagcccgctgctctgggcagctggggaggcaatggcaggaggggaatggaggccgcaccctgggatgggcggatgcgactgtgggcgggctcctggctggcggctgccacaggagctggagctgrtgcccggggagccatgagctgggtttggacctagcctgaggggacagccagccctgtggcatttggcggggtggctgttggagattgtgagcacgcttctgcaacaagcacagctacaagttcaggagggccatgttcgattctctcaggggagccccacccacctttctgggggacctcagccagctctggccccccaagccaggcccttgccacctggccctaggccaggaggctccgggactcacagttgctccccgctgtcagccggggtcctgaggacatccacagctccttccc

SEQ ID NO: 60913 - DNA, 601 bp, Human
agagcccccgcttctgcccggacacatgggcttctcgggggacttccagtccttcgtcaaagactggtgagaacctccctccacttgggaggtcagggacagcccgctgctctgggcagctggggaggcaatggcaggaggggaatggaggccgcaccctgggatgggcggatgcgactgtgggcgggctcctggctggcggctgccacaggagctggagctggtgcccggggagccatgagctgggtttggacctagcctgaggggacagccagccctgtggcatttggcggggtggctrttggagattgtgagcacgcttctgcaacaagcacagctacaagttcaggagggccatgttcgattctctcaggggagccccacccacctttctgggggacctcagccagctctggccccccaagccaggcccttgccacctggccctaggccaggaggctccgggactcacagttgctccccgctgtcagccggggtcctgaggacatccacagctccttcccccacacacatcttggggacccctggccccttggggagggcctgagcacaggggtggggccggcatcccctcctccct

SEQ ID NO: 60914 - DNA, 601 bp, Human
aaaccaatgcatcaacataaacagtattatttccttccacatttgagacgttcgtgtatctcaacctctttgtgggcctcgaagttgcagaatttgataatagatcccagcacagaactttgcacacagaaaatattcgatgacaactggagtgccctggagccttgtgattataggagcagtacaatcgagtggttaagagtaagggttttgaatcagagggcccgagttcaaaccctggcgcagccactttagtgcatgagactggtcacatcaagtgacccatctaagcctcagtttyttcatctctaaaatggaaattaatggaaattataacatcacctgcctcaaggactgcagacaaacgtccacaaagtgtcaagcacatagtaaatcctcaataaatactggtggctatgtacaacatcatttattcagtgcctaccaggcacagaccacgcacaacgcaacgggatttccaccctcttcaatttgcaccacacttttgtccttcccattttatagataagaaaactaaggctcaacagagtcaagcttgttcgaggtcttgggagcatctcccagggcattagaacttttg

SEQ ID NO: 60915 - DNA, 601 bp, Human
ctcaaaaccaatgcatcaacataaacagtattatttccttccacatttgagacgttcgtgtatctcaacctctttgtgggcctcgaagttgcagaatttgataatagatcccagcacagaactttgcacacagaaaatattcgatgacaactggagtgccctggagccttgtgattataggagcagtacaatcgagtggttaagagtaagggttttgaatcagagggcccgagttcaaaccctggcgcagccactttagtgcatgagactggtcacatcaagtgacccatctaagcctcaktttcttcatctctaaaatggaaattaatggaaattataacatcacctgcctcaaggactgcagacaaacgtccacaaagtgtcaagcacatagtaaatcctcaataaatactggtggctatgtacaacatcatttattcagtgcctaccaggcacagaccacgcacaacgcaacgggatttccaccctcttcaatttgcaccacacttttgtccttcccattttatagataagaaaactaaggctcaacagagtcaagcttgttcgaggtcttgggagcatctcccagggcattagaact

SEQ ID NO: 60916 - DNA, 601 bp, Human
cgtctctactaaaagtacaaaaaattagtcgggcgtggtagccggcgcctgtagtcccagctactcgggaggctgaggcagaagaatggcgtgaacccgggaggcggagcttgcagtgagccgagatcgcaccactgcactccagcctgggcggcagagtgagactccgtctcaaaaaaaaaaaaaaaaaagaaatagcaccatgatctcagactcaacacatccagactgaaactctgtctgctcaaaaccaatgcatcaacataaacagtattatttccttccacatttgagacgttcrtgtatctcaacctctttgtgggcctcgaagttgcagaatttgataatagatcccagcacagaactttgcacacagaaaatattcgatgacaactggagtgccctggagccttgtgattataggagcagtacaatcgagtggttaagagtaagggttttgaatcagagggcccgagttcaaaccctggcgcagccactttagtgcatgagactggtcacatcaagtgacccatctaagcctcagtttcttcatctctaaaatggaaattaatggaaattataacatcacctgcctcaagga

SEQ ID NO: 60917 - DNA, 601 bp, Human
tctctcatttcttttacttgaaatagcaccatgggctgggcgcggtggctcacacctgtaatcccaggactttaggaggccaaggcgggtggatcacctgaggtcaggagttcgagaccagcctgctcaacaaggcgaaatcccacctctactaaaaatgcaaaaaattagctggacgtggtggcggctgcctgtaatcccagctacttgggaggctgaggttgcagtgagctgagatggcacaactgcactccagcctgggcaacaagggtgaaactgtctcaaaaaaaaaaaaaaaaargaaaaagaaaaaaaaaaaaaagaaatagcaccatggtccgggcgcggtggctcacgcctgtaatcccagcactttgggaggccgaggcgggcggatcacaaggtcaggagatcgagaccatcctggctaacacggtgaaaccccgtctctactaaaagtacaaaaaattagtcgggcgtggtagccggcgcctgtagtcccagctactcgggaggctgaggcagaagaatggcgtgaacccgggaggcggagcttgcagtgagccgagatcgcaccactgcactccagcctgggcggcag

SEQ ID NO: 60918 - DNA, 601 bp, Human
ttgctttgtcacccaggctggagtgcagtggtgcgatcttggctcactgcaacctccgcctcctaggttcaagtgattctccggcttcagcctcccgagtagctgagattacaggcacctgccaccacgcccggctaatttttgtatttttagtagagacagggtttcactacgttggccaggctgctctggcactcctgacctcaggtgatccacccgccttggcctcccaaagtgctgggattacaagcatgagccaccacgcttggccgcttttttatgttttgtagaggcgggggcrggggggtgtctcgccatgttgttcaggctggtctttaactcctgacgtcaagtgatcctcctacctcagcctcccaagcactgggcttagaggtgagagtcaccgtcggtgcctggcctctgggagaagtcttgtttggatgatctctgaaggtttttgactccaatgcactattttaaacaatcctggttgtctatgtgacatcagtgatgttgttcacatccgtcgatcatctagcgcatatccaggggagagagatgtgtgtgtctttatgtgtgacagaaaaagagtgaagcagtg

SEQ ID NO: 60919 - DNA, 601 bp, Human
ccatgccattgctgtaaacctttgttactgtcccaaccactcctatcattatttgccttacactcaatgaccaatgtcagtggtgagaaccttgagggcccaggttataccattgccatctaagagtccccaggcaaagccagggtgtgtcacacagcagtacaggaggctgctggctctcagaccaggctggagtgcagaggcatgatcacggctcactgcagccccggcctcctaggctcaggtgatcctcccacctaagcctcccaagtacctaggactgcaggtgcgtgtcactacrtagtcctactaagtcctctatgtagttctgtctaagcttttttatgttttgcagagaggggggtcttgctttgtcacccaggctggagtgcagtggtgcgatcttggctcactgcaacctccgcctcctaggttcaagtgattctccggcttcagcctcccgagtagctgagattacaggcacctgccaccacgcccggctaatttttgtatttttagtagagacagggtttcactacgttggccaggctgctctggcactcctgacctcaggtgatccacccgccttggcctcccaaag

SEQ ID NO: 60920 - DNA, 601 bp, Human
aatcggacccaggtggttctccagcctcagtcgccaccctcccttcccgctcactccagcttcttgccaatatgctacaggcctctgctttggctgttccctctgcagggcactagtgtcctctccttcacttcccagctcattttttaaaattagtatttttttttaaagagatgggggtctctctttgttgcccaggctggtcttgaactcccaagctcaagtgatcctcctactttggcctcccaaagtgctggaattgcaggtgtgagccaccatgcctggcctcccagctcacttytatttttacttatttttcttttgagaaagggtcttgctctgctgccaaactagagtgcagtggcataatcacggctcactgcagcctcaaactgcctcagtttcccaagtagctgggactactggtgtgtgccaccatacctggctgatttttaaatttttttagagacaggggtctcattttgttgcccatgctggcttcaagtcatcctcccacctgggcctcccaaagtgctgggattataggtgagagccactacaccaggctggctcatctttaaaaagctaccttcctggcctg

SEQ ID NO: 60921 - DNA, 601 bp, Human
gctcaaaaacaaacaaacagacaaaaacatttgctggaagctgatccaaacagaccacaagggttaacactgaagaattaaaatgcacattgaagcttgctcaaaatgtaattcaagcatttcccttctttctttctcttttttcctttacctttccttctcctcgccctttctctaagagttaggcatctactttgctttttccctcattctgctttcatggacggtgagatggacaatggctgtcccaggcttactgtccacagtgtggtatcctctaggtctgggaaaagtggacctyctgaaacacacatcatggcctgtggtacaaatctggcccattgcctgttgttataaataaagttttattggaacacagcttgtctcatttgtttatgtattgtctgtctatagatagttttgtactacaataacacagttaagtagtagcaaccgtatggccaaaaaagctgagaatatttaccatctggctcttcacacaaaaaaaatctgccgacctctgttttaaaatgtaaaaacataaaatttcttggagaaaaatctttgtggcattgggctggggaaagatttctcagacaca

SEQ ID NO: 60922 - DNA, 601 bp, Human
tctggaagaggcacactacagagaaaaagatcaatggttgccagcgatgcaggtcggcgtgggggggacaacaaatagtggaacacgggattgtcagggttttagggcagtgaaactattttgcatgatatatagtggtggatgtgacaatacatgtttgtcaaaacccacagaatgaacaatatacagagtgaactctaatctgaattacgtgctttagttactaataatgtgtcaatattgattcaccaagaataacagaggtaccatgtgaatgtgagatgctaataatgggtgtggyggcgccatcacagctcacagcagccaaggctcctgggagatcctcaagcgatcctcacacctcagcctcctgagtagctgggaacgcaggcatgtgccaccacgcccggctgatttttaaaactttttgtagagatggtatcttgcccaggttaattttgaactcctggcctcaagtaatccttccatctcaccctcccaaagtgctaggattacgggcatgagccactgtgtccggcttctttctatttaaaaaaaattttattcagtcaatacttcattgtaatgctacagaacgagt

SEQ ID NO: 60923 - DNA, 601 bp, Human
ggatggtggtgccatcggctaaggtggggacaactggaaacgagtggctggctttagggagagtcaggtcagttaggaatatactgaatttaaggggccgagggcttctggagctcaggacagccttctggtcaaaaaggaggtggcagacagagggcagctgggagccatgaggtgactctgcccaccgtgagtgtcagctttggaagaagaggagaatgacataaccctctgagcataaccctctggcataaccggctgagtcaaaggctggggaaaggcgctaaagacagatggggcrtggcctcaggggcagttagacaggtgggaggaggaggtgctcctgaaagccaatgggagaggatgcttctggaaggaggtggagacagggaacaggacagtatgtgggtgggaggccaacacacacagcagtggctctcgctaggggagactctgcctcccaggggacatgcggcaatgtcaggacatttttgggtttcaccactgggatgtcactactgggaccacgtgggtggaggccagggatgctgctcaacaccctgcagtgtccagtgcggcgtccagccctgacatcaggagc

SEQ ID NO: 60924 - DNA, 601 bp, Human
agggaagacctcactgagagacagagactggaggtggagactgaattaattcagcaataaataagaaacagcaaaggtctgcaaaagaaaagaaacaggcgaaggacaagaagggtattttacaaaagtagtacaaacaaccactaaatagaaacagtgatgaacttcactcgaaataggaatcaccctgatcggatgtcgctcgtccctcacagggtggcaaaggtgagaaatcctgccaaggctagcggatagcagggctggacagaaggaagggtgaactaagcgtcccctagagagygagttagcgacagggaccaagagcctttaaaaggtgcgctctcccatctgccgcttcaccggcaggaagactttctatggaaataaccagtgagcaaagatttgtgccaggacatttatgtcagcagggctttcaaatatcaacaaatgggaagcagaatactatgcgaccgatgatgatgggatcgcgagatgttcagcgaagtggaaaaatgtccagatacaggaagggaagtttatccacagcctgagagaagagcccattctgtagaagtacgtggctgcttatggccatgaatac

SEQ ID NO: 60925 - DNA, 601 bp, Human
agtcagaaaaggaggaggtgggggggttgccagttggcctcagtggttttaagtcagggtctcagtctgttgccaagactcggctcactgcaacctctgcctcctaggctcaggcgatgctcccacctcagccccccaagtagctgggactagaggggcacgccaccatgcccagctaattttttaattttttgtagagatggggtttcgccatgttgcccaggttggtctcaaactcctgagctcaagcgatcctcccaccttggcctcccaaagtgctgggattataggcgtgcgccaycgcgcccagcctcctcagtggtttttaaagctccctagtgattccagtgcatgaggggcatggggcttcccatggttatgcagaggagaggaggcctccagaggagaagtgcaaacgggcccccaagttactgtttctccaggcagggtccacaagccacctgcaccaggggcatctggagttcaaggcaacaacttggctccctagatacccctaccccatcccgggacccaggatgtcaggcaggtgtgggaatccacatccccaaactccttacagatgctcctcctgcccaccagt

SEQ ID NO: 60926 - DNA, 601 bp, Human
tggctgtccctcctcaggctcctcactccctgtccattccatggagacccatgggccctgaggacccacctttggcccttgtctctgccacatgctcttcctcaccacacatgcccacacctgccaacatcaccgagggagtcgcacacccctgggctgcccgtcaccttccatggtcaagctcttctctgtcctcaaggagctgacgcattaactgagcacctactatgtgtcaggccctgtgcttggctgggagttagtgatgcatgacagaggacggtcgctgccatcatgaaagccrtcacatccctgggggcaagtcagacaacatggtggtgagaaactgacaagcattaagacaggggtcaggagggcccgtcgcagaggagatattttaaacctctgcgtggctgacgtgagcattccagacagaagagcaggtgccaagtctccgaggcagagacaatgccagtgtattcccagaaagtagaggtggcccgtgtggcaagggcctaggaagtggccactggcagcagggcagagccagtgtggagccagcgggctggtgatctaatccagatgggagatgcaggctatgtgc

SEQ ID NO: 60927 - DNA, 601 bp, Human
ccgtctccctggctgtccctcctcaggctcctcactccctgtccattccatggagacccatgggccctgaggacccacctttggcccttgtctctgccacatgctcttcctcaccacacatgcccacacctgccaacatcaccgagggagtcgcacacccctgggctgcccgtcaccttccatggtcaagctcttctctgtcctcaaggagctgacgcattaactgagcacctactatgtgtcaggccctgtgcttggctgggagttagtgatgcatgacagaggacggtcgctgccatcrtgaaagccgtcacatccctgggggcaagtcagacaacatggtggtgagaaactgacaagcattaagacaggggtcaggagggcccgtcgcagaggagatattttaaacctctgcgtggctgacgtgagcattccagacagaagagcaggtgccaagtctccgaggcagagacaatgccagtgtattcccagaaagtagaggtggcccgtgtggcaagggcctaggaagtggccactggcagcagggcagagccagtgtggagccagcgggctggtgatctaatccagatgggagatgcag

SEQ ID NO: 60928 - DNA, 601 bp, Human
gcagccaggtcaggactgccagggcctctgcaagtgctccagatggcagtgtgaaactggcaggtgtccctgcaccccctttgtgacacactcagcacacgtacaagcgaatacccactcactggacaccacgggagggactcgggatggcaagggcaggaccagaggggacagcctctggggtcagggattcctgtgatatggattcttgaccacgacgccagcctggctgggtttttttcactcctgaacacctgctctcgaagtgctcagcgccttctgcatccgggccccatctttmtgctccataaacaagcctggaccacctgcctccttggctgcggcgcctcaggcagcctaagtgctgcttgagaaagtcacacactgatagggactcgagcaccaatgcccgttcctgtgtcctcagccacagccggttcctctcaacacagaaacatggtccctgcttggaccaagtccctgcttcctcatctcccaggtgctgggtgatcctgactggtcccctaggatggtcactgccctggggaccgtttcaggatgtgtcccctgagctttcggcagctcagggtagggcctaccc

SEQ ID NO: 60929 - DNA, 601 bp, Human
aaaactcctcagggctaagagactcagctctggggccctggacaaagtgagaacccagagcaccaagaccgtaggaccaggcccgtgtggagcgaattgggatcgcagcttggagaacaagcaacggagcagtgcagccaggtcaggactgccagggcctctgcaagtgctccagatggcagtgtgaaactggcaggtgtccctgcaccccctttgtgacacactcagcacacgtacaagcgaatacccactcactggacaccacgggagggactcgggatggcaagggcaggaccagagsggacagcctctggggtcagggattcctgtgatatggattcttgaccacgacgccagcctggctgggtttttttcactcctgaacacctgctctcgaagtgctcagcgccttctgcatccgggccccatctttctgctccataaacaagcctggaccacctgcctccttggctgcggcgcctcaggcagcctaagtgctgcttgagaaagtcacacactgatagggactcgagcaccaatgcccgttcctgtgtcctcagccacagccggttcctctcaacacagaaacatggtccctgct

SEQ ID NO: 60930 - DNA, 601 bp, Human
caggatcccacgtgacatttagcagtcacatcccctcaggctcctctcgactatgacagtttcttgtttctcgtgactgtgacggttttgaggactggtcggacatcccgtagactctcgattgggtttgctggagtctgtcacagctggagcgcccttctcgtcacacgatgtcaagggcacaggccgtcaacgtgacttatggctgctggtgctgaccgtgatcactgggccgaggcagtcagtttgccaggtttcttggctgtaaagtgactcccacccctttccacactgccctccrcggaaggaagtcaggacgcccagcccacacttaaggcatggccctgacgtagcagctatagaaatgacgtgcagttagttctgcatggggcgctctctttcctaaagaacaaaaccaaaatcagatcctctagactcgtatttctaataaaactcctcagggctaagagactcagctctggggccctggacaaagtgagaacccagagcaccaagaccgtaggaccaggcccgtgtggagcgaattgggatcgcagcttggagaacaagcaacggagcagtgcagccaggtcaggactgc

SEQ ID NO: 60931 - DNA, 601 bp, Human
ctgtaccccctttgtgaaacactcagcacaggtacaagtgaacacccactcactggataccatgggagggactcgggagggcaagggcaggaccagaggggacagcctctggggtcagggttcagaaggagcttcacaggacatttggccaaatgctctcactaaaggggaagtgaggaggcacagggaagagcgcaatccccgtctcccgcagcttatccatgcacttgcaaggctgctgaacatctgctgtgggcctgagcctcacccagcactgctccattcccccagccggcagagygcgacaacgagcaggtcaccgaacaggaggtggcctggagccccactgaggcagagatcctcctggcagctgggccagggacatccagatccatctcaccgacagcaagattacaaatccagcagagagcctaacccaggtttgccactttctttttaaaatgaattttatttttcagaacagttttaggtttacagaaaaattacaaggataataccaagttcccatatggccccctcccagtttcccctatgggtaccaccgcaagtgagtatgaaatgctggtgacgatgaatgttc

SEQ ID NO: 60932 - DNA, 601 bp, Human
caccgccacctcaaattcttgggctcaagacagcctcccacctcagcctccagagtatctgggactacaggcccgctccagcaggcccaagctaattgttaaaattatttttagagatggggtctcactatgtcacccaggctggtctaaaacttctgggctcaagcaatcctcccacctcggccccacctcgacctcccaaagtgttgggattacagatgtgagccactgagcctggccaagaggttttacttttgtaattaaaataaccccaaaagttatttacaaaggagtatttttwaaaaatactgtgctacggacagcatctttctgaaagaccagtcccgtgggtgccggccgctctgtggggcctgggtggtgaggatgaggaaggccacggcagtggaggctggtgggaccccagtttgtgtcactgctgtttctctgccacttccttgtccagagcaggagggcctgctggcaccacccaccaccagttccatttacctttccaagcctgagaccagcccgaccccgctgtggggcagaagagtccagggagaggccaggggctgagaatccccagccctgccagacagtg

SEQ ID NO: 60933 - DNA, 601 bp, Human
tgtgaccatggaatctatatgttacagctccccaggaggccctaataattggcaggtccaagagggacccttcagggtgcctgatgtgactcagggagcacctttctctggggcaggggaatctagcagatctaaaggctcacacaggaccacctcattccaaatggccttggagcaagagaggggattctggccgggaagcccttacgtctgtgggtatcttgtgaaggcgggcactgagggcgggtgggtgcagtggctgctgcaggaagcccagttgcaggggcctgcctggggcacrggaggctcagggaaggctcagcagtacccaggactgacaggagaccagggagcaaaggtcggaaagacacgaggcttgatacaggtggcaggagctgcccacgaacccaggagccagaaggcagacacgtggggacgggggtaagtggggctcggggttgacagccccagtgcacgagagcgcgggtcagatgatgaggacagaggaaatccatctgtgtgacctggaggacctgcaactcatcccaggaagccactatggccctgctggaggtgctgcccctgggctgctgcacagttg

SEQ ID NO: 60934 - DNA, 601 bp, Human
accctgggaccaccttacagagaatggtgggcacaactgggctccccgaggatggaccatgggccagtgacccccagcacctggcagagggcttggccctagcccgtattgtcataaaggatttgtctggtctctgtcccagattcctaggaggaagcttgtaaaactcctggaatttctgtctttgttaccataaggccttggatcccacttgagtttgtgctaagtgatggctcaggatgggctccgacaccagaaagaccaagcatgtgactagacggctggggctgtgagctgggcrataccggcctgacctccagggtgggggaggggaaaggggtgctggggatggagttcgatcacatggccaaagagtcaatcggtcatgcattcgtaatgagcccagtaaacacggcagacaccaaagctccacggagcctcctggcaggtgcacaggtcacatgcagggaggactaggcacctgatcccaccaggtgcagacatgtgagctctgtgcttgggaccctccctgtgtggctcttcatttggcaggccctgagttgcaacctttataaacaaactgtcatcagaagtgtgagtt

SEQ ID NO: 60935 - DNA, 601 bp, Human
gttcccatgatgtgcctggccactgggtctcctctaggatgcggcccttgccttgtgcccctgcaggtcctgctgctcagaataccctcatctccaccctggtctggctaactccctctcctcctccagatctcaactctggctttcttgagggagcctcctctggcactggccactattataggctcctaagcccaccctgggaccaccttacagagaatggtgggcacaactgggctccccgaggatggaccatgggccagtgacccccagcacctggcagagggcttggccctagccygtattgtcataaaggatttgtctggtctctgtcccagattcctaggaggaagcttgtaaaactcctggaatttctgtctttgttaccataaggccttggatcccacttgagtttgtgctaagtgatggctcaggatgggctccgacaccagaaagaccaagcatgtgactagacggctggggctgtgagctgggcgataccggcctgacctccagggtgggggaggggaaaggggtgctggggatggagttcgatcacatggccaaagagtcaatcggtcatgcattcgtaatgagccca

SEQ ID NO: 60936 - DNA, 601 bp, Human
gtgccagagaccaccagcctccaccagaagctgtgagagaggcctgtgacagatcccttcccagtgccttcaagagaaaccaaccctgctgacaccttggtctcgggcttccagcctccagaactgtgagttgatacccttcttctgttgaagcaacctggcctgtggggctttgtcatggcagctgagcaaactcctgaccactcagcttgccacagatccctccactggcatcaacgcccagttcctcctgtccctatttagttcttgactgcgttgatcatgacctgacacgctacattttttttttttttttttagttttttttgtagagacagggtcttgctatgttgctcaggttagacttgaactcctgggctcaagtgatcctcctgccccagcctcccaaatgccctggattacaggcatgcaccaccctgcctggcatctattttacttatttaacttttaactttgcaaacagactctgtgagggccagacttgtgtgtctcctgccatatccaaagcactcagagcagcctcaggtgaacggcaggcatctggggaccgctgctgcgtgagtggagtgcgcagtagcca

SEQ ID NO: 60937 - DNA, 601 bp, Human
tcaggagatcgagaccatcctggctaacatggtgaaaccccatctctactaaaaatacaaaaaattagccaggcatggtggcaggcgcctgtagtcccagctactcgggaggctgaggcaggagaatggcgtgaacccaggaggcggagcttgcagtgagccgagatcgcgccactgcactccagcctgagtgacagagcaagactccatctcaaaaaaaaaaaaagtattttttttgaaaacataaattcaatttagaaaggcgggaaatgtggatacaggcactctcacagggagaagkctgtgtgaagatggaggcagacactggggtgatgcttctctaaaccaagcagtgccagagaccaccagcctccaccagaagctgtgagagaggcctgtgacagatcccttcccagtgccttcaagagaaaccaaccctgctgacaccttggtctcgggcttccagcctccagaactgtgagttgatacccttcttctgttgaagcaacctggcctgtggggctttgtcatggcagctgagcaaactcctgaccactcagcttgccacagatccctccactggcatcaacgcccagttcct

SEQ ID NO: 60938 - DNA, 601 bp, Human
aaaaaaagtatttttttttggctgggcgcagtggctcatgcctataatcccagcactttgggaggccgaggcgggtggatcacgaggtcaggagatcgagaccatcctggctaacatggtgaaaccccatctctactaaaaatacaaaaaattagccaggcatggtggcaggcgcctgtagtcccagctactcgggaggctgaggcaggagaatggcgtgaacccaggaggcggagcttgcagtgagccgagatcgcgccactgcactccagcctgagtgacagagcaagactccatctcaaaaaaaaaaaaagtattttttttgaaaacataaattcaatttagaaaggcgggaaatgtggatacaggcactctcacagggagaagtctgtgtgaagatggaggcagacactggggtgatgcttctctaaaccaagcagtgccagagaccaccagcctccaccagaagctgtgagagaggcctgtgacagatcccttcccagtgccttcaagagaaaccaaccctgctgacaccttggtctcgggcttccagcctccagaactgtgagttgatacccttcttctgttgaagcaacctggc

SEQ ID NO: 60939 - DNA, 601 bp, Human
agtacaggcacgtggccaaagcattgaggagggtgttgaatgctgggttaggaaaagccaacactgtgtgttagaaatcatgcagggaacgattatcatcactgacgctcaccgcctgcagccgcatggtggcaagctcactgagggatgggccgtgagccaggatgcctggcagtgcttcctcactgggtgctcaccatcctcaaggaggcaggcgtgactcctatgtcacaaagcccagcaactgagggcccgcagcttgtgtgtggctacctctctgatgtgctggacagtgagccgrtgccagagaggtcctggtgcctgaaagcagcccgtgctgcagcgggcaagcaagctgggagctactgggaacacaggagactcccctgccaaagagcaagctcgccacagaagccctgacaggggctgtgagttctgggaggaccccgagtttgtactcaaatccactcaagtgttcaatattaaacgactcaatgccttttggatttatattttgcaaaatcaaagaaaactgaagagaaccttctgggtgctttgacaaaatggtacattcatcattcgtgtggagagggtggtgagg

SEQ ID NO: 60940 - DNA, 601 bp, Human
taatctccagatgaatacactataaagttcacaattaaggtggatatagaagcgaaggaatacaaaaaattaagctctgtcagctcagggtgggattttttttctctttttttaaaaaaagagttgggggtctcgctatgttggccaggctgttctgaactcctgggctcaagcaatcctcccaccttggcctcccaaagtattaggattacaggcgtgagccaccgcgcccggccatcctcatctatttaacactaaaaagcccgtcacaggaaggcaaactccacacaggctggcctgccacacacactctgtctccagcagagggagctacagccctgggatgggagcctcaccttcccaccaattctgcatcctggggtgggaagcagagccgggagaccctcctggctcccttctctctgcctccctcactgctctgcaaagatgacaaaggttccttaggccaccttgaggttcacagccgaccctgggggcgcaatactaaggtgcccccaacaccctgggagacactatcttgcagagggaaaggaagcaatgcccccagcagctgtgtgcagaggtgagttccccctgcctg

SEQ ID NO: 60941 - DNA, 601 bp, Human
ctcactgcaacctccgcctcccaggttcaaacgatactcctgcctcagcctccccagtagctgggattacaggtgcctgccaccatgcctggctaagtttttgtatttttagtggagacggggtttcaccatgttggccaggatggtctcgacctctcgacctcgtgatccgcccaccttggcctcccaaagtgctgggattacaggcataagccaccgtgcccggcctatttttagtacagatggggtttgccatgttggccaggcaggtctcgaactgctgacctcaggtgatccaccyaccttggcctcccaaaatgctgggattacaggcgtgagccacggcccccggcccccttgtgttttttagaatttaacagcagagtccaagaaacggcataatctccagatgaatacactataaagttcacaattaaggtggatatagaagcgaaggaatacaaaaaattaagctctgtcagctcagggtgggattttttttctctttttttaaaaaaagagttgggggtctcgctatgttggccaggctgttctgaactcctgggctcaagcaatcctcccaccttggcctcccaaagta

SEQ ID NO: 60942 - DNA, 601 bp, Human
gctggccggctcgtagggaagctggctccaagcagatggcttcattctgtttctaaagaccctgcggcccagcggagagaaggcacgtgtgcaagtgtggcttcctcgtctggggttgtagagtggctttcaaatgcaaactgcctgagtgaaaggaagaaagctctagtaaggggggcaggagggatgctgtttagcagagggggatatcaattcactcaattatttaatggatgtatactttctgaagatggctctgcattttttgtttttttcttcccctagtgttttttatttttarttttttttttaagatggagtctcgctctgtcgcccaggctggagtacaatggcacgatctcagctcactgcaacctccacctccccggttcaagtgattctcctgcttcagcctcccgagtaggtgggactccaggcgcctgccaccatgcctggctaatttttattttattttactttatttatttatttagagatggagtttcgctctttttgcccaggctggagtgcaatggtgcaatctcggctcactgcaacctccgcctcccaggttcaaacgatactcctgcctcagcctccc

SEQ ID NO: 60943 - DNA, 601 bp, Human
gggagtagggtcctgtggccaccccctgccagctccatgctgctgctgtcacctcactcctgtcttgggatactccactctaaggtcctacacccctcccgtgggccccaaattgccatcagaatcaaatgaggccagaacactgcccaggctcatacagcagagctgaacctatccacaggctcgccaggcaggcctggggtccctgtatgggaagggccagggccccagcagccaagcccagagggcatcttctcttgccacctcaactgagccacccaagggccagtcccgggttccyggctaaacccaatccctggacggagcagtgtgagacctgaggcccgtcctgctatgggggacattggtcagctgggcatgggtgtgagatgctgagcaaggcgggtggaaggagagcatggctgtcctgcacccctgcctgtccatacactaggcccgggagggaaacatgagtagcccgtcccttgaggaacctgggaagcgggctggaaactggatgagggggatggggatgagggcacactgagcagcgcactagctccttctctgggggcaaggacatgatggagtcaggggaagg

SEQ ID NO: 60944 - DNA, 601 bp, Human
gtgtggtgtgtggttggtgggtaacagggttggagtggggactgcgtctgagagatcctccctgggctcaggggccactctcctggctgctgtctctgggcccgctgtgacagcaggcctcgtggccgagcctgctgcaaaggtgcccagctcagcctgcatgccttctccttcatgccaggagggagtagggtcctgtggccaccccctgccagctccatgctgctgctgtcacctcactcctgtcttgggatactccactctaaggtcctacacccctcccgtgggccccaaattgccrtcagaatcaaatgaggccagaacactgcccaggctcatacagcagagctgaacctatccacaggctcgccaggcaggcctggggtccctgtatgggaagggccagggccccagcagccaagcccagagggcatcttctcttgccacctcaactgagccacccaagggccagtcccgggttcccggctaaacccaatccctggacggagcagtgtgagacctgaggcccgtcctgctatgggggacattggtcagctgggcatgggtgtgagatgctgagcaaggcgggtggaaggagagc

SEQ ID NO: 60945 - DNA, 601 bp, Human
aaaacaaatggatggagtaaagaaaaccaatgactaacagaagattaaagcttcagactttcttcccggctgaagccatgactccacagtgttggcgcccaaagatattttggtgacagacatccccaatagacacccaggcctcttatttggaagaaagcaacattaggaaacagcacatccaccgtcactatttagctgccaggtgtccgccacagagtgggtgcgtgggtgtggtgtgtggttggtgggtaacagggttggagtggggactgcgtctgagagatcctccctgggctcmggggccactctcctggctgctgtctctgggcccgctgtgacagcaggcctcgtggccgagcctgctgcaaaggtgcccagctcagcctgcatgccttctccttcatgccaggagggagtagggtcctgtggccaccccctgccagctccatgctgctgctgtcacctcactcctgtcttgggatactccactctaaggtcctacacccctcccgtgggccccaaattgccatcagaatcaaatgaggccagaacactgcccaggctcatacagcagagctgaacctatccacaggctcgc

SEQ ID NO: 60946 - DNA, 601 bp, Human
tgtggctgtgccgtcgcctgccagcggggctaagtatggctttcaggagcgcgcaccctcccgacccacctgaatctctgcgcctggtggtgaacggggcctccgaaccgtcgcgctggcgagtggtacagctgcgagaggagtgccacgtttttgttctggttggggttggctgcaaacttcactgtgatgggctcagaggaacctgggggtttatgaccattgaaactggtaattgcctcttctgcctccgaccgtttgtcaaaccggataaacgcaacccctctggacaaaccttttyaacaaatcaacaaaaacggagttagggggaaaaacgctaggactttcaaaactgaaaagcaaaagtcaggtcagtctactgtgggccaggctagaagtctggttaaggaaataaacaaaaattaaacctaaaagtgaaaacaaatggatggagtaaagaaaaccaatgactaacagaagattaaagcttcagactttcttcccggctgaagccatgactccacagtgttggcgcccaaagatattttggtgacagacatccccaatagacacccaggcctcttatttggaagaaagcaac

SEQ ID NO: 60947 - DNA, 601 bp, Human
tggtcttgaactcctgggctcaatcgatcttcctctctcagccacccaaggtgctaggattacagggataagtcactgtgtccagcctggagtcactgttttgattcccatgaaagacaacgccccatcggaagtaaacggctttcctacagacacctttctgatggaggttgtggtgtggagctgcagaatgattctgaaacgcgctctctgacgggatcagtctatcatccccgtggtttctattctgtggctgtgccgtcgcctgccagcggggctaagtatggctttcaggagcgcrcaccctcccgacccacctgaatctctgcgcctggtggtgaacggggcctccgaaccgtcgcgctggcgagtggtacagctgcgagaggagtgccacgtttttgttctggttggggttggctgcaaacttcactgtgatgggctcagaggaacctgggggtttatgaccattgaaactggtaattgcctcttctgcctccgaccgtttgtcaaaccggataaacgcaacccctctggacaaaccttttcaacaaatcaacaaaaacggagttagggggaaaaacgctaggactttcaaaac

SEQ ID NO: 60948 - DNA, 601 bp, Human; identical to SEQ ID NO: 28515

SEQ ID NO: 60949 - DNA, 601 bp, Human; identical to SEQ ID NO: 28516

SEQ ID NO: 60950 - DNA, 601 bp, Human; identical to SEQ ID NO: 28517

SEQ ID NO: 60951 - DNA, 601 bp, Human; identical to SEQ ID NO: 28518

SEQ ID NO: 60952 - DNA, 601 bp, Human; identical to SEQ ID NO: 28519

SEQ ID NO: 60953 - DNA, 601 bp, Human; identical to SEQ ID NO: 28520

SEQ ID NO: 60954 - DNA, 601 bp, Human; identical to SEQ ID NO: 28521

SEQ ID NO: 60955 - DNA, 601 bp, Human; identical to SEQ ID NO: 28522

SEQ ID NO: 60956 - DNA, 601 bp, Human; identical to SEQ ID NO: 28523

SEQ ID NO: 60957 - DNA, 601 bp, Human; identical to SEQ ID NO: 28524

SEQ ID NO: 60958 - DNA, 601 bp, Human; identical to SEQ ID NO: 28525

SEQ ID NO: 60959 - DNA, 601 bp, Human; identical to SEQ ID NO: 28526

SEQ ID NO: 60960 - DNA, 601 bp, Human; identical to SEQ ID NO: 28527

SEQ ID NO: 60961 - DNA, 601 bp, Human; identical to SEQ ID NO: 28528

SEQ ID NO: 60962 - DNA, 578 bp, Human
cttgaatgtgcttgcatttctcctctcatgctctggtgctctgctgatgccatgaggagaacatacccaggctagcccactagtttcaggaggaggacaggaggcacatggggcagagccaccagcctagatcaatggacgctattaatgtgtgctgctagacttttgtggctggataataaaagtgggtctgttcctatgacggaatactatacatcaatgaaaatggacaaaccatagctgcacgcaaccataagaacagatctcacaaaagtaaygttaagcaacagaagccaaatacaaaagagtacataacgtatgcttccgatttgtaaagttccaaaataggaaaaatctaatgtgtagagttagaatcttgaagccggagtggtgactgaaagaaacatgggagttcctatggttccagcaagattccatttcttaatttacatgcttgttaaacaagtatgttcattttctgaaacttaaccaagtggtacacttctgagttttgtactttcttgtacatgttatatttattttatttgaatgtatagtttttgtgacacaggagatat

SEQ ID NO: 60963 - DNA, 461 bp, Human
cttgaatgtgcttgcatttctcctctcatgctctggtgctctgctgatgccatgaggagaacatacccaggctagcccactagtttcaggaggaggacaggaggcacatggggcagagccaccagcctagatcaatggacgctattaatgtgtgctgctaracttttgtggctggataataaaagtgggtctgttcctatgacggaatactatacatcaatgaaaatggacaaaccatagctgcacgcaaccataagaacagatctcacaaaagtaatgttaagcaacagaagccaaatacaaaagagtacataacgtatgcttccgatttgtaaagttccaaaataggaaaaatctaatgtgtagagttagaatcttgaagccggagtggtgactgaaagaaacatgggagttcctatggttccagcaagattccatttcttaatttacatgcttgttaa

SEQ ID NO: 60964 - DNA, 601 bp, Human
gatgaaacccaaagccatccacaggaggaaaacagctcaggtttttttgtttgtttgtttctaaattccacgtatactggtcaggctgtaaaatctcaagatgcttgcaaattgagctatccccttctgagtaaagcagtcataggcccttcctgtgcgaaagtcgccatgacttgttccatgtaaccatcccctaccctggccatggctgcttagaccaggctcacgtgtctaatggcaccttggtgctctgctcaacagcaggcaaggtaagtaacttcttcaagccacccaaagagartaattggcctacgagagccttcctgcagggtctacatgcaagacacagcagtcagtaatgccctaaaaacaaacagtaaggaatggagttacacagatgacaactactagagctgatgctgggctatcgagctaccagagataatggggtagctgttgagatggtctcctgtgtggcctgttcacaatccccatcgttaacctgactgtgtctctgttcttgcgcgctcaaagagcctcacgcaacaggtctaatataaactagtcccccggctcaccttctcatcgtcataacttttta

SEQ ID NO: 60965 - DNA, 601 bp, Human
actctcccattttgccaccacaacagacgtttccaatcgagcacagtatttgctcagtgtctggaagcaatccaaacagatgaaacccaaagccatccacaggaggaaaacagctcaggtttttttgtttgtttgtttctaaattccacgtatactggtcaggctgtaaaatctcaagatgcttgcaaattgagctatccccttctgagtaaagcagtcataggcccttcctgtgcgaaagtcgccatgacttgttccatgtaaccatcccctaccctggccatggctgcttagaccaggytcacgtgtctaatggcaccttggtgctctgctcaacagcaggcaaggtaagtaacttcttcaagccacccaaagagaataattggcctacgagagccttcctgcagggtctacatgcaagacacagcagtcagtaatgccctaaaaacaaacagtaaggaatggagttacacagatgacaactactagagctgatgctgggctatcgagctaccagagataatggggtagctgttgagatggtctcctgtgtggcctgttcacaatccccatcgttaacctgactgtgtctctgttcttg

SEQ ID NO: 60966 - DNA, 601 bp, Human; identical to SEQ ID NO: 28529

SEQ ID NO: 60967 - DNA, 601 bp, Human; identical to SEQ ID NO: 28530

SEQ ID NO: 60968 - DNA, 601 bp, Human; identical to SEQ ID NO: 28531

SEQ ID NO: 60969 - DNA, 601 bp, Human; identical to SEQ ID NO: 28532

SEQ ID NO: 60970 - DNA, 601 bp, Human; identical to SEQ ID NO: 28533

SEQ ID NO: 60971 - DNA, 601 bp, Human; identical to SEQ ID NO: 28534

SEQ ID NO: 60972 - DNA, 601 bp, Human; identical to SEQ ID NO: 28535

SEQ ID NO: 60973 - DNA, 601 bp, Human; identical to SEQ ID NO: 28536

SEQ ID NO: 60974 - DNA, 601 bp, Human; identical to SEQ ID NO: 28537

SEQ ID NO: 60975 - DNA, 601 bp, Human; identical to SEQ ID NO: 28538

SEQ ID NO: 60976 - DNA, 601 bp, Human; identical to SEQ ID NO: 28539

SEQ ID NO: 60977 - DNA, 601 bp, Human; identical to SEQ ID NO: 28540

SEQ ID NO: 60978 - DNA, 601 bp, Human; identical to SEQ ID NO: 28541

SEQ ID NO: 60979 - DNA, 601 bp, Human; identical to SEQ ID NO: 28542

SEQ ID NO: 60980 - DNA, 601 bp, Human; identical to SEQ ID NO: 28543

SEQ ID NO: 60981 - DNA, 601 bp, Human; identical to SEQ ID NO: 28544

SEQ ID NO: 60982 - DNA, 601 bp, Human; identical to SEQ ID NO: 28545

SEQ ID NO: 60983 - DNA, 601 bp, Human; identical to SEQ ID NO: 28546

SEQ ID NO: 60984 - DNA, 601 bp, Human; identical to SEQ ID NO: 28547

SEQ ID NO: 60985 - DNA, 601 bp, Human; identical to SEQ ID NO: 28548

SEQ ID NO: 60986 - DNA, 601 bp, Human; identical to SEQ ID NO: 28549

SEQ ID NO: 60987 - DNA, 601 bp, Human; identical to SEQ ID NO: 28550

SEQ ID NO: 60988 - DNA, 601 bp, Human; identical to SEQ ID NO: 28551

SEQ ID NO: 60989 - DNA, 601 bp, Human; identical to SEQ ID NO: 28552

SEQ ID NO: 60990 - DNA, 601 bp, Human; identical to SEQ ID NO: 28553

SEQ ID NO: 60991 - DNA, 601 bp, Human; identical to SEQ ID NO: 28554

SEQ ID NO: 60992 - DNA, 601 bp, Human; identical to SEQ ID NO: 28555

SEQ ID NO: 60993 - DNA, 601 bp, Human; identical to SEQ ID NO: 28556

SEQ ID NO: 60994 - DNA, 601 bp, Human
gctctccctctgactccccatatgactctggccatcacctttcaaggctgagattcctcatctataaaatgtgggtgttggcaaagataagcagcaaggttcctctcagctgtcattgataaatatgaccaggaccagctcaaatattacaacccagaaatgtgggtcatgacatgggggcagggggagatcattctcataccagaaagcattgtttgagtgattcatgccccaaggacattgtggatggtctgaaattgtgtgggtctgttactaaatagacagaataacatgtgaaggratgtatgcaaccagttagtaggatggaagtagttgtttgatttcctggcaatggggagtttagattagttgcataaagcctgtgcaggaaagggagccagtcactcttaccttccccaccctccaccccctttcccaaagctgcactcctgatggagcccacctttcatttgcccccagtgttgcggcattgccctgactgcggagtgcatcttctttgtatctgaccaacacagcctctacccactgcttgaagccaccgacaacgatgacatctatggggctgcctggatcggcatat

SEQ ID NO: 60995 - DNA, 601 bp, Human
tactatgtgcccaggcaatccaatatgcacagtaataatacatctatcattttacttaatcctcataaatctatgaaataggcattatcactctggtcatttgagaaaggaaaaaaaatgagacagaaaggtaaaatgacttgtctaaagtgacatagttggcaactgaaagagcaagaattctgaacccagatggcctgactcccagggcccaagtttgtaatcccctgtgggtttcaccactctgccatggccatgggccttccaatgggaggatctctgttctacctcagctaagacktgctctcaattctacatctttctttctctcccattctctgttttcctagcctaagccaccctacagtatgtgttcccctggcctcatagtgatttcttttaagatgagagtctcttctctgcatggggacttatgccaacctcagccagctgtacttggtgcctctgagtacagttttgctccaggagagaatgttcagtgtccccaggaaaagacagagaaaaatattttcctctccttgaaaattagcgtgctatctctccctcttgtgttgcctcttcctactatagttcacaccca

SEQ ID NO: 60996 - DNA, 601 bp, Human
ctgtcctttgtccagctcttttgattctgttctgcattccatctcctttgccccaacagtcttccctgctctgatctgcctcatcagtttctccctttcaacagcctacatggacaccttaaattgtctatcttataaaaagactcccttgtccaacattcacccactattctgtcctactactgttttgttttattccacagcaaatctcagaagagatgcctacacttgtggtccccattttcatccctctcatctgctttcatccaactacaattggcctctggcctcaccactcaamaaaaacaaccctggccataattaccaattacctccatcctgccaaatccaatagccaagtctctgtcctcatcttctttgacatcttatcagcatttgtctcactgactactcccgcttagtctcctctgctgggttgtcactctttacccaaatctgaagcttggagtgctacaaagctcaattttggacccttaaatcttctctgtgcccactaaatcctagtttgaaataagcctggcttagacttaaccatttttcccagaatgcagaataattatttttcttggttagatatttc

SEQ ID NO: 60997 - DNA, 601 bp, Human
actctatgagataggtactatattccaattttacagttaaggaaactgaggcttagacagtttaagtaacatgtcaatggctacagggttcactaatgactagtaaagtaggaagtgtaaaaattcttttacaaactgtaaaatgtaagttgtaagttatcaataccttcagctgtcatttggggatttcttagtaaatgtaagatatggtacactttccgtatcttctttctctataaaatttcagttgctacattgatggctctagtagggaccacgaaagagaattttgtatctctcrtctgctgacaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcaggtgagtcctctctcctcccaagacttcccaggaggttctgctgctctttatgagaaaaatattggtcaactgtaggaaatagtctttcagtaaggaattctacattctt

SEQ ID NO: 60998 - DNA, 601 bp, Human
ggtacactttccgtatcttctttctctataaaatttcagttgctacattgatggctctagtagggaccacgaaagagaattttgtatctctcatctgctgacaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcaggtgagtcctctctcctcccaagacttcccaggaggttctgctgctctttatgagaaaaatattggtcaactgtaggaaatagtctttcagtaaggaattctacattcttttccctaaacctcatgttaactatttccttctctgttaataaactgcaaatgctaaaccaggactgataggggcaaatttacattttaataaaattaacaaaacatgagaattgcaatagcagaacccaactttgtttaaatgaagacaatttgcacaatgtatggaattggtatgtcaagaaatatttacattaaacaaagttttgc

SEQ ID NO: 60999 - DNA, 601 bp, Human
atttccttctctgttaataaactgcaaatgctaaaccaggactgataggggcaaatttacattttaataaaattaacaaaacatgagaattgcaatagcagaacccaactttgtttaaatgaagacaatttgcacaatgtatggaattggtatgtcaagaaatatttacattaaacaaagttttgctctagttttgcaaaatgtaaattggaagggatgatgtgcaaaaagaatgttttgccaattccaaagcaatgactattgctgaggataaatgtagtaattacacatccacattccwtattcaatggtaaagtaggacagtcttaataaacattaggttggtgatttggatggaaggtagtttacatacagatagtttttgaaaaagtttccaggctgatgaggataatgtgattacgatcatgaaaactaacatttattgtgtacttactaaatgccaaacactgtttccagtgccacacatacactatctcctttaatgctcagtagtaggtgccagtaggatccctgttttacaaacgaagaacttagacgtagagatactaataaataccttgctgaggtcacacaactagta

SEQ ID NO: 61000 - DNA, 601 bp, Human
aaaagtttccaggctgatgaggataatgtgattacgatcatgaaaactaacatttattgtgtacttactaaatgccaaacactgtttccagtgccacacatacactatctcctttaatgctcagtagtaggtgccagtaggatccctgttttacaaacgaagaacttagacgtagagatactaataaataccttgctgaggtcacacaactagtaaatgtccgtcttttcaaaaaactctctggcttttgaaacatgagttttctgccttcaagcacagactctaagccagtgaagacttgttaatattccccaaaagccctgatgagaacctccaggtacttgtagtcagcatctgctgaccctgtacactgaaacgctgtgctctgctcagggagttacctctttaaggaaagctagttgtgtaccagctcattaaataattgagaaatgtcaggctgttttgtttgggagcagtacaaactgcatgttcagattgagggacatggcactgttgctgacagggtgcctggactagaactggatgcattattccagaaaagggcatgggagtgttctagattattttgcagcagtgtcca

SEQ ID NO: 61001 - DNA, 601 bp, Human
ttttagttatgaggacaaacctgaagcttttctcaagtttagatagatgagaaattgaggaaaagatacaaatgaactattttcctctaccttgggacctccacacccattttgacaatgcttctaacacgttcccttacagttccctggcctcatctgttctaacaactccacctccactacctaccaactacaaattcatcatcactcagccctactcctccaccaaattcctgaattctgaaattcctctctctgttcctgacttcctgtgctccttgtttctcaacctcactcattmtgctcctttgacataatctcttatctattagtcctttctgattctccctagcccagcctcccagattcccacacaccaccattctccctgactcataggtcttgctaagtcccctcttgccatccttttccaccaagaaaaaggtgctaccccaacacctggtatactttatttctattattgcattcactacctggaactatatttgttcccaagtctattttttctgagtctccttgaggactatgtattatttgattctacagatttgatatttttagtacttagcataatgcctgg

SEQ ID NO: 61002 - DNA, 601 bp, Human
ctgttctaacaactccacctccactacctaccaactacaaattcatcatcactcagccctactcctccaccaaattcctgaattctgaaattcctctctctgttcctgacttcctgtgctccttgtttctcaacctcactcattctgctcctttgacataatctcttatctattagtcctttctgattctccctagcccagcctcccagattcccacacaccaccattctccctgactcataggtcttgctaagtcccctcttgccatccttttccaccaagaaaaaggtgctaccccaasacctggtatactttatttctattattgcattcactacctggaactatatttgttcccaagtctattttttctgagtctccttgaggactatgtattatttgattctacagatttgatatttttagtacttagcataatgcctggcacaaagcaagcactgacgtttgatagatgggtgaataaagaagtgaatagtgaatggtttttctttttctttttttttttttttttttgagatggagcctgtctcactctgtcgccaggctggagtgcagtggcgctatctcggctcactgcaac

SEQ ID NO: 61003 - DNA, 601 bp, Human
aatctcttatctattagtcctttctgattctccctagcccagcctcccagattcccacacaccaccattctccctgactcataggtcttgctaagtcccctcttgccatccttttccaccaagaaaaaggtgctaccccaacacctggtatactttatttctattattgcattcactacctggaactatatttgttcccaagtctattttttctgagtctccttgaggactatgtattatttgattctacagatttgatatttttagtacttagcataatgcctggcacaaagcaagcacygacgtttgatagatgggtgaataaagaagtgaatagtgaatggtttttctttttctttttttttttttttttttgagatggagcctgtctcactctgtcgccaggctggagtgcagtggcgctatctcggctcactgcaacctccacctcccaggttcaagtgattctcctgcctcagcctcccaagtagctgggactacaggtgcacgcaaccacacccagctaatttttgtatttttagtagagatggggtttcaccatgttggccaggatggtctcgatctcttgaccttgtgatcc

SEQ ID NO: 61004 - DNA, 601 bp, Human
attatttgattctacagatttgatatttttagtacttagcataatgcctggcacaaagcaagcactgacgtttgatagatgggtgaataaagaagtgaatagtgaatggtttttctttttctttttttttttttttttttgagatggagcctgtctcactctgtcgccaggctggagtgcagtggcgctatctcggctcactgcaacctccacctcccaggttcaagtgattctcctgcctcagcctcccaagtagctgggactacaggtgcacgcaaccacacccagctaatttttgtawttttagtagagatggggtttcaccatgttggccaggatggtctcgatctcttgaccttgtgatccacccacctcagcctcccaaagtgctgggattaaaggagtgagccaccgtgcccagcctggtttttgttttgttttgtttgagagacagggtctcactctgtcacccaagctggagtgccatgctgcaatcacagcttattgcagcctcaagctcctgggctcgagtgatcctcctttccacctcagcctcccaactaactacaggcatgtaccaccaggcctggctaattttatt

SEQ ID NO: 61005 - DNA, 601 bp, Human
agagatggggtttcaccatgttggccaggatggtctcgatctcttgaccttgtgatccacccacctcagcctcccaaagtgctgggattaaaggagtgagccaccgtgcccagcctggtttttgttttgttttgtttgagagacagggtctcactctgtcacccaagctggagtgccatgctgcaatcacagcttattgcagcctcaagctcctgggctcgagtgatcctcctttccacctcagcctcccaactaactacaggcatgtaccaccaggcctggctaattttattttttgtatagatgaggtctcactgtgttgcccaggcttcactttttgacaaccatattgtaggttttcaggatctacaatgcacaaatgtgctgctatagctgtgaagactaacaaaattagggaagtcactataagcttgttaatagtagaaattaactagaatttcacacagcatgtcagatgcaaatatatatatattctatgttatggtttatgtgactcagaaatgctatgtgcaaattgtgatcactatacctcaaaaatgttataataaaatgaaggaagatcaagtaaagtaccactaaa

SEQ ID NO: 61006 - DNA, 601 bp, Human
tagatgaacgaccacctcccaggattgttgggaggaccaaggagtagcagatatgggagtgttttgtgaaccatcaagtgtgttgcaaattatactattgtaaacattaatgttccattcattctgtaaatgtttattacgtgtctactatgtgccaagcacttgttctaggttctagaaattcaacagtgaacaacataaaatccctgccctcatggagcttgcattctagcatgggagacagaaaataaacatgttaccaaacaaatacatgataaaattccaggcccaaaaaggccakgagcagaaataaggcagggtgagtatatagagtaggatggagaaagggtctttttctctgtcactgtcaggaaaggcttgttgagatgatatttgcagaggtttgaattaagtgagaaaatgagacaccggaagattggggaggaaagttctacaagaaaggagttgtgagtgcaaaggcccttaagtgggagcaggcccagctttttgaaggagcataaaggagatcagtatgacaaagtcagaatgagtgaaggatgagtagatgacaaggatggagctagattttttgtggctggag

SEQ ID NO: 61007 - DNA, 601 bp, Human
gggacacgaaatggaaagggacatgaaatggaaagggacacactaggaaatgagaagtgtgggctggggaaagaaattctgggcaatggatagagtagcttaccggccagagagcagcagggacaggcggttgatgggtgtctcaccctccacagcataggtctgttcagtggccagagttaagacctgctcctcacagcagtgaacaatctccttgtatgtctgtaggggcacctgcaagggcaggcacagcgtcttgtagaggaggtcaaactcctcagggagggtgtcctcacgcagrcggtataccaggtgtgccagctggagcaggcagaccacagccagcaggaagctccaaagaacaatgtccaggccacaggcactgaaccagccccacagcacgcagcacaggtaacctgcactcaggaagccaaaaagatagaagcatccatacaccccactgccccccatgaagcccaggagtaagaggcagttggctaggtggtagatagccccttccacatcctgcttccacctaatgcacgctgaaccctgcaagagaagctggcccactctgctgctgttggcgctcatctttggg

SEQ ID NO: 61008 - DNA, 601 bp, Human
gaactggtttcttcttggaaaatgccaagaaagaggaagcaaccccactcttagaaaaatctattttggtttgtttgacttgtcacatccttccctcaatggaaggggacacgaaatggaaagggacatgaaatggaaagggacacactaggaaatgagaagtgtgggctggggaaagaaattctgggcaatggatagagtagcttaccggccagagagcagcagggacaggcggttgatgggtgtctcaccctccacagcataggtctgttcagtggccagagttaagacctgctcctcrcagcagtgaacaatctccttgtatgtctgtaggggcacctgcaagggcaggcacagcgtcttgtagaggaggtcaaactcctcagggagggtgtcctcacgcaggcggtataccaggtgtgccagctggagcaggcagaccacagccagcaggaagctccaaagaacaatgtccaggccacaggcactgaaccagccccacagcacgcagcacaggtaacctgcactcaggaagccaaaaagatagaagcatccatacaccccactgccccccatgaagcccaggagtaagaggcagttg

SEQ ID NO: 61009 - DNA, 601 bp, Human
ctatccaggacctctgagttcaaacaaaatcaaaacatatatacatgatacttcaggttctataaatgaatacacaaacacgtattattactattagtggtagttgtagtaccattagcatcattgtcaaacttttttctccattgtgtggttggcagtattatctggatttgcttttttttttttttcttggaattggagccttctaattgccatcttaccttttctatcacattctcctggtctcaagaaagctggtggagtgggggttgtggggctcaagagccactagggcagtatmaaaaaatccacaattgcctactaagtgtgtagcacagagccccgtgatgttttctcagaagaaatcaatgcccaacattcacatccaggttgactgggcatacactgatcctgactaagaccatttctgcccatatctgactgtcagccttctccaaaagaggcggtgcttccacaaaagccttgatgagataggtgtatcacttctcttctcccattgttgggccctcagatttacagtactgtacttgacttcttagtcttcaagaacctcaatagaacaactggaaatggaaaggtg

SEQ ID NO: 61010 - DNA, 601 bp, Human
accaagggcaagcccccctctccccttcactgggaagtgatcttatacaagttcacagtaaatctatcctaactgaactatacagtaaccatacatgcttccagcaaatgggcaccctacactggagggagcacttctgctgctctcaatttcctcctttgaacagacgagctataacatcatgggtctcatgaatgagcaagttccctaaattgtctttaagcatggaactataggtgcaaacattttcacaatagttatatgtatttgtatttacatctatatctgtttacaaataatygcattggtttacactttcagttcaccaataaatgaaatgaaatgtaccctcacaaaatgtctcccctcctagctcactctatccaggacctctgagttcaaacaaaatcaaaacatatatacatgatacttcaggttctataaatgaatacacaaacacgtattattactattagtggtagttgtagtaccattagcatcattgtcaaacttttttctccattgtgtggttggcagtattatctggatttgcttttttttttttttcttggaattggagccttctaattgccatcttacc

SEQ ID NO: 61011 - DNA, 601 bp, Human
agtccccacttcctggcacaaagttcttgtctgctgctttgagatgtttggtcccttactgtaaccagcccaaggttcagtgattctcctttaaaactagagcccagtcatagactagaagccttttcctctatgtccagctcagcaaagctgagacagggtgacactgaaagataacaaaactcttactccaaaccttgaaaggcaggaaaaaaaaaaatcaaaattgtctaatttctgactcagccttttgatgctaagtataccaggaaaagctacaccaagggcaagcccccctctycccttcactgggaagtgatcttatacaagttcacagtaaatctatcctaactgaactatacagtaaccatacatgcttccagcaaatgggcaccctacactggagggagcacttctgctgctctcaatttcctcctttgaacagacgagctataacatcatgggtctcatgaatgagcaagttccctaaattgtctttaagcatggaactataggtgcaaacattttcacaatagttatatgtatttgtatttacatctatatctgtttacaaataatcgcattggtttacactttcagt

SEQ ID NO: 61012 - DNA, 601 bp, Human
acaggagctttattcaagactctgaataaatatgtatggaagggggaaaagaaggaaagaaggaagcaagaaagtaaggatgaataaatgaacaaaggaaaccaaggaacaaactcacttgtgtcaccataaaaggggatcaaaacctcactgaaaagcttccatagcaaaggaagacagcagaagagaatggcgctgctgcagcatatgtcagctccttaggcgaggatttcggccacccaggcaagccaccaaagagtgacaaccgtagagtgtagataatgtctaatgatcttcgtgsctcgctgaagccatttaaatcggaatgctgtgccctttatcatctgtttcttcttccttcttgatctactggaagatggatgatcttctcctaaatgaatagcttagatagttagttgcctgctcagggggttgtatatatggaagtttgtgttttgaattttatatgagagaaacgtctaagttaagcgctgcttaacagggtgatagactttgagaaagtcactttccctctctgagttttgaaagagattggtttcctttattaaaacaaaacaaaaagacttctgaggtttgagtg

SEQ ID NO: 61013 - DNA, 601 bp, Human
gcagacctctcgaaggagatgacatttgagctgaattttgagggatgcaaagggtattgagaagcagataaagatgagaatgaacaaagacctgggaaatccagtgtggcagtctgttctccagtatctgctttcttctcttccttaatggtgctagattttaactggacacatgactgcagagaaaaaaatcaacatttctctacttccctggctgctaggcataggcaagtgataagtcctggccaatgggatatcagcactcctgagccttgctcttaatgaatgcctaggtatacaygcgtgtatacaaattaccaaagaccagcaccaattaaaaaaacaattgcacctattatctgacaacctaaagctggaagacaggagctttattcaagactctgaataaatatgtatggaagggggaaaagaaggaaagaaggaagcaagaaagtaaggatgaataaatgaacaaaggaaaccaaggaacaaactcacttgtgtcaccataaaaggggatcaaaacctcactgaaaagcttccatagcaaaggaagacagcagaagagaatggcgctgctgcagcatatgtcagctcctta

SEQ ID NO: 61014 - DNA, 601 bp, Human
atgcagagatgggcacaatctggtctttgtctttgaggatttcacaatttagtggaagtcacaggcacataaataactggctgcaagtcaatgtgataggtgctattgtggaacagtaacagaggagagagaaagattggttctctttgggcagcagacctctcgaaggagatgacatttgagctgaattttgagggatgcaaagggtattgagaagcagataaagatgagaatgaacaaagacctgggaaatccagtgtggcagtctgttctccagtatctgctttcttctcttccttartggtgctagattttaactggacacatgactgcagagaaaaaaatcaacatttctctacttccctggctgctaggcataggcaagtgataagtcctggccaatgggatatcagcactcctgagccttgctcttaatgaatgcctaggtatacatgcgtgtatacaaattaccaaagaccagcaccaattaaaaaaacaattgcacctattatctgacaacctaaagctggaagacaggagctttattcaagactctgaataaatatgtatggaagggggaaaagaaggaaagaaggaagca

SEQ ID NO: 61015 - DNA, 601 bp, Human
catctggaagaagattagaatccagtatgggctttatccttcccccaacccgacccctgcccagaaaactcagagtttcatctttaacctctcttctaaagtgagttatatcaggcaataggggtgcctctattaggcaaagggggaagatgaaaaagatctctaaggtacaccttgttcatttgggggagatatccttccattatttctggaggtttattggctaaacaaatatttctggagcatctctcatgtttctggagatctgggaatgcagagatgggcacaatctggtctttgyctttgaggatttcacaatttagtggaagtcacaggcacataaataactggctgcaagtcaatgtgataggtgctattgtggaacagtaacagaggagagagaaagattggttctctttgggcagcagacctctcgaaggagatgacatttgagctgaattttgagggatgcaaagggtattgagaagcagataaagatgagaatgaacaaagacctgggaaatccagtgtggcagtctgttctccagtatctgctttcttctcttccttaatggtgctagattttaactggacacatgac

SEQ ID NO: 61016 - DNA, 601 bp, Human
tcttaagtcttaagtcttaagtcattaactgctcttgacttgcccatgaccacaggcttggtttcacaacttaaggggttaggagccttactattgctgcttggtgcctttgtacccttgtggctgtacctagcctagtgctctgcccctgcagggtaaaaagactgcattccatgagaacttgttagaactgatggcatgtcattgatgatgcctgaggacagggagtgtatttcagatgtgaggccacatctggaagaagattagaatccagtatgggctttatccttcccccaacccracccctgcccagaaaactcagagtttcatctttaacctctcttctaaagtgagttatatcaggcaataggggtgcctctattaggcaaagggggaagatgaaaaagatctctaaggtacaccttgttcatttgggggagatatccttccattatttctggaggtttattggctaaacaaatatttctggagcatctctcatgtttctggagatctgggaatgcagagatgggcacaatctggtctttgtctttgaggatttcacaatttagtggaagtcacaggcacataaataactggc

SEQ ID NO: 61017 - DNA, 601 bp, Human
gaatattcttaagtcttaagtcttaagtcattaactgctcttgacttgcccatgaccacaggcttggtttcacaacttaaggggttaggagccttactattgctgcttggtgcctttgtacccttgtggctgtacctagcctagtgctctgcccctgcagggtaaaaagactgcattccatgagaacttgttagaactgatggcatgtcattgatgatgcctgaggacagggagtgtatttcagatgtgaggccacatctggaagaagattagaatccagtatgggctttatccttccccsaacccgacccctgcccagaaaactcagagtttcatctttaacctctcttctaaagtgagttatatcaggcaataggggtgcctctattaggcaaagggggaagatgaaaaagatctctaaggtacaccttgttcatttgggggagatatccttccattatttctggaggtttattggctaaacaaatatttctggagcatctctcatgtttctggagatctgggaatgcagagatgggcacaatctggtctttgtctttgaggatttcacaatttagtggaagtcacaggcacataaata

SEQ ID NO: 61018 - DNA, 601 bp, Human
agaccttttttcccccttctgttggctagagtgggttactgtggctgcagccagaaatccgaattatttgctttaattttatgaatattcttaagtcttaagtcttaagtcattaactgctcttgacttgcccatgaccacaggcttggtttcacaacttaaggggttaggagccttactattgctgcttggtgcctttgtacccttgtggctgtacctagcctagtgctctgcccctgcagggtaaaaagactgcattccatgagaacttgttagaactgatggcatgtcattgatgatrcctgaggacagggagtgtatttcagatgtgaggccacatctggaagaagattagaatccagtatgggctttatccttcccccaacccgacccctgcccagaaaactcagagtttcatctttaacctctcttctaaagtgagttatatcaggcaataggggtgcctctattaggcaaagggggaagatgaaaaagatctctaaggtacaccttgttcatttgggggagatatccttccattatttctggaggtttattggctaaacaaatatttctggagcatctctcatgtttctggaga

SEQ ID NO: 61019 - DNA, 601 bp, Human
attatcaggcattattaacaaaactaacacactcctccctgaaggaactaaaaaaaatttttttttatcacgtaactcagactttgaaaagcatgggtcccaattggctatagagaaaataaacttgaaatcacataaaatgtcctagtaggacatgttcttgtttctagcactacctgaggcttaggtgcatgtctttccttgagtttcataagaaatccttgtatctttttaaataaagaccttttttcccccttctgttggctagagtgggttactgtggctgcagccagaaatccgrattatttgctttaattttatgaatattcttaagtcttaagtcttaagtcattaactgctcttgacttgcccatgaccacaggcttggtttcacaacttaaggggttaggagccttactattgctgcttggtgcctttgtacccttgtggctgtacctagcctagtgctctgcccctgcagggtaaaaagactgcattccatgagaacttgttagaactgatggcatgtcattgatgatgcctgaggacagggagtgtatttcagatgtgaggccacatctggaagaagattagaatccag

SEQ ID NO: 61020 - DNA, 601 bp, Human
ggtatggaaagatgtagtgcagaaactgcccatcctggctcacacgaaccctggcaagggaagagaagagatcatgtgggaaaaggaaaatggctctccaagccacctatgctgaagttaggtgtcgctgattaacatgaatcttcctgtagaaatactttgcctaaagcatggtaaaacccaaagctagactagccagcctaattactgcatgcaagtagttcagaaaaggaacccattgagacttccagaaccctcatttttcctcctccttctccttactggtggttctcaatttcasgctgcagagtagaagtcccagggaagcttttaaaaaaaagcacctaggcttgggccttatcccagagcaattaaacaagaatctctctaggtaggaactggatattattagtatttacatctccccagtgattctaatgtgtagccaagatagaaactactgcttaagaactctgctgctggcccggcgcagtggctcacacctgtaatcccagcactttgggaggctgaggcaggtggatcacctaaggtcaggagttcgagaccagcctggccaagagagtgaaacccccatctctac

SEQ ID NO: 61021 - DNA, 601 bp, Human
tatgaaggagggagagctggaaatgtgactagagagcactaaaaggtttaagttaccctataacaagtgtgggtttttatgttgtggcactagggtcttccagaagagtttaagcatacaagtaacatggtctacccaggggccagcatcttcctaccctacctcacctatggctaggagcccaggaactcttttcagaggaagagtgcccccgcctgtagcttcacactggcaggggtgcgaaggacagatgtaagaggggaaacatggaggcacggatattgctgggctacagtgggayggggtgaggcggtgctgccaccaggctccctgttacctggaacaccccctcctcagaaggctgtagtgattcccactcaggagagtccatgaactggtatggaaagatgtagtgcagaaactgcccatcctggctcacacgaaccctggcaagggaagagaagagatcatgtgggaaaaggaaaatggctctccaagccacctatgctgaagttaggtgtcgctgattaacatgaatcttcctgtagaaatactttgcctaaagcatggtaaaacccaaagctagactagccagcctaat

SEQ ID NO: 61022 - DNA, 601 bp, Human
gtatgagcaaaaaatatgaaggagggagagctggaaatgtgactagagagcactaaaaggtttaagttaccctataacaagtgtgggtttttatgttgtggcactagggtcttccagaagagtttaagcatacaagtaacatggtctacccaggggccagcatcttcctaccctacctcacctatggctaggagcccaggaactcttttcagaggaagagtgcccccgcctgtagcttcacactggcaggggtgcgaaggacagatgtaagaggggaaacatggaggcacggatattgctrggctacagtgggatggggtgaggcggtgctgccaccaggctccctgttacctggaacaccccctcctcagaaggctgtagtgattcccactcaggagagtccatgaactggtatggaaagatgtagtgcagaaactgcccatcctggctcacacgaaccctggcaagggaagagaagagatcatgtgggaaaaggaaaatggctctccaagccacctatgctgaagttaggtgtcgctgattaacatgaatcttcctgtagaaatactttgcctaaagcatggtaaaacccaaagctaga

SEQ ID NO: 61023 - DNA, 601 bp, Human
caatgtggtgtgtttagggaagtactagtggttcagcatggctagtatgagcaaaaaatatgaaggagggagagctggaaatgtgactagagagcactaaaaggtttaagttaccctataacaagtgtgggtttttatgttgtggcactagggtcttccagaagagtttaagcatacaagtaacatggtctacccaggggccagcatcttcctaccctacctcacctatggctaggagcccaggaactcttttcagaggaagagtgcccccgcctgtagcttcacactggcaggggtgcgraggacagatgtaagaggggaaacatggaggcacggatattgctgggctacagtgggatggggtgaggcggtgctgccaccaggctccctgttacctggaacaccccctcctcagaaggctgtagtgattcccactcaggagagtccatgaactggtatggaaagatgtagtgcagaaactgcccatcctggctcacacgaaccctggcaagggaagagaagagatcatgtgggaaaaggaaaatggctctccaagccacctatgctgaagttaggtgtcgctgattaacatgaatcttcc

SEQ ID NO: 61024 - DNA, 601 bp, Human
cgatctcctgacctcaggatccacccacctcagcctcccaaagtgctgggattacaggcgtgagccaccgcgcccggcaagcaattctttactgaacagctgctgtgctccaggtactttcctttagagtctgggaccagagagggaaaagcctagatttgtacttcagagttcactgtgcagaagacagaaaggagaccagattattagaacagacagcaagatgtgcaccagttagcataagtaaaaggactagaacaggcacacaggagtgctaggctgtggggtggaagctggtgagggctgtggggtggaagcaggcttcacagtggaagtgaggttccgtggtctcatctagaaggggaaatgcatttcagaggggagagtaggggccaaggcatagagctgcaaaacaatgtggtgtgtttagggaagtactagtggttcagcatggctagtatgagcaaaaaatatgaaggagggagagctggaaatgtgactagagagcactaaaaggtttaagttaccctataacaagtgtgggtttttatgttgtggcactagggtcttccagaagagtttaagcatacaagtaacatgg

SEQ ID NO: 61025 - DNA, 601 bp, Human
gtggcgcaatctcggctcactgcaagctccgcctcccgggttcacgccattctcctgcctcagcctcccaagtagttgggactacaggcgcccgccaccacgcccggctaattttttgtatttttagtagagacgggatttcatcgtgttagccaggatggtctcgatctcctgacctcaggatccacccacctcagcctcccaaagtgctgggattacaggcgtgagccaccgcgcccggcaagcaattctttactgaacagctgctgtgctccaggtactttcctttagagtctgggamcagagagggaaaagcctagatttgtacttcagagttcactgtgcagaagacagaaaggagaccagattattagaacagacagcaagatgtgcaccagttagcataagtaaaaggactagaacaggcacacaggagtgctaggctgtggggtggaagctggtgagggctgtggggtggaagcaggcttcacagtggaagtgaggttccgtggtctcatctagaaggggaaatgcatttcagaggggagagtaggggccaaggcatagagctgcaaaacaatgtggtgtgtttagggaagta

SEQ ID NO: 61026 - DNA, 601 bp, Human
agggtgagtgagtgtgtgtgcgcgtgtgtgcatgcgtgtgcatgtgtgtgtgtgtatgtgtgtgtgtaaactctactcttctggtgaccttcccattttaataaagaacagaaatggtagatccaggcaacttggctttgtcactttctagctgaagaccctgggcaaattacttgatgtttttgggccttagtttcctcagttgttaaatggagtaataatcatattcaacccatagagttgttatgagaatcaatgaggcaatatgatacgtagtgcctgccacatgctagccattcartaagtgagagctacaaagaaagtgaccaaagcctgagggattggcagagataagaagagtaggggccaggcagccaggaacctgcattggagcatgtatgtgaatgccccatggagtcctctgggacaccagctgcccagtggcaaaccagttcagcaattcttttttttttttttttgagacggagtctcactctgtcgcccaggctggagtgcagtggcgcaatctcggctcactgcaagctccgcctcccgggttcacgccattctcctgcctcagcctcccaagtagttgggacta

SEQ ID NO: 61027 - DNA, 601 bp, Human
tcaggactgcctctcaggctccatcatcacagagccaagtgtcagggtgggggcagaagcaggccctgccaggtagcactgcccggtgtgtgtctgttccggggttggctcatatgttggcttgagggactccctgataaaagtagtaggagacacatggaatccagtgtttccaggtccagcaaactatccaggcaggggagtccttaaaagggtgagtgagtgtgtgtgcgcgtgtgtgcatgcgtgtgcatgtgtgtgtgtgtatgtgtgtgtgtaaactctactcttctggtgaccytcccattttaataaagaacagaaatggtagatccaggcaacttggctttgtcactttctagctgaagaccctgggcaaattacttgatgtttttgggccttagtttcctcagttgttaaatggagtaataatcatattcaacccatagagttgttatgagaatcaatgaggcaatatgatacgtagtgcctgccacatgctagccattcaataagtgagagctacaaagaaagtgaccaaagcctgagggattggcagagataagaagagtaggggccaggcagccaggaacctgcattg

SEQ ID NO: 61028 - DNA, 601 bp, Human
ccgagtagctgggattataggcacctgccaccaccctggctaatttttgtattttctaatagagatggggtttcaccatgttggccaggctggtctcaaactcctgacctcataatccaactgcctcggcctcccaaagtgctggggttataggtgtgagccaccgcgcccagcctctaatgttgctttctcatgtcctgtataaaatccttccccaaaggtcctcctgaaatctgcttcttgattggttctcccatatatatagacatatctgttgtaacgttttgacaagtatttagctttttttttaatactcatctcagatgttggttgaatgaattaaatgagataacctatgtaaataggacttaggtccagtaagataggatgcaaattagaaaaacagtgatgatttctgtgtgatccctcctgtgctgtgttcttggtgactaatgagtgtcacagtgccgaacacacaatgaattctgacttaattgaattgtcgagaggtgtgctggaatgctgattgatttatattaggtacaatgtgaattataatttaggctgtcactgtggattgctctcagtcaacaaagactat

SEQ ID NO: 61029 - DNA, 601 bp, Human
tggctgtatctagacaatatatgctatggccctacatgatcttgctacctcgtcacctctccaactttctctcctgctattccctccccttcctctctccattccaggtccactgtcctcctttctgtgcatcaaacacactggccccacctcagggcctttgcactggctctttcctctgtctgatatgcttttcccagatattcacagacctcacctgtcatctctctcaggtttttgctcaaatgttatctgcttaacaaggatttccatgaccaccctatttaaaattgccaccatwtctcccttgcactactctaggttttttttttttaaactagcagtgattatcctctaacaaattatataatttacttattcattatgcctatggctttttgtctcccccattagaatgtaaattgcatgaggggagggaccttcatctgttctgttcactgatatatttcaaatccttttaacagtgcctggtatatactaagttttcaataaatattattgaagtgaataaatgaatcaagggaagacagccaatcttgtatattgcaaaacaacctaatgtcactttcttcccccaccc

SEQ ID NO: 61030 - DNA, 601 bp, Human
ctccaactcctcaccactaaagtatcccagggctccgctcttgaaccattccctcttccatccacactcactcacttggtgagctcatcctatccaatggctttaaatatcatctgcatacaaccaactcccaaatttatgtctcaggcccagatctcattcctgaatttcagacttaaatatccagttgcctatgcagcatctccattcaaatgtccacagatgatgcaaacctaacatcaaacactgaacttcctagtcccccgaaagcagctctacctgcagctttctttgtctcagytgacagcagcaccacctgtccagttgctcaggccaaaagccttagagtcttccttgatcttctctttctctcacatactatatccaaccctttagaaaatccttttggctgtatctagacaatatatgctatggccctacatgatcttgctacctcgtcacctctccaactttctctcctgctattccctccccttcctctctccattccaggtccactgtcctcctttctgtgcatcaaacacactggccccacctcagggcctttgcactggctctttcctctgtctgatatgctttt

SEQ ID NO: 61031 - DNA, 601 bp, Human
ttcatggcatccatcaatttccccttcctctttgatatatcttcttcacttggttcccaggatgccatacactccttgcccaatctcatgattgttccttttcaagctcctttgctgcttcctcctttcctctccaactcctcaccactaaagtatcccagggctccgctcttgaaccattccctcttccatccacactcactcacttggtgagctcatcctatccaatggctttaaatatcatctgcatacaaccaactcccaaatttatgtctcaggcccagatctcattcctgaattycagacttaaatatccagttgcctatgcagcatctccattcaaatgtccacagatgatgcaaacctaacatcaaacactgaacttcctagtcccccgaaagcagctctacctgcagctttctttgtctcagctgacagcagcaccacctgtccagttgctcaggccaaaagccttagagtcttccttgatcttctctttctctcacatactatatccaaccctttagaaaatccttttggctgtatctagacaatatatgctatggccctacatgatcttgctacctcgtcacctctccaa

SEQ ID NO: 61032 - DNA, 601 bp, Human
cttgtgtgcactgatatgggggggtcctgtgtcaggagccctgggatcagccattcactcactcacccatcacctcctgaagcctcagtttccacatccactttcctcaactgtaattctgtggttccgtggctaatgccactaatgactgcagaaagttctgagtcttatgattttaagatagagaaagaaggggccttcttgtgctctgaagagtggttgaaatgctgacaactattcattttaagaatgaggaagggtaagatattggggtagggacataaaaagagttggaaagttsagtttgagaaaaagcttctgatgaggtatgccaagctacatcaggatcccaagcctgggattcaggttgggatacgagcaagttacgaaattgctcgtaacttggccacttcaagtaaccaaaaggatctgatgactgaaatcagaaaaagggcatagcggaagacaaactctaaagggtagaaaatcaaagggcaccccattctccatttgtttattcatctaggaatttctgagtactcactatgtgcccatgatgcaaagctaaattacgcttgcatgggaaataagcaataacgtg

SEQ ID NO: 61033 - DNA, 601 bp, Human
tgtagctacatgaggtctcagcagtcagagtgacctgagaggggtcagaagcagacaataaaagtttaaactagaaaatttgtccatgctgagcacagagatcattcagtcacttggcaaacagctgtacttttactgaagaagctgtgtgggagtacccctctatggccttgcctggaggaggtctagtggatgactttcacttgtgtgcactgatatgggggggtcctgtgtcaggagccctgggatcagccattcactcactcacccatcacctcctgaagcctcagtttccacatcyactttcctcaactgtaattctgtggttccgtggctaatgccactaatgactgcagaaagttctgagtcttatgattttaagatagagaaagaaggggccttcttgtgctctgaagagtggttgaaatgctgacaactattcattttaagaatgaggaagggtaagatattggggtagggacataaaaagagttggaaagttcagtttgagaaaaagcttctgatgaggtatgccaagctacatcaggatcccaagcctgggattcaggttgggatacgagcaagttacgaaattgctcgt

SEQ ID NO: 61034 - DNA, 601 bp, Human
agcagagccgagaagaggcaggagatgtatcgctctttggtcagaagaagatggagacttttccggggccaggaaatgtagctacatgaggtctcagcagtcagagtgacctgagaggggtcagaagcagacaataaaagtttaaactagaaaatttgtccatgctgagcacagagatcattcagtcacttggcaaacagctgtacttttactgaagaagctgtgtgggagtacccctctatggccttgcctggaggaggtctagtggatgactttcacttgtgtgcactgatatgggggkgtcctgtgtcaggagccctgggatcagccattcactcactcacccatcacctcctgaagcctcagtttccacatccactttcctcaactgtaattctgtggttccgtggctaatgccactaatgactgcagaaagttctgagtcttatgattttaagatagagaaagaaggggccttcttgtgctctgaagagtggttgaaatgctgacaactattcattttaagaatgaggaagggtaagatattggggtagggacataaaaagagttggaaagttcagtttgagaaaaagcttctgat

SEQ ID NO: 61035 - DNA, 601 bp, Human
agtgacagagtgagaccctgtctcaagaaagaaaaggaaaaaagaacagaacatcaaactgaggcaatcaaggactgagaagaaattggagaagaaagaagagaaaaatagaaccaagaaaagagaagaaaaccaggaagaacaacatgagaaaacagagagctgctgtgagtcgaagagagagtgtataggtggatgggcaagttggaccaagagggatccataggacataaggagcatgcgtggatgcaggatgaacgagtaggaaggcgaacagctgcacagagggaaaggagtgatsagagttgtcaatgcacacttcggggaactcaacaaagtgatctggggtgttagattgatccttggaattacctcagaatgagctgaactatggttctaaggatgctggtaacacaggagattgtaaattccatatctacaaaactaaatctctaacctttcatcagtcatctctatggcctctttcatcatttatataacctgtttttcaaaatagacaaacattcactcattcatttcatgtactctggaggccttcctcactgggctagtttctcaggtaatttattggtgctttctg

SEQ ID NO: 61036 - DNA, 601 bp, Human
ggatcgcttgagcttttggaggtagagattgcagtgagccgacatcatgccactgcactccatcctgagtgacagagtgagaccctgtctcaagaaagaaaaggaaaaaagaacagaacatcaaactgaggcaatcaaggactgagaagaaattggagaagaaagaagagaaaaatagaaccaagaaaagagaagaaaaccaggaagaacaacatgagaaaacagagagctgctgtgagtcgaagagagagtgtataggtggatgggcaagttggaccaagagggatccataggacataargagcatgcgtggatgcaggatgaacgagtaggaaggcgaacagctgcacagagggaaaggagtgatcagagttgtcaatgcacacttcggggaactcaacaaagtgatctggggtgttagattgatccttggaattacctcagaatgagctgaactatggttctaaggatgctggtaacacaggagattgtaaattccatatctacaaaactaaatctctaacctttcatcagtcatctctatggcctctttcatcatttatataacctgtttttcaaaatagacaaacattcactcatt

SEQ ID NO: 61037 - DNA, 601 bp, Human
agagtcccaaggtgccagagaaattgtagtgaaatatcacagagagttcttgctgaaagacactcagatgtcctggggcttgtgtctactgtactgcggactgactactcctcttttcttcctttgaaaaacttatccttgccttctcagatcaatccaagggggttcctggggacagctggtccaacacgctcaaatgaagaaagtaaggtttagtgaggtatggtttgcaaaaagtcacatatttgattagtagcaaagccagacatagaagccaggactttggactcccagtcctggyctctttctcatttaccatgctgcctgcctcctgatgtttggaaaacattcctaaagctggggattttacaccttcacttgaatggttttctttataggcagagggaaaagtactgatctttggaagagttaggattaaaaactaataagatgggggtacagggtgtttaggaggaagaatagatacagcaaggcaaaaaaggtgggaaaaagaaaaaaggaggtaataggagagataaatatatgaacaataaaatggaagaaaacaagagacaagtgaagagggagaaatgaactgaga

SEQ ID NO: 61038 - DNA, 601 bp, Human
tgttttcaagttgttctgaaaacctctatggcctgaaaagtaaacgacataagtttcctttctctctattgcttaaacaaagaaacatgaaaaactattctccctatattgcaaattccggtattttagaaagtgagcctcatcagcagttttctcatcttgagttttagaaaaggctgaatttggaaagaggcatttcatacgatagtatgtattaagggttgagggcttggggactgagttgtgatctcctctctcataaaatatccgcactgtaggccgggcgcagtggctcacgccygtaatcccagcactttgggagcccgaggcgggcggatcaccacgtcaggagatggagaccatcctggctaacacggtgaaaccctgtctctactaaaaatagaaaaaattagccaggcacggtggcgggcgcctatagtcccagctactcgggaggctgaggcaggagaatggcggtgaacccgggaggcggagcttgcagtgagccgagatcgcgccactgcgctgcagcctgggtgacaaagcgagactccgtctcaaacaaaaaaaaaaaaaaaaagaaagaaaaagaaaaggaaaa

SEQ ID NO: 61039 - DNA, 601 bp, Human
gtgctaggtgcttacctaaatcaactcattggatcctcacaacaaccctgtgaggtgggtttcataacccccactgtttaccgatgaggctcacagaggctatgtaacttgcccaagattctgcagctggtaaaggacggaatctgtgcctctgcactaccaatgcctgctcctgaaggaaggtttgtgagggtgaatttctcaaagtcacttcaggtccttactgtagcgacagtgttggcaccttctgtgtcctctctcaccttgcctgtgagccttccagtgggtgggaaaagaggcrtgcctatcagtggccattctgtgaacacagaagagagctgcgctggccacagagaagatagtccaatgatccttaaagttcaggcgtgtgggttggagccaaaggggcctgtcccctggatataacttgagagtagctctggagaggaattctagaagctgtggaaagaaaaagagggaggattttagcactatgtctctggacagtttgtctaacttcaaagggttcttttcagtttttttctttcctttaccaattcccaatgttttaactgtactcactgcctgacatgataggggc

SEQ ID NO: 61040 - DNA, 601 bp, Human
aaaataaccttaggccttatgactgccatcctatgtgcaatcggagtaaaatatgttagacaaattttgattgtttatttttatttatttatttattttgagagagagtcttgctctgtcgcccaggctggagtgcagtgatgcgatcttggctcactggaaccttcgcctcccagcttcaagcaattctgctgcctcagcctcccaagtagctgggattacaggtgtgcaccaccatgtccggctgattttttttgtatttttagtagagacgggggtttcaccatgttggccaggctgstctcgaacccctgacctcaggtgatccacccgcctcggcctcccaaagtgctgggattacaggcatgagccactgcacctggccttaatgttttaaaaagcagccagggccgggcagggtggctcatgcctgtaatcccagcactttgggaggctgacgcaggcagatcacttggggtcaggagttcaagaccagcctggtcaacatggcgaattcccgtttttactaaaaatacaaaaaattagctgggtgtggtggtgaatgcctgtaatcccagctacttgcaaggctgaggcagga

SEQ ID NO: 61041 - DNA, 601 bp, Human
ctctctcaaaagtcagtttccacacctgaagcagaggctggtgaacaacacgtggtacttcccacccctgtaatggcttcgtatgtgctgccttcaggacaccaggtggaacgggaccctgaaatccatcccaggaatcactaacttccatagtctcaaatcatgtgtttaagctactccactaatgagaagtgatgtacctgccctacttcatccacagaggggcgtggcttgccatctagcagctccatggctgtttccttaactcgcccccgtgaggctacctattgttaagcagtayaagacaggtctcttaaatatgttttgattaaacatgtacgatgtatgtgtctgtctttaaacacttgaaactgcaacagaaattccaggtcctttttttatttttaaacctttgtacattttctttcagagttgttagaatcagatgtcacctgacttgcctattcagtgcctaatcatttgggccagcttttggggaggtggggtggggtagggaggaaaaaaacaggaatttagggcatttcagtaattattgcacagttttcacgtttgaaagtgaacctcaaaccattcgatcttt

SEQ ID NO: 61042 - DNA, 601 bp, Human
ccaggctggagtgcagtggcatgatctcgactcgctgcaagctccgcctcatgccattctcctgcctcagcctcccaagtagctgggactacaggcgcccgccaccatgcccgactaatatttttgtatttttagtagagacagcgtttcaccatgttagccaggatggtctcgatctcctgatcttgtgatccacccacctcagtctcccaaagtgctgggattacaggcgtgagccactgcacctggccgaatctttattgttaaaaactggtttgaccaattttctgtacatttgatyttcattatggggatgacgatcttacggtatgaatagtcctcccttccttccttccctggaccctcccctgaccaatcttgctgaaactgaatttgaattgattagcttcaattcaataacagagactaaagagagacatggaatttcaaatactgagctttgtttggcctcctagagaggaaataaagtttcctatgtcacaatattattctcccctataaccactgggagaaacagcaggccacccctaagcatacaggggaaactcactcctcccaaatctctgcatcccagaagtta

SEQ ID NO: 61043 - DNA, 601 bp, Human
acttacagcatccacaggtgcacatgggccatagcctagagcagggacccagcaggagagcaaacaggtcctccatccatcctggggaactacaagggggactctcagaatcaggcccaagcaggttgttgccctaatcttcccttgggaagccagtgtgtcggccacattgccgaggcctggatactcactggatgatcccgagaccattgtctaggatgtgcctagatcctaaatgtgctctcccatgaggctgtggggaagctaagggcccaagatttggacatccaggtgggctcargcctggcagtcctgagtggtcagacccctcctagcccccaggttcaggggttcatctaagcattgaaggactggtgggagctggggggcatccttatctcatgaccccccatgacatggaaagaagacccaagagcaggcccggttgcatgtgtgaggggcctgcaggtatgtggtgcgtatgtgtctatgcaggtgtatctgcttgagtcttgtgcagttacggttgtgtttctgcatcgtccctggtgtcccagagcaaggccagacatgttgctagggccctgttccttgcattttc

SEQ ID NO: 61044 - DNA, 601 bp, Human
gttcaggggttcatctaagcattgaaggactggtgggagctggggggcatccttatctcatgaccccccatgacatggaaagaagacccaagagcaggcccggttgcatgtgtgaggggcctgcaggtatgtggtgcgtatgtgtctatgcaggtgtatctgcttgagtcttgtgcagttacggttgtgtttctgcatcgtccctggtgtcccagagcaaggccagacatgttgctagggccctgttccttgcattttcagaggttcagagtcaagaagaggttctctgggggaggagatmccactgcttgggccagtgtggggtttgcccctgcttggagtgagggtatcctgtgcacattgccggtggctggaggggtcaccctgagaccctggagggaatcctgggtttcctctccatttatctgtctctgagtacgcagtgagagtgagggctggctctactggggctggtgctgaggctggggctgcagcctgactccagcagtgcaaacctcactgctccctctccctacagcagaccatactcctgcaggggtgtgtgtgtttgtgtgcacgcacgtgtgtttgtggtgtgacg

SEQ ID NO: 61045 - DNA, 601 bp, Human
ccagagcttctagcccaggccacgttccactctgctctgctcctgcatgctccagtgtacgcagtccaggccatgcactgctgtggggggatggggcggtggcatgtgtaaggtgcctccagcccacctgcctgcgcagagagtacttgctctgaactgagctgggaaatctggtcggatctcagctatgggtttttcccaggtgggaagtggggccttggctcttagccattccctggggaggcaggtgggggttgggatggaaaggaggctgctggtggtggggggtctgggccttgcytcctctgctccctgttttccagcattttccagtgtcttggcaacctgatttgctcattcggtgaactggggtggggtcgtgaaggggacggcaggcaggtatttcccatcttccttccagtttcccaggcttgaagcggcagcagctcccactgttctcccaggcgctgtctgtagcaggagttggccctgagggagagcaggccagaccagtgcagccccccggactcctccctggctggcaccccctggccagcctccttcctcttcctgctctcactccaacccctgcagcagagac

SEQ ID NO: 61046 - DNA, 601 bp, Human
ggtcaggctgaagtctgtggtgggccttggtttgcccctacgtaaaatgggctggcggggtgaggaagggattgatggcagcttgtcttcggggagccagctgggagtggctgggatgggagtcatggggttgaactggagggttactttgaggcccccacagaggaagaaagagaaccactccttgcagcatgacagttactgtgaatgtctgtggttacacagagctgctttgcaaattttagtttgtgtatggaacccatgggcttattgagtgaatttgttatgcatctcaggccgyccaggcctttgtgtggcctgcctctgaaggaaggtggagaaagacagcagcaaatccccattcttaagaggccctgtgtcttgtagggagatgagaccatggtttgtgaggcaattagaagactccagaatagtgctgtctaatagaacttctgcatgatggtaacattttataactttagtatctgagactagtgatacgtaggtactgggcacttgaaatgaggttggtgcatgaggaaccgatacttaacttttttttttttttttgagacagactttcgctcttgttgcccaggct

SEQ ID NO: 61047 - DNA, 601 bp, Human
ggaacccatgggcttattgagtgaatttgttatgcatctcaggccgcccaggcctttgtgtggcctgcctctgaaggaaggtggagaaagacagcagcaaatccccattcttaagaggccctgtgtcttgtagggagatgagaccatggtttgtgaggcaattagaagactccagaatagtgctgtctaatagaacttctgcatgatggtaacattttataactttagtatctgagactagtgatacgtaggtactgggcacttgaaatgaggttggtgcatgaggaaccgatacttaacttttttttttttttttgagacagactttcgctcttgttgcccaggctggagtgcaatggcgcgatcttggctcgctacagccttcgtctcccgggttcaagtgattctcctgcctcagcctcctgagtagttgcgattacaggcatgcaccaccttgcccagctaattttgtatttttagtagagatggggtttctccatgttaggctggtctcgaactcccgacctcaggtgatccgcctgcctcggcctcccaaagtgctgggattacaggcatgagccacagcacctgaccttatttt

SEQ ID NO: 61048 - DNA, 601 bp, Human
ctagtgatacgtaggtactgggcacttgaaatgaggttggtgcatgaggaaccgatacttaacttttttttttttttttgagacagactttcgctcttgttgcccaggctggagtgcaatggcgcgatcttggctcgctacagccttcgtctcccgggttcaagtgattctcctgcctcagcctcctgagtagttgcgattacaggcatgcaccaccttgcccagctaattttgtatttttagtagagatggggtttctccatgttaggctggtctcgaactcccgacctcaggtgatcckcctgcctcggcctcccaaagtgctgggattacaggcatgagccacagcacctgaccttattttttattttttgttaacttggatttaaatagccacatatgactagtggctaccatattggacagcacaacctgagagggagggcagaatgggacagccccaccccgtagccaggacagggagggacctgcacaggctcagagcaggggtcatggaaagtttcctagaggagtggggacttcagttgggccttgaagaatagacaggggagggaggaggcactgtgggctgcagaagaat

SEQ ID NO: 61049 - DNA, 601 bp, Human
gggctgcagaagaatgtacctagagctacagggagtttccatgtgtggagggctggggacaggataccagcccagctggctggaagagtcagggtgtaaaagagccttcattgccatgctaaagtagttgataggacggagtcacggagagtttttgagcaggggagagagcctgtctaaagaggcatatctggtgagaggagggcaggagagatggagtgactggcaggaaaggggttgtggggacaggagattatgagctgagaagagcactttggtccagcaccttccagcagcctgrcctcaggtcttaggagacctcaaatctcctttctgcctgggtcccactgagggggctgagggagctagccaggactccagagtcctagctctcagtcttaagaacaagggagggggtgactggcctgatgccccctaatgtaaggcgagggtaaagtgagatctttggactgggacagaggttcacgtggctatggaagggaatttgaccccctgcatcttagggtactcatctcttagaggatgctccccagggagaggcagcacagcctgggtaagaacggaccctgctgccagatca

SEQ ID NO: 61050 - DNA, 601 bp, Human
gtggctcacgcccataatccccgcactttgggaggccgaggcgggcagatcatttgaggtcagtagtttgagaccagcctggccaacatggtgaaaccccgtctctactaaaactacaaaaaaattagctgggcgttgtggcgcacgcctgtaatcccagctactcgggaggctaagacaggagaatcacttgaaccggggaggcggaggttacagtgagccgagatcgcaccactgcactccagcctgggcaacagagtgagaatccatctaaaaaaataataagataaataaatatgcrtgggaagctattctggggagagctgggaataggcccctgggattggagggggccaaaggggctgggtagcagaggcttggtgccatcgggtcaaaggatccataggatgcatgtgttgtgtagagggaagcatgggtcagggttggagccacagtccctctgatactcccacccaaatgtccctgcagaagatgctcatgaagcagcaggaccggctggaggagcgagagcaggacattgaggaccagctgtacaaactcgagtcagacaagcgcctggtggaggtagctaagcccaagg

SEQ ID NO: 61051 - DNA, 601 bp, Human
gaagatgctcatgaagcagcaggaccggctggaggagcgagagcaggacattgaggaccagctgtacaaactcgagtcagacaagcgcctggtggaggtagctaagcccaaggccatgctgcggggtgggggtggcttgagcgcagggctttgggtgagttccttactaaggattgattgtgtagccctatgccagaaccactccatcagtcattcaatcaactgcccgtggatgcccactggtgccaggggatgctggcccagagccctgtgctaccagtggggaactggcaggtcagamcttgcccttgggagcctggggcagcctggtgacttagggttctaggatgtgagaagggtaagagggggggaaaccaaaggtttccagtgcttacctgcctgcccactcctgccctctgtactcgcaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaa

SEQ ID NO: 61052 - DNA, 601 bp, Human
cagtgcttacctgcctgcccactcctgccctctgtactcgcaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaaggtgggctgggctcaggaccaggctgtggcacccagagggccatttccaaattgagatctgcagtttcctgcacctgtagctcacatgcccttacctttggagccagcatgcatgggttcaaatccacctgcctgctctttctagcactgtgaccttgggcaagtcataggtacatcccgggccttgttccctcacctacgaagtggtgttgatgatacaggtctactattctttatccacaattccacatttataaacatctctggaaactaaacaaattttggcatctaatttaacagcaaaaattgacctaaactgatgtta

SEQ ID NO: 61053 - DNA, 601 bp, Human
ccaggctttgccacttgtagctgtgggacagtgggtaagcaacatgacctccccagcctccatttcttcagcttaaagtggggatataactattctgtacctcctaatggtagaggagcaagcatcacctgagatgtaacattcttgggcctctaggtgtcaatggtccccaggtccaacccagggagaggaggcctgggttgcttggggtgggagctttggcgacttttgccccaactctccacaggccccttcagcacgccggtgcccttcctgcagagtgtccccctgtacccttgcrgcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtct

SEQ ID NO: 61054 - DNA, 601 bp, Human
gacagctccgcagagtgcgggcgcagggtctgacagtgccctctagaagggctctcccaccccatcccctccccttagagacaagtcctccttcaaaagtcactgcctccgagagaagataccccttcacaccgccccaggcccctcggcaggcttcctcagcacccgccccgcagtcaggccctctaacctgacccggtccaggcccgggcggctcacccctccggcccgacccctcccccgcgcggccgcccctccgcgtcagacaatggggcccgactcccggccgccagcctctccygacccatcaccctcgcctcaccccagccgatgccccgacttctgccccaaccctcctcgacccctttaagatcccccaagctggcccacggacccagccgaccggtgctctcctgaactcactattcgggattcatgctggacatgtcactgcagctgccgccgccgccaccgccgcccttgctgccgcagccgccgccctgactctccgcgccacgggtaatcgaaagaaaggaatgagataggctgttccgggagagcaaacgtcttcccctactccgtcccctagaacacaatcagc

SEQ ID NO: 61055 - DNA, 601 bp, Human
ttcagaaaatttcctgaacagtagaggtctataaacctcgataaagcagtaaatccatgttctttattgttaccaagaaaactactaaattaagaacctcaagttcacctccgttcaactgtgcaaaaccaactttgtccttggagcccttgaaaaaaaaatttttttaaactgtcaacacagcaaatgtcactacaagaacactaccctcaacttctaaagcatgaaattctaataaaatactacggtttctgtttagtgcaaaagatttcagcttcaagccacactattacaaaacttktaagcattttgcaagagccatgtgacacacatatgacagtcagctaaactggtgggtggaccttttaggggaaaatgtctagcagtaattgaccaaaccagcaaataaactcaacttttacaacaaatactgattttcccccatccctcaaaggcctttgacactgaaaaggaataccaattcggtctcttccaattattcattactttacatgcatgtaaactgtagaggaaatttttaaagggccattgaggagagcccaacaaactctacccaagggaagtgaacaccagttcccag

SEQ ID NO: 61056 - DNA, 601 bp, Human
gccatgatatacttaaggggatgggggctaaaaataaggtaaatactttaaactttttctgcattaaagaattatagttgatctaagtagactactatatttcttcctactatagttagctggtatactgaagacaggtagacatgctttattcttaacacattccttaaagatgaaccaatcaaaattattttcttgacactaaaaaaatccactggaagccagtggattatgaaaaatgttatgagaataatcacgagaataatgttaagtatttctttctttttttttttttttttttgaggagtctcactctgtccctcaggctggagtgcagtggcatgatctggactcactgcagcctccgcctcccaggttcaagtgactctcctgcctcaggttcctgagtagctggaattacaggcgtgcaccaccacacccagctaatttttgtatttttagtagaggcagtgtctcatcatgttggccaggctggtcatgacctcaaatgatccgcccacctcggcctcccaaagtgctgagattacaggcgtgagccactgcgcctggccatgttaagcatttcttaatgtgctgaaat

SEQ ID NO: 61057 - DNA, 601 bp, Human
ggtcaggagtttgaggccagcctggccaacatagtgaaaccctgtctctactaaaactacaaaaattagccgggtgtggtggcacacacctgtactcccagctacttgagaggctgaggtggaagaatcacttaaacctggaaggcggaggttgcagtgagccgagatcacgccaacgcactccagtgacaaagtgagactctgtctcaaaaagaaaaaaaaagaagccaagtagagaactggcaaggaagatttgattttgaagcacttccatctttaagacaacgttaaaaaaaaaaaactaaactaaaatatttgatggttaaaaactgtctaacatccctcattttaacttaatttgattaaagggggaaatttttattttttatttttttgagacagaatctcactctgtcacccaggctggagtgcagtggccaatcttggctcacggcaacctctttttcccagattcaagcgattctcttgtctcagcctcctcagtagcttgggactacaagcgcacaccaccacgcctagctaatttggtgtttttagtagaggcagggtttcaccacattggccaggccggtctagaact

SEQ ID NO: 61058 - DNA, 601 bp, Human
ctcagaaagcaaaattccctttaaaagccaagtagaagccaggcgcgtggctcacacaagtaatcccagcaatttggctgaggtgggtggatcacgaggtcaggagtttgaggccagcctggccaacatagtgaaaccctgtctctactaaaactacaaaaattagccgggtgtggtggcacacacctgtactcccagctacttgagaggctgaggtggaagaatcacttaaacctggaaggcggaggttgcagtgagccgagatcacgccaacgcactccagtgacaaagtgagactctrtctcaaaaagaaaaaaaaagaagccaagtagagaactggcaaggaagatttgattttgaagcacttccatctttaagacaacgttaaaaaaaaaaaactaaactaaaatatttgatggttaaaaactgtctaacatccctcattttaacttaatttgattaaagggggaaatttttattttttatttttttgagacagaatctcactctgtcacccaggctggagtgcagtggccaatcttggctcacggcaacctctttttcccagattcaagcgattctcttgtctcagcctcctcag

SEQ ID NO: 61059 - DNA, 601 bp, Human
gggaacagtggctcacacctgtaatcccagcactttgggaggccgaggcgggaggatcacaagatcaggagtttgagaccagcctggccaataaggtgaaactccgtctttactataaatacaaaaaattagctgggcgtggtggcgcagcctgtaatcccagcaacttcagaggctgaggcaggagaatcacttgaacctgggaggtggaggttgcagtgagccaagatcacaccactacactccagcctgggggacaaagcgacaccttgtctcaaaaaaaaaaaaaaaaaaaaaaaaactcaaatgagtttgggataccagatttaaagctaagctttgtcactctcagattttcacattttaatattgataatgatagttaacattctcttttctgttttcaatctcctaaatcaagtattcttaatctgaggttcatgaacagccttggtgtgaactgcctataactttatgcaaaatgttatatgagtatatagacacaaagggagcagatgcatcaaatgtaacgtgagtatggctacacgaccataaatgggttaaatgtaacagtcccaaatcaagataccagaaaatatct

SEQ ID NO: 61060 - DNA, 601 bp, Human
aactccacattttaaaactcaaattaggccgggaacagtggctcacacctgtaatcccagcactttgggaggccgaggcgggaggatcacaagatcaggagtttgagaccagcctggccaataaggtgaaactccgtctttactataaatacaaaaaattagctgggcgtggtggcgcagcctgtaatcccagcaacttcagaggctgaggcaggagaatcacttgaacctgggaggtggaggttgcagtgagccaagatcacaccactacactccagcctgggggacaaagcgacacctygtctcaaaaaaaaaaaaaaaaaaaaaaaaactcaaatgagtttgggataccagatttaaagctaagctttgtcactctcagattttcacattttaatattgataatgatagttaacattctcttttctgttttcaatctcctaaatcaagtattcttaatctgaggttcatgaacagccttggtgtgaactgcctataactttatgcaaaatgttatatgagtatatagacacaaagggagcagatgcatcaaatgtaacgtgagtatggctacacgaccataaatgggttaaatgtaac

SEQ ID NO: 61061 - DNA, 601 bp, Human
taaagcactacataattatccacattatatatttcacaaaattgtttcaaatggccttttataaatttagctatttgactatttttataaatttcatctaacccactttaagactaacatcttaaactccacattttaaaactcaaattaggccgggaacagtggctcacacctgtaatcccagcactttgggaggccgaggcgggaggatcacaagatcaggagtttgagaccagcctggccaataaggtgaaactccgtctttactataaatacaaaaaattagctgggcgtggtggcrcagcctgtaatcccagcaacttcagaggctgaggcaggagaatcacttgaacctgggaggtggaggttgcagtgagccaagatcacaccactacactccagcctgggggacaaagcgacaccttgtctcaaaaaaaaaaaaaaaaaaaaaaaaactcaaatgagtttgggataccagatttaaagctaagctttgtcactctcagattttcacattttaatattgataatgatagttaacattctcttttctgttttcaatctcctaaatcaagtattcttaatctgaggttcatgaaca

SEQ ID NO: 61062 - DNA, 601 bp, Human
taaccaccaatctacacataaagcactacataattatccacattatatatttcacaaaattgtttcaaatggccttttataaatttagctatttgactatttttataaatttcatctaacccactttaagactaacatcttaaactccacattttaaaactcaaattaggccgggaacagtggctcacacctgtaatcccagcactttgggaggccgaggcgggaggatcacaagatcaggagtttgagaccagcctggccaataaggtgaaactccgtctttactataaatacaaaaaaytagctgggcgtggtggcgcagcctgtaatcccagcaacttcagaggctgaggcaggagaatcacttgaacctgggaggtggaggttgcagtgagccaagatcacaccactacactccagcctgggggacaaagcgacaccttgtctcaaaaaaaaaaaaaaaaaaaaaaaaactcaaatgagtttgggataccagatttaaagctaagctttgtcactctcagattttcacattttaatattgataatgatagttaacattctcttttctgttttcaatctcctaaatcaagtattctta

SEQ ID NO: 61063 - DNA, 601 bp, Human
aaaacaaaaaaacaaaaacaaaaaaaaacaaaaaaaccctatcagaatgaatcaaatcatatataaactagcacccagaacctgaccaaatacaaagaaaagtgtgattcactgcttaaattaaattagaacacttgtgttagtagagaataagctcagcctggcgcagtggctcacagctgtaatcctagcactttgggaggctaaggtaggaggactgcttgagccaaggagccagagacaagcctgggtaacatggggagatcctgtctctacaaaaaaaaaaaaaaaaaaaaaaaaattaattaattaaaaaataaaaataaaaaagagagtaagttagctcggctcaaaaaagcctggtgaagatgcctaatttggagttcagatttcactagctttagtaagtaagaaatccaactgctcttcatcaggcagatgctaaccaccaatctacacataaagcactacataattatccacattatatatttcacaaaattgtttcaaatggccttttataaatttagctatttgactatttttataaatttcatctaacccactttaagactaacatcttaaactccacattttaaaa

SEQ ID NO: 61064 - DNA, 601 bp, Human
cagcctcccaaagtgctgggattacaggcatgagccaccacatcaggcctccaaccatgaattcgtaaagtaactgaccacaaaatgttagtgcctaattacttgactaaaattttaaattcttttttttgtgtgtgagataggctctcactctgtcacctaggctagagtgcagtgatgcaatgtgggctcactgcaacctccacctcccaggctcaaacgatcctcctacttcagcctcctgagtagctgggaccacaggcgcgtgccaccacgtccagctagttttttttttttttttggtagagatgaggttttaccatgttgcccaggttggtctcaaactcctgagctcaagtgatttacccacctcagcctccgaaagtgctgagattacaggagtgagccaccacaaccagcctaaaatgttaaattcttagaagtaagcacatgtagtaaagcagaaacagcctatttgttgtagtgggacatccaagcctttgagttaaaattccaattcagttgcttactttgaatgcccttgggcaagtcatttaactcttctctgcctctgtttccttgtttgtaaaactagggcatt

SEQ ID NO: 61065 - DNA, 601 bp, Human
tcccaaagcctagcaatgcataaaacagtaacatgctctgcagcaagtgtgccctctacagcaagagaaggcagccctctgcttcatttgcttttcatagaaagacatccatgacctctaagtctccaagtttaaatatatagcaagacagaaaaactgagaatggatacaattaatttcaacccaagatgtgaagggtaaagttaaaagcccatttataaataatacatacctcacaaacccttcttaaatccttcccccacccccacccaccaccaccacagagacagggtcttgctakgtcacccaggctgaagtgcagtggtgcaatcacagttcacggcagcctccaacttctgggctcaagcaaccctcttgcctcagcctcttgagtagctgggaccacaagcacaccaaccacacctggctattttttatttttagttttttagagacagggtcttcatatgctgcccaggtctcaaactcctggcctcaggcaatcctcccacctcagcctcccaagtggttgggactacaggtgcacactaccatgcccagctaatttttaaattttttgcagaaaggggatcttactagg

SEQ ID NO: 61066 - DNA, 601 bp, Human
gtacaaagtagaggatgaatcagcttgtttctgaatctaaaatgctactggaaattctaaaacctccaaaataacactgttatgtgaaaggaatatagaattttttaaagtataacctcatttttgttttttaaaaaatcttttgaggggctgggcatggctagctcatctcagcactctgagaggctggagcaggaagtctaaactgtaggactataatggattgacggtttcttctttatacctttttaacaacctgcagtaagcttgtatgacttttataaccagaaataaaaaatgytatttgaaaggaggagaaaagcgttttattcaatgacttaacacccttacaaatatgttcagcatatgtcagcacagcacacctatcataacacaaattacttctaagtaggtagagtaggtcaggttgtaaacagacagcaatggcatactcccaatacagccacaagtatatgaagttaaattctgggttaaatgagaatatactgttttcttctttcatgaaataaaatttagattctcagacaaggttcacatgtcaatgaacactttacaaaagaaagctgattgacattaaccc

SEQ ID NO: 61067 - DNA, 601 bp, Human
gaatttggatcactaagtttttatcctacaataatataattttgacttaagtgaaaaaaactaaattacgctagtttagaaaccaataaaaatttggctgggcgcggtggctcacacctgtaatcccagcactttgggaggccaaggtgggtggattacctgaggtcaggagttcaagaccagcctgaccaacatggtgaaaccccgtctctactaaaaaaaaaaatacaaaaattagctcagcatggtggcagatgcctgtaatcccagctacttgggtggctaaggcaggagaatcacytggacccaggaggcggaggttgcagtgaggagagactgcgccattgcactccagcctgggcaacagagcgagactccatctcaaaaaaaaaaaaagagaaaggaaaaaaaagaaacctatgaagatttacaattgtcaccctcgtaaattattctagtaaatcctatccactgtttccagttcagaacttcctctagctttttgtagttctaatctactataacctcatattttctaccctcgagaagtttggggtctgtgtttctccacccttacgtttgacatagctatctgtgggtg

SEQ ID NO: 61068 - DNA, 601 bp, Human
gcggaggttgcagtgagtcaagatcacatcattgtacttcagcctggacaataagggcgaaactccatctcaaaaaaacaaataaaaaaattatttatgagtttctaataatttaaggcttaaattaaagccattataaataatatgaagaattgagtgctctgtataagacaatctttgcaaaagactactggttctctcgcaaaccatttgtttactaacatgacaacagtcacatgagaaaggcaaataaaatcaaacccacaaacttccccacctccccttatcaaagacacacacytgaatagcgtgatcagtgacacgttaacttgcattgggacattttaaattacctactacagaagtagtttatttctcaactgtaaatatactgaatattcgtgagaattcattgttctgagtttgctttaaaacgtttttataatttacaaaacaccacacagtaaaaatgttgatagaaaatatacaaatataaaattacagagcacaaggacagaattttggtacaaagagccaagactaatttagcaaatggtaagactttaaatgtatttattcttcattcctcatgaatttggat

SEQ ID NO: 61069 - DNA, 601 bp, Human
agagcaaaactccatctcaaaaaaaaaaaaaaagaaagaaagaaagaaacatgaaggtttcctaattgcactacaagttacattatggtttcaagaaattaatagtcaattctttttaaattacctttttcaaccactacatttttttaagttttacaaatataacactcttattttaacgcattatggctgggcacagtggctcagtgagcctgtaatcccagcactctgggaggccgaagcaggtggatcacctgaggttgggagttcgagaccagcctggccaacatggtgcaatccygtctttactaaaaatacaaaattagccaggcatggtagcgcatgcctgtaatcccagctacttgggaggcaaaggcaggagaatcacttgaacccgagaggcggaggttgcagtgagtcaagatcacatcattgtacttcagcctggacaataagggcgaaactccatctcaaaaaaacaaataaaaaaattatttatgagtttctaataatttaaggcttaaattaaagccattataaataatatgaagaattgagtgctctgtataagacaatctttgcaaaagactactggttctct

SEQ ID NO: 61070 - DNA, 601 bp, Human
tgatccactgcgtcacctggctctgctttttctttttattctactaaagtttaatttaaagatttattttcatcaagtcgctttcaacacaggccaccaactacccctttaacttgctgcctatattggaactgctgtttgactctgaccaaaagtattagacattctgactttataaccagacttcactgaatttcttttaagagcaacaatatttttctatttaacagtccaagataccactggggatgtatatttggagtctttaaatatataaattctggaagaattaacttattckgaataaaactgtttaattttatctacctagaaaacatacatagcattaattgtaccattaattgtaaagacatttcaatttcaacttactgcaaacctaagaagaaggcaagactttccaacccctgagtcgccaatcagaagtaacttgaataaataatcactgcaaaaagaaaaagaaaatgatgttaataaaaagcacactgcattgctataagctatacaaaaacaaaaacacagctacaaataacaactcactgtgaagactacatctcctataaagcccatgcatggcttaagc

SEQ ID NO: 61071 - DNA, 601 bp, Human
atttggagcttagcgctgccttgatgtgtaccaagccagcagcaattttacccacatgcttttgtaccagagccaatgtcatcactgaaaaacgcaaacatcttttatattagtattattaccaagtaaatatttccttacaaatactaacatcttagtattattaggatattttgacctcatgggctacctgagagggtcttggtaacccccaggagtctttggtccatgctctgagaaacaatgatctctagaagggaaacatgctaatttgtttttttattttttttcttttttttttgagacagtcttgctctgttgccaggctggagtgcagtggcaccatctcagctcactgcaacctccgcctcctgggttcaagcgattctcctgcctcagcctcccgagtagctgggactacaggcgtgtggcaccacacccagctgattttttgtatttttagtagagacggggtttcaccgtgttagccaggatggtctcaatctcttgaccttgtgatccgcccgtctcggcctcccaaagtgctgggattacaggcgtgagccaccgcacctggccaggaaacatgctaaatttaaag

SEQ ID NO: 61072 - DNA, 601 bp, Human
gaaatgctgaattcttgtaaatctctaaatgacctttactcccatgcctgagccgttactattcgtctgcccaaaagcctcagttatctctctctgcataaccctacttactccccagccccaaggtcatgtggcatttattcatccttcagttttgagctcaggcaatactgagtgtccaaacaatttcttcaactcctcagccaatagattcttccctctgtgcccccagagcttattgcacatttctttattatagtcctcacgattgtctctattaatattttgagggtatggggaycagcattttaaaaatagtttccaggtattattggaaaacctttgacttcaagcaatggacatcccagagagggttttccttgaggcacaaacacctgaggctacagctagattcttcccacctaccgagagttgcttaagaattatgcttaattttaatatttgccaatttaataaaaattaaatgacacctaagtttaacttaaaggcctttaattacaaataaagttgagcctttttttttttccatatttattggcaatttgtattacttccttttttttttttttttttttttttg

SEQ ID NO: 61073 - DNA, 601 bp, Human
ggtcaggagtttgagatcagcctggccaagatggtgaaacctcatctctattaaaaatacaaaaaattagctggacgtggtggcgggcgcctgtaatcccagctacccgggaggctgaggaaggagaatcacttgaacccgggaggtgaaggttgcagtgagccgagactgtgccactgcactccagcccaggcgacaaggcatgtctctgtctcaaaaaaaaaaaaaaaaaaaaaaagttatgttgtaattgagtgcctaataagtatcaggtactatagaagtatatagaggccaggcrcagtggctcacatatgtaatcccagcactttgggaggccaaggtgggaggctcactttagatcaggagttcaagaccagcctggccaacatggtgaaaccctgtctctactaaaaatacaaaaaattagtgggtgtgatggcacacgcctgtaaacctagctagtcaggagaccaagatggagaatcgcttgaacccatgaggtggaggctgcagtgagccgagattgcacgactgcactccagcctgggcgacagagcgagactccatctcaaaccaaaaaaaaaaaaaaaaatgcaga

SEQ ID NO: 61074 - DNA, 601 bp, Human
agccgagtcaggcagatcacgaggtcaggagttcgagaccagcctaaccaacatggtgaaactctgtctctactaaaaatacaaaaaattagcagggtgtggtggcgcacgcctgtaatcccagctactcaggaggctgaggcaagagaactgcttgaacctgggaggcggaggctgcagcgagccaagattgcaccactgcactccagcctgggcgacaaagcaaggctccatctcaaaaaaaaaaaaattgtccgggcatggtggtacacacatataatcccagctattagggaggctraggcaggagaatcacttgaacccaggaggcggaggttgcagtgagctcaaatcgcgccactgcactccagcctgggagacagagcaatactgtatctcaaaaaataaaaaaacaaacaaacaaaatgttcaaaatgaggccttcaggcatggaaaagaaattcctattaaagatgaaagacagacaaagatgaaagacagtgtcctataagatcccttccagccacaggaaagtaacaaaatatgaatgtttcacacacgaatacacacccaaatcttataaacaccaatgatcacacat

SEQ ID NO: 61075 - DNA, 601 bp, Human
gcctgtaatcccagcactttgggaagccgagtcaggcagatcacgaggtcaggagttcgagaccagcctaaccaacatggtgaaactctgtctctactaaaaatacaaaaaattagcagggtgtggtggcgcacgcctgtaatcccagctactcaggaggctgaggcaagagaactgcttgaacctgggaggcggaggctgcagcgagccaagattgcaccactgcactccagcctgggcgacaaagcaaggctccatctcaaaaaaaaaaaaattgtccgggcatggtggtacacacatrtaatcccagctattagggaggctaaggcaggagaatcacttgaacccaggaggcggaggttgcagtgagctcaaatcgcgccactgcactccagcctgggagacagagcaatactgtatctcaaaaaataaaaaaacaaacaaacaaaatgttcaaaatgaggccttcaggcatggaaaagaaattcctattaaagatgaaagacagacaaagatgaaagacagtgtcctataagatcccttccagccacaggaaagtaacaaaatatgaatgtttcacacacgaatacacacccaaatc

SEQ ID NO: 61076 - DNA, 601 bp, Human
caatataaagaattaacatgtctctaaaagaatcatgtagtgagctgaccgctgcactctagcgagggagacaaagtgaaatttttgtctcagaaaaaagaaaaaaagaagaatcactaggaataaataaaaaaaataactggcaactagaggttttgtggttttttttgtttttttctgtatgttttgcaaagatgaggtttcgccatgttgctcaggctggtcttagacctcctgagctcaggcaatctgcccaccttggcctcccaaagtgctaggactataagcgtgaaccacgacrcccggacagccactgcgcccagccttattttgtttttgagacagggtctctcactctgtccccaaagctggggtgcaatggtgcaatcttgcctcactgcagccttgaagtcctgggctcaaacattcctcccacctcagtctcctggggagctaggactacaggcatggaccaccacacctggttacttttttttttttttttttggtagagatagagtctctatgttgaccaggctggtcacaggagctatgttgactcctggcctcaagtgactctctgacctcggcctcccaaagt

SEQ ID NO: 61077 - DNA, 601 bp, Human
taccaggccatattcctgttaatacttaacaccaagaacacagtataagccaagcaactcacgattccctacaaactcttgcctatatgttagagtcttggctatttgatcaaagttatttagttgacaataaatacaaccagaatcccttgaaagcaaacgtaaaactaattactaatcttttatttattacaggaaaacaaatgtcttttaagtgattcacatttatatttgagagtggacaaagttttctgccataaaattaatactgatggcttatatatgaagtagtaaatgaatstgacattaatcaaataatggcttcctacttggtcactgtaacacaatctcctcttggaacttacctgatctgtcacatcatacacaactatgatgccatgggctcctctgtaataactggaggtgattgttcgaaatctttcctggcctgctgtgtcccactattacaaaacaatcaagaaatccaaacaattccattaaaataaagttggggaaaagtgtaggagggaggggaaatagtttagttttcataactgtggagattatcaggatgtgatatagaaacattagtcctcaactc

SEQ ID NO: 61078 - DNA, 601 bp, Human
cttttggcaattctgatggacaagttctaattaccaggccatattcctgttaatacttaacaccaagaacacagtataagccaagcaactcacgattccctacaaactcttgcctatatgttagagtcttggctatttgatcaaagttatttagttgacaataaatacaaccagaatcccttgaaagcaaacgtaaaactaattactaatcttttatttattacaggaaaacaaatgtcttttaagtgattcacatttatatttgagagtggacaaagttttctgccataaaattaatacygatggcttatatatgaagtagtaaatgaatctgacattaatcaaataatggcttcctacttggtcactgtaacacaatctcctcttggaacttacctgatctgtcacatcatacacaactatgatgccatgggctcctctgtaataactggaggtgattgttcgaaatctttcctggcctgctgtgtcccactattacaaaacaatcaagaaatccaaacaattccattaaaataaagttggggaaaagtgtaggagggaggggaaatagtttagttttcataactgtggagattatcag

SEQ ID NO: 61079 - DNA, 601 bp, Human
gtgagaaaaggatggaggcaaattttagcagcaacctccacctgactgcttgactggagtgctctgaattttaacattggacttctcagcaccaccagctgttgctccgggacccattcgctttttaatctcagctgccatcgtcatgaaagactgttctacattcgttgcattcttagcactggtttccaaaaacggaattccaagggaatcagcaaattcctaagagaataatgaggcacaattaacactgaaaaatctttttcactaattcttactgcatttctaccatccataatgragcgtgaggaactaagttcattggatccaaacagatgctacacaaattgtcactgtcacagtattctagtgcacatatttttaaaaggctgtggccttactgttactgcagaacccatacataattcaacaccttcaaattcagtatgaaaattaaactttaaacataccttcgctgttgtgtagtctactactttctttgtggtcagatcacatttgttccctaccaacaatttgttgacattttcactggcataacgatctatttcctgcagccactgtttaacattattgaaggact

SEQ ID NO: 61080 - DNA, 601 bp, Human
cctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgsatttatgaaatgttgatcaatgaagctatttcaaatggttttagagaaggatcagagataacgggctagatagcatacattctaaacttgttttacatatagtttgagctccctgaaccactgaagttggttaaatccctacacagcacagaagcccctctaggtcatgttattgggcatattatctagaaagcaaatactggatgctgctctaagataggtctagaataccttagtttgcattgtgcacacacaaatggctgtgttgaatataatgcaaggctctatttccctttaacc

SEQ ID NO: 61081 - DNA, 601 bp, Human
atttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaamcccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctt

SEQ ID NO: 61082 - DNA, 601 bp, Human
gaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcrtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcc

SEQ ID NO: 61083 - DNA, 601 bp, Human
tgaactgaaattgaacacctgcttgcgtaaacctagtcggctcgagttgttctggttctggattggtcagtctagagttccaggggtgtggccaaaagtctgtgaggcggggccgtaggcagcctaaatcaggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatggtgagtctccctgggcccgtgcagtyatctgccgcgtatccgagccatccgtggtccctgggtcccagtacttgagctataggcacgcgaagcccggttgctcttctctggccgtttctgtcagaggatggttgtcgaggggctcggggctgttggcagggcgtccgggctggcgggctgcgctgtagacccggacacgctgggcttcgggctccagcgcctgggcagtgcaggagctgttgcgcttgttgacttcgtggagcacggtggatgggggtagggggcgggcgggatagatggacactgggaggcacatctcgtctgca

SEQ ID NO: 61084 - DNA, 601 bp, Human
ggttgttaaattaacaaataatcaagtgttctgtgaacttttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacytaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgttt

SEQ ID NO: 61085 - DNA, 601 bp, Human
acagtcaccagggtagctttagagggaaagccctagtggagccttcaggtcggccacacattgacagcaggggtctgtttgtgttgactggcccgtatcccagggagcccttagtatttcttcttcattctcagtttcttctggaaaatagggacacccttcctgcttccatttggttccagggtgggtcttgcagcttcgagggtagaggctggctgggatggggcttcagccttccctccccacaccctcatgcctctccctgggcctcagtttcccaaccccgaatggaggagctggyctggcttctaccttagacacactctcttgtccctgaatttctgatgctttgggcccagctgtgggagcactgccagctgtgtccacagaagtaggccaagatagcattgtcatctcttctgacagattaggaaaccaaggccacctcctccagccttgggttcaggaaacggctcccagaaatgatagagctgcctcccatgggggttggcaataatgggaatggaatgtccacgtgcttcttccttagcctccttggccactgtgggggtgggtgggtgctgagagacacccaccttca

SEQ ID NO: 61086 - DNA, 601 bp, Human
tcccagaaatgatagagctgcctcccatgggggttggcaataatgggaatggaatgtccacgtgcttcttccttagcctccttggccactgtgggggtgggtgggtgctgagagacacccaccttcacctgcctctccaatgaccatcctcttttgtccttcttctcccccaacagctgaaggcagatgtcgtcccaaagacagctggtaagacagggcctggggccttctgagatgggtctagagggaagggggccaggcagggcaaggtgggtggcgtgatgagaagagtcggggctcrgagacccctgacagatgggagctccatgtgtggctcagccattgggtgctctggggcagccctgccatccctctctgggcctcaacgttggctctgccctcctctctcatagtagctgggagcctcagagccagtggaaggcacatgtaaatttcccggagacttccccactcctggtgcccagtgaggcagggtgatgggcacacagcccttgagtccgtgccctgctggccagcacagccatgagcctgtactcttgtcacagtgctcaggtactgaggacagggaaggggagtgact

SEQ ID NO: 61087 - DNA, 601 bp, Human
gtgtgtgaagatgcctggtatgaggaaggtgctgagcagagcagctgcagttgctctgtcagccaggctgccctccctgcattagccctgtatccaggcttcactgcacatggaagcccagccccaacccgctgccactccaggccagtggcaggccctgcccgggggactgggaggtggagtctatcaagagagagctgggttgggagatggatgtgctgggggtggccttgaagactttgaagagccagcatattccagtggtctctgaccttgtcccctgtgtgcccctgagcactgstgtgggagataagagagggagagagagaagtggaggaggcggaggaggaagacaggtccagggcaggaacacacacgccaggacttggggcttcccttcccagagaaaggcattattctcggtgaaatgaatgtttttcggtcatgtgtcatgctcagttttcacaagcattggtattgctgtgtcagaggtttgggggtaggtgttgtagcaggagcttcctgtgggtcaggacccaggtggtgttggggctggtcttctattagcacagaccttcaagatcagggattgggtgtcctg

SEQ ID NO: 61088 - DNA, 601 bp, Human
catgtgtcatgctcagttttcacaagcattggtattgctgtgtcagaggtttgggggtaggtgttgtagcaggagcttcctgtgggtcaggacccaggtggtgttggggctggtcttctattagcacagaccttcaagatcagggattgggtgtcctgggcaggcagagcctggaggcaggggcatggctgtcatgacctctttgaagaccttcctgcctggaattctctccccattccctccaccctgacccagtggccgtcatcgtaccgtggtaagtggcagcgggttgggactggaygtctatgtgcggcgaagcctggatacggggtgaacacagggacggcaggcctggcccagccctaaggctgatggtaaagtaggagctgaggtggaagtcctgagccagggtgggaactccagcgcgggagggctccctggcacaaggcggtggcaccgggagtccagaccagagtcctgagtcatccgttgggagggatatcaattagggagcacctaattgacacctgtggatgcttcagctgggctggtcagttcccctctcttacccacggatcccatctcaggaaaacagcagcca

SEQ ID NO: 61089 - DNA, 601 bp, Human
tggtcttctattagcacagaccttcaagatcagggattgggtgtcctgggcaggcagagcctggaggcaggggcatggctgtcatgacctctttgaagaccttcctgcctggaattctctccccattccctccaccctgacccagtggccgtcatcgtaccgtggtaagtggcagcgggttgggactggacgtctatgtgcggcgaagcctggatacggggtgaacacagggacggcaggcctggcccagccctaaggctgatggtaaagtaggagctgaggtggaagtcctgagccaggstgggaactccagcgcgggagggctccctggcacaaggcggtggcaccgggagtccagaccagagtcctgagtcatccgttgggagggatatcaattagggagcacctaattgacacctgtggatgcttcagctgggctggtcagttcccctctcttacccacggatcccatctcaggaaaacagcagccagccatggcctgggctgggcagcgctaggcataggggctgctaccaggctcttctggccatgggtgccccatgcaggtttggccacggctgcctgggccttagctgaggcc

SEQ ID NO: 61090 - DNA, 601 bp, Human
ttgggcagactctgtcctgggtctgcaagggttgggaaagctgctgggctgggtaaggggcagtgcgcggacagtgaggggactcggcctggggagctggtctggaccagctgctggtactcccacagactagactcgggaactggggggcctctggcctcttccttgttgccctccaggaggagtgggttaaattctgggtcactaagtatcatctcagaatggcctttaggtcttttgaagattacttaaaaatttgctcagacaaaaagtaagtcatttggaaacaaaggtagttackgtgacaaaagatatttaagttttgtcttttttttttttgcttattattcttattattagctcttattttattggatgtttattgacccctttacctgaggggcgccaactgggtgggcttgggtgggctgaggctgctgccagcgccagggccgtggcccccgcctgctccatggtagccactcagaaggtgctttgtgctcacaggcgggcgacttcaccaaccacaatggcacaggcgggaagtccatctacggaagccgctttcctgacgagaactttacactgaagcacgtggggc

SEQ ID NO: 61091 - DNA, 601 bp, Human
gaccagctgctggtactcccacagactagactcgggaactggggggcctctggcctcttccttgttgccctccaggaggagtgggttaaattctgggtcactaagtatcatctcagaatggcctttaggtcttttgaagattacttaaaaatttgctcagacaaaaagtaagtcatttggaaacaaaggtagttacggtgacaaaagatatttaagttttgtcttttttttttttgcttattattcttattattagctcttattttattggatgtttattgacccctttacctgaggggcrccaactgggtgggcttgggtgggctgaggctgctgccagcgccagggccgtggcccccgcctgctccatggtagccactcagaaggtgctttgtgctcacaggcgggcgacttcaccaaccacaatggcacaggcgggaagtccatctacggaagccgctttcctgacgagaactttacactgaagcacgtggggccaggtgagtgggggcctcctctagggtgagtgtccccacagctctgacctggcctggaagccccagcaggccctgagaggccacatgcagtcaccgtccagtat

SEQ ID NO: 61092 - DNA, 601 bp, Human
gaaaccctgtctctactaaaaatacaaaaaattagccaggcgtggttgcgggcgcctgtagtcccagctactcgggaggctgaggcaggagaatggtgtgaacctgggaggcggagcttgcagtgagccgagactgtgccactgcactccagcctgggcaacagagtgagactccatctcaaaaaaaaaaaaaaaaaaaaaaactgaaagtgaaataaagattttttaaatgaagacagtgtttaccactaacagattcccactggacaaacatctgaaggatgtatgtatctatgcaatraaaaaggaaggaataaaatgcaaggaaaaatagtgaaaaagcaaacagtagacatacatgggtaaaatgaaataatcactaacaatacaaaacaataaacatattttaattgtgttggggtctcactctgttgcccaggctagctaagaactcctgggctcaagccattctcccgcctgctcctcctgcctcagcctccagagtagttgggatgacagggcaagccaccatgcccagctacaaaataataattatcaattagaattgttcaacttagagatggattgactttgggaatga

SEQ ID NO: 61093 - DNA, 601 bp, Human
caaaataacaaacaggctgggtgcaatggctcacgcctgtaatcccagcactttgggaggctgaggcgggtggatcacctgaggtcaggagttcgagaccagcctgggcaacatggtcaaaccctgtctctactaaaaatacaaaaattagctggttgcagtggcacgtgcctgtaatcccagctacttgggaggctgagacaggagaatcacttgagcccgagaggcggaggttgcagtgagccaagactgcgcaattgccctccagcctgggcgacagagtgagactccatctcaaaaaaaataaataaataaataaataaataaaataaaaataatatacaatacaaaaaacagaccagataacctgaagcccttcctactaaatatgcctagaagtgctcagaaaaatataataaacatccttttagactgtgccagctattaaggtattgtctctcagctccaaatctaccctgttatgctccgctttgtgatgctggggcctggactccactaaaccccatttcacatttgccagctggatccctgtcaacagggggtgctaaggggaaaacagaagacaagagaaggctacaag

SEQ ID NO: 61094 - DNA, 601 bp, Human
taatcccagcattttgggaggccgaggcgggcggatcacgaggtcaggagaatcgagactgtcctggccaacatggtgaaaccccatctctactaaaaatacaaaaattagctggccgtggtggcgtgtgcctgtaatcccagctactcaggaggctgaggcaggagatcacttgaaccaaggagttggaggctgcagtgagccgagatcgtgccactgcactccagcctggcgacagagcaagactgtctaaaaaaatttaaaaaattaaaaattagccaggcacagtgctgtgtgcctrtagttccagctacttgggaggctgaggcaggaggaccccttgaaccaaggagttcgaggttgcagtgagctatgatcacaccacggcactccaaaatctgggtgatagagcaagaccctgtctcaaaacaaaaaaagaaaagcttctcagtggggattagttatggtctaattggccacagccagagcatggctatgttacagtgtgtggctcattttcaaataactttatatgcagtataggtctggtatataatcccaaaggaaagagcccaaaacactcaaatgaagtcaaaagact

SEQ ID NO: 61095 - DNA, 601 bp, Human
gtgagcacagctagctactttgtcacactcctaaccctggcaagtgcagacaggcccaggagctctccaaacaattggaaaggagaaggaatacattatcactgtgaaataatataatacggaggtatctagagtaaaatgtaaaactccctcttcattaagcctcaacccacatttgccagtgacactccccagctcagaagtgaccactgttagaagtctgttgtacaaccttttggatttttcctaagcatgtacacatacaggtatatattcacatacaggtatgtgtgtttggtcyacatatctgtaatcataccatataatatgttctgcaacttgcccttttcacgtacaaatttatttgacatgtttccataccagcaaaaaacagattcctcacatttttaattaattttttttgagacaaagtctcactctgtcacccaggctggagtgcagtggcaccatcatggctcactgcaacctcaaccacctgggctcaggtgatcctcccacctcagcctcctggtagctgggactaaaggtgcacaccaccatacccagctaatttatttgtagagatgggatttcaccatgt

SEQ ID NO: 61096 - DNA, 601 bp, Human
tctccctcttctctccctcccctttaaggatggcgcaggaaagggaggtgaggggggagaatccaccccaccccctcgtccatgtttgaacaaaaacccagagaaagagtgagggagaaaaagtctcggtgcgggggggccttaccagactcctaaagccaaacgtatctacaggttttaatccgccattagcatttaaatcttgaaaggagaggaggaagggggggccagtggaaagtaaccccacacacaaaagaaaagttgttggttttcttctcagtctgcctggcaggagcgatcktcctggctgacagccagaagtgcgtcacagccaggagtctgctttctttaaaggcacagcaagcttccccgatctgggagcgacagcaagcaggggactctcagtgggggtggggcccagagggagggggtgcactggagaggaggggctgcaaaggggaaggctggaggcttggtccacgaacaagaaaagcaggacgaatgggggcggcgggttgagggtgaaggcacaagcaggcaggcaaaattactgaactccaacagcagcaagagccaaggcaaactgtggcataaacacaca

SEQ ID NO: 61097 - DNA, 601 bp, Human
gtttggtccatctaaagggactagcttgggctgaagcctcctcttcacacagaccactccatctttgtagcctagagtttggcacagaaccccaaagccctggagaggaacaagggagggattacagaggaaaccaagcttctctggtttcttcaaaagtggcttacagatgtctgccccttctccccgttctctggagggtccagatcaggatgatggcaaaagagctgcaatcaggaaccagacctgcaaccaggcctgcagccatgtattgtactggggcgcgtacacatacacacayacacacacacacacacacacacacacacacacacacacacactgacctgggccccccaccactatattcacacaccctggtccctatcagctgacaaaatgaaccttttttcactgcccaccaccgtgcacacacccacggcctcacgcagaaatggtgaagccctctcctgagctgtctctacagctcaacgtgcaggcaaacacgctttccttctctgaacaaaaacatgctgacatctacgcaagggggaaagaaagcaaccctttgctctgaaaggcgccaactcccggatgttgg

SEQ ID NO: 61098 - DNA, 601 bp, Human
gttcaaatgggggattgagaatatccaaacttaggtctctggatgaggtcgagcccaattccggaggagatcccatgggacatttaatgaaaattacgcacctgtcctggtgttctcatccccaatttcctttcccattgagattctgccacctgcctgccaacccacccaagagaccacagaccagattaactaaatattcaccaacacctcctagcaacccttgcaattttcactaatctccaggggcacaatgagccctgcccccatctcctgccacacgtgctcagtctgtaattaytctagaaggaggaacaagagtggtaagagccacatcacttgtaagtctccccatatattagcatctccagagtgtgggctctgtggaaccagtctcatgtatgcaagttggggataaagaaagacaccattcttgcccagaaggtgctcactgtctagtaagggaaagagatacgaaaatctgaaaattcactccccattatctcttggtccttcctatccaagtatactctatttatcagccaaccgaaaggtattttcttagttcctaaatatgatcatcctcgctgggagcagtggc

SEQ ID NO: 61099 - DNA, 601 bp, Human
aaacatgagagtgaggaccaggctcaccacataactcaagagttgcctttaaggattgcaaggttgcttaaggttgtcaaatcttaaaataccctgtaacagtttattcattattaactgctgtttacagaatagtttcaagctataatttaagtattaataaaataaaccactaatttatttttatgttataaattactgaaaattcagaagacaaaaaacagagctcccaataattctagtattttaatacaggtacttttagcattttgatgtatttctttcgttttttctaggtaattttttttaaactgtagttggaattatcatgtgtgtgtatgtgtatgttctatgccactcttctcactaacataacagatgcattatttcatgctactacagtttcataaaatttgctttagctccacaacttttgtttaaattgaaaacattctctatactatatttatatatatttttaagagacaggctcttgctatgttataggttggagtgcagcagctatttacagatgcaatcatggctaactgcaacctcaaactcccgggctcaagcaattctcccatctcagcttcccaag

SEQ ID NO: 61100 - DNA, 601 bp, Human
caatgagctatgatagtgtccctgcactgtggcctgggcaacagagacatctcaaaaaaaaaaagaaaaaagaaaaactaataaacataaagcactattatggttaataaaattaaaataatgaagtagacataacatttgtatttcttaatagttaagttagctgcatgcactatagaattaagaggatttttaaaaatcaatgatttctctacagacatgatagtatttatttgagttaaatactttcacatttaaaaacaacttttaggccaggcgcagtggcccatgcctgtaatcmcagcacttggggaggctgaggtggaaggactgcttgaggccaggagttcaagaccagcctgggcaacataaggagaccctggctctacaaaataataatttaaaaaaatttttagctgggtgaggtggcttgcgcctgtatgctcacgtagtccctgctactcgggaggctgacgtgggaagatcgcttgagcctgggaggtcaaggctacagcgagctatgatcacaccactgcactctagcctggccaacggattgagaccctgtctcaaaaaaataaataaataaataaatacaaca

SEQ ID NO: 61101 - DNA, 601 bp, Human
acttcaaataaaaaccactttagcagcagacccatctgtcctgggccacttggccccgctagaccttgctgatagagaacaccaactcatctcttcactcaacaaacattcactaaaacctaaacaatgtagcatcctaagctaggtagggaggaccccaagatgaatcagacacagttctagcctttgataagcttaattctaccttctttccctatcaatgagctgttacctatgaacaggtagctaaagtgcttgcttcagagatatgagtccctgataccagttcctaactgccacrtatggcacataaacaccttcaacacttcagtctatccttggcctggggcaaacaatctaatgtgctttttcttaaaaaaaaaaaaaaaaaaaaaaaaaaaagatgacaactgacctatgcttggtcccagaaaggtaggatactgggaggaagccccactttattcatttccgagataactgtgacgttcaaaggaaatgtgctaaagacacagaccaaaaggccaaactacaatccttgctgcatggtaacaacaagcttattaaatgctcatggacctcagaaatcaagttaattgaa

SEQ ID NO: 61102 - DNA, 601 bp, Human
gaggaagatgagtggtgacaagccaagaactcaggccaggctgcccagggtcaaaccccagctctaccactggggaaccttgggcaagtgactgcccctctatgccccagattcatctgttaaaggagacagaataaacctacctcagagggttgttgggggacaaatcaggtataattgtcatgagtgctttatgtctagcacaaaataagtaaatgtaagtgtttaataaaaacatttttccagtcttaacttctatactagctattagaataatctttttaagatgcaaattaaccaygtactcttcagtttcaaattcttccaaggttcctttttttttctcctaaacctttcaattacagccaccaaggtttcctcaatgcctttaggatcaagtcttaatagccggtctccaatgggccttcctggcctcacatctcagcttagtcaggctctttcacagcctctgttcacactgctcttctcgtcaacctggcacacacacctatggatgctttcaagactcagcaggagcgatagcttccacgaagcctttcttgaccacttgctttttattccaactgtgccctaaatagat

SEQ ID NO: 61103 - DNA, 601 bp, Human; identical to SEQ ID NO: 61092

SEQ ID NO: 61104 - DNA, 601 bp, Human; identical to SEQ ID NO: 61093

SEQ ID NO: 61105 - DNA, 601 bp, Human; identical to SEQ ID NO: 61094

SEQ ID NO: 61106 - DNA, 601 bp, Human; identical to SEQ ID NO: 61095

SEQ ID NO: 61107 - DNA, 601 bp, Human; identical to SEQ ID NO: 61096

SEQ ID NO: 61108 - DNA, 601 bp, Human; identical to SEQ ID NO: 61097

SEQ ID NO: 61109 - DNA, 601 bp, Human; identical to SEQ ID NO: 61098

SEQ ID NO: 61110 - DNA, 601 bp, Human; identical to SEQ ID NO: 61099

SEQ ID NO: 61111 - DNA, 601 bp, Human; identical to SEQ ID NO: 61100

SEQ ID NO: 61112 - DNA, 601 bp, Human; identical to SEQ ID NO: 61101

SEQ ID NO: 61113 - DNA, 601 bp, Human; identical to SEQ ID NO: 61102

SEQ ID NO: 61114 - DNA, 601 bp, Human
gccatagtttaggatgaagaatacagaatggaaaatgaaggattaggatgaaacctgggactccttcgagcattgtccagggaaaggagaatagtctgaaagggaaacagatggaccaataggagaagtaggaggagctctgtatcccagaagccaaaggggaagaatgaaggaagagaatgcttcaaaaacaagagagtataacactctggaatgcagctaaaaggtcagagaagacgaaaactgaaaagaatccattcgattcagtgaccatgacaagatctattcgatgaaagtgggytgagaattgagtggatggtcacagagagcagtgttttgttgtttctaatgaaatttacccatattttaaaacctaatgggatggatccaaaagatccttgatggcgatttatttaattttccactttatttttatgcttggggtccatcccatgtaagaacagaagccacagcccccagaaccaacaaaactaaagttattgacaattactttaaggcccagtgccaaagctttgggtcgaaaggtttccaactgccataggaaagcaaagataaggagaaatcctctgtaggaagctag

SEQ ID NO: 61115 - DNA, 601 bp, Human
ttagccgggcgtggtggcacatgcctgtaatcccagctacttgggaggctgaggcaggagaactgcttgaacctgggaggcggaggttgcaatgggccgagatcccgccattgcactccagcctgggccacaagagtgaaactccgactcaaagaaaaaaaagtacatacagatctggattggatctcagaagcaaggtcttctgagctgtaaattcacaagtcatctgaatatagatggtaactgaagccatagtttaggatgaagaatacagaatggaaaatgaaggattaggatgaarcctgggactccttcgagcattgtccagggaaaggagaatagtctgaaagggaaacagatggaccaataggagaagtaggaggagctctgtatcccagaagccaaaggggaagaatgaaggaagagaatgcttcaaaaacaagagagtataacactctggaatgcagctaaaaggtcagagaagacgaaaactgaaaagaatccattcgattcagtgaccatgacaagatctattcgatgaaagtgggctgagaattgagtggatggtcacagagagcagtgttttgttgtttctaatgaa

SEQ ID NO: 61116 - DNA, 601 bp, Human
gtgacagattggatattgggggtgggggtggggtgtgagtaagcaaaaaaaagggttaccagatatactaggcttctggctggtataacagattgtcttgtataacagacagaagactaggtttgaggagaaagggcatgagttctactttggacaaactgaggtggctttgaggagaccaagtggaggaaaagcttcccaggggaatggtaactaaatattgaaatattaatatatagatctggggtcaggcgcggtagctcacgtctgtaatctcaacactttgggaggccggggcagstggatcacttgaggtcaggagatcgagaccatcctggctaacatggtgaaaccccgtctctactaaaaatacaaaattagggccgggcgcggtggctcacgcctgtaatcccagcactttgggaggccgaggcaggtggatcacgaggtcaggagatcgagaccatcctggctaacacggtgaaaccccgtctgtactaaaaatacaaaaacaaaattagccgggtgtggtggcgggagcctgtagtcccagctactcgggaggctgaggcgggagaacgaacggcgtgaaccagggagg

SEQ ID NO: 61117 - DNA, 601 bp, Human
aaaggacactctctccaataaatggtgctgggaaaaccagatagctatatgcagaataaaaccagaccccgggccgggcacagtggctcacgcctgtaatcccagcactttgggaggccgaggcgggcggatcatgaggtcaggagttcgagaccagcctggctaacatggtgaaaccccgtctctactaaaaatacaaaaattagctgggcgtggtggcaagcgtctgtaatcccagctactcgggaggctgaggcaggagaatcgcttgaacccgggaggctgaggttgcagtgagccragattgcaccactgcactctagcctggcgacagagcgagactccatctcaaaaacaaaaacaaaaaaacaaaaacaaacagaccccaactctcagcatatacaaaaatcaaatcaaaatggattaaagacttaaatgtaagatctgaaactatacaaccactagaagaaaacactgggcaattgcttcaggacattggtctgggcaaagatttttttgagtaagacctcaaaagcacagacaactaaagcaaaatagacaaatgagatcatatcaagctaaaaagcttctgagaggaaag

SEQ ID NO: 61118 - DNA, 601 bp, Human
gtgagtcagtgaatgcatggtaagtgaatgtgaaggcctaggacattactgtacactactgtaaactttataaacactgtacacttgggctacactaaacatattttttcttcaataatttcagcttaatgtatttaaaactttgactcttttgtaataacacagcttaaaacaaaaacacattgtacagctgtgcaaaaatattttatatccttgttctatacctttttctatttttaattttaatttttatttttatttatttatttactgttgagacggagtctcactctgtcaaccrggctgcagtgcattggtgcaatctcggctcactgcaacctccaccttctgggttcaagtgattctcctgcctcagccttccaagtagctgtgactacaggtatgcgccaccacatctggctaatttttacatgtttagtagagatggggtttcaacatgttggccaggctggtctctttctaactcctaacctcaagtaatccgcccaccttggcctcccaaagtgctgggattacaggtgtgagccaccatgcctggcccaattttcttaatttttaaattttgttaaaaactaagaca

SEQ ID NO: 61119 - DNA, 601 bp, Human
tgtagggcacttaccatgaaaggagcttgcaggattggaagttgctctgggtgagtcagtgaatgcatggtaagtgaatgtgaaggcctaggacattactgtacactactgtaaactttataaacactgtacacttgggctacactaaacatattttttcttcaataatttcagcttaatgtatttaaaactttgactcttttgtaataacacagcttaaaacaaaaacacattgtacagctgtgcaaaaatattttatatccttgttctatacctttttctatttttaattttaattttwatttttatttatttatttactgttgagacggagtctcactctgtcaaccaggctgcagtgcattggtgcaatctcggctcactgcaacctccaccttctgggttcaagtgattctcctgcctcagccttccaagtagctgtgactacaggtatgcgccaccacatctggctaatttttacatgtttagtagagatggggtttcaacatgttggccaggctggtctctttctaactcctaacctcaagtaatccgcccaccttggcctcccaaagtgctgggattacaggtgtgagccacc

SEQ ID NO: 61120 - DNA, 601 bp, Human
ggctacaaacctgtatggcatgttactgtaatgaatgctgcaggcaactgtaacacaatggtatttgtgtatttaaagatatgtaggccaggtgggatagctcatgcctgtaatcccagcactttgggagaccaagaggagaggatcacttgagcccaggagttcgagaccagcctgggcaaaacagtgagaccctgcctctatatttaaaatacaaataataataattttagaaagacatctaaacatagaaaaggtacagtaaaaatatagtagaaaagacttaagatggtatgtctgkgtagggcacttaccatgaaaggagcttgcaggattggaagttgctctgggtgagtcagtgaatgcatggtaagtgaatgtgaaggcctaggacattactgtacactactgtaaactttataaacactgtacacttgggctacactaaacatattttttcttcaataatttcagcttaatgtatttaaaactttgactcttttgtaataacacagcttaaaacaaaaacacattgtacagctgtgcaaaaatattttatatccttgttctatacctttttctatttttaattttaattttt

SEQ ID NO: 61121 - DNA, 601 bp, Human
agtgttcattaacaaaccaagcacaaaaattattaatggatcaaaatttgagtgagctacacatctaaaatagtaccttttaatgatgagaagagcatttctataatatactttaaaacttgggatataaactcacctttcacccatgatataggagagaatagtaaatagtttatgtttttgttcctcttcacatcttagaagttgttaaaattcttagttcaccacagcagtctaatttaataaatccgagaggtttgtgattcaaaaagaaaaaccttttgtgattgctacatttcartatgaagtgtctaagatgcatttttgtataaacaaagtatctaattgcctcccattatctttagcgaatagacataatcttccagtgaaaatggctgaggtggggatatgactcactgccagtgtctgtgcttcctcagccctcacagggaagcagtcagccatctccaatgccatctcctcacgctggattatatgcatgcttcccaaaattttgaactgttaacatgatttataaaaactgtcttggcagacaagctaaaacctactttaactggaaatgtgacagagtcaagactct

SEQ ID NO: 61122 - DNA, 601 bp, Human
aagttctctctgtgccccaatttccttatgtataaaatgggaataatattgcctaccccatcgtgctactgtgaggatcaaatgaggtaacacatgtaaaaactcactgtttagcacaaagtaagccatcagcagtatttgttactcagaacatcagtcggcttaagcatcgcttcacccattcatgctcccatctcctggcattggtcaagttcctatgccaagtgctctcactgagctgtgtttttgtttatcatcacatttctcaatctcacaacacatttctatttcatgtgattckatctgctaggctgtaagttccatgaaggcaggaactatacctggttttgctcatcctgcattcccagcgttcagtgaagtgcgtagtacttgatgatcaatgaaattgtagtaaaattcctactaatttttttaataatagtatttagtactaatacaagttgaattgtgccattcgccaaaaaagatatgttgaagtcctaaaccccaggtatctttagcatgtgactttatttggaagtagggttgttgcagatgtaattagctaaactaacacaggcatactggagtaaagtggacc

SEQ ID NO: 61123 - DNA, 601 bp, Human
gcaaaactccatctcaaaaaataaataaataaccaggttacaaagactagatgaagtagcaacatgtgtcaggttaaaattcattacaagggttgactatggccagaatgaactttaaagacatcagataaaggagctggccctaatgccattaatattgatcttttaaaagtttaaaataaatctaattgccttgaaaactccatttaattttaactctggtacaggtaactatgaatgttagtgtatgccttttattgaaaaacacttagaccataatctctaaaccagcatggacacrttctgcaaaaaacaaacaacccaaaaaaactcaaaatgaatttccttctaggttcaactcaaaagctactttctccataacatctggactttcctgtctctccaccagaagcacccagcttccctctgactacacagaacccctttactccttgaaggccaagatcaggccaacaatcatctttgtttcccctttaacagtgactactcatagagaccatctacagttccacttttcacagtttcagttacccttggtcaaacatggtctgaaaatactaaatgaaaaactccagaaata

SEQ ID NO: 61124 - DNA, 601 bp, Human
actgcctctcccttcagaacagacccagaatagtcaagtgactcacctacctaagttcataaaccagttagcatattactagcccaggctagctgttcttcccattacagcagcacaaagctttgttgacatactagttttttttttttttgagatggagtctcactctgtcgcccaggctggagtgcagtggcatgatctccgctcactgcaagctctgcctcccgggttcacaccattcacctgcctcagcctcccgagtagctgggactacaggcgcccacaaccacgcccggctaatttttttttttttttttgtatttttagtagagacagggtttcagcgtgttagccaagatggtctcgatctcctgacctggtgatctgcccacctcagcctcccaaagtgctgggattacaggcatgagccactgcacccagcctatacaactagtttaagaaataccaaggagatttcagaattagatcagtgaacagaatttccaacatgctaaatatgaagctgaaagatgtgcatctactttttataaactacttcacttgtaaacagccccagccctcaaaaagctgtttactgtgg

SEQ ID NO: 61125 - DNA, 601 bp, Human
cggtggctcatgcctgtaatccccgcactttgggaggccgaggccggtggatcacgaggtcaggagattgagaccatcctggctaacacagtgaaaccccgtctctactaaaaatacaaaaaattagccgggcgcggtggtgggtgcctgtagtcccagctgctcggggggctgaggcaggagaatggcgtgaacccgggaagcggagcttgcagtgagccgagatcgcgccactgcactctagcctgggtgacagagtgaaactgtctcaaaaaacaaaacaaaacaaaaaaaacaccagttattgtcccgactttacagatgaggacacagatactgtcatttggaaacactagctgactgctgaagaagagccaaccagccggtgggagagctagattttgacccatcttctgactccagaccagagccttaatcttgggctgaactcaacctactagaagtgtggactgaaggggagaggtccccttcaggaaacacgcatcaggggttattgtaggttgaagtctgccatgtggtgacaaggcccagagctgatgacagcaaaagacagcaaatctgattttttaaaagaaaagta

SEQ ID NO: 61126 - DNA, 601 bp, Human
tctgcttttcttgggcatacatatctggatttctggtctccattcattttgttcctggatgtgagttcctgcttggacagcatttttcaaattaaattttacatttagtttgtgatttctttcaagccctaccacaactcgcattagtcaaaaccagttataggccgggcgcggtggctcatgcctgtaatccccgcactttgggaggccgaggccggtggatcacgaggtcaggagattgagaccatcctggctaacacagtgaaaccccgtctctactaaaaatacaaaaaattagccrggcgcggtggtgggtgcctgtagtcccagctgctcggggggctgaggcaggagaatggcgtgaacccgggaagcggagcttgcagtgagccgagatcgcgccactgcactctagcctgggtgacagagtgaaactgtctcaaaaaacaaaacaaaacaaaaaaaacaccagttattgtcccgactttacagatgaggacacagatactgtcatttggaaacactagctgactgctgaagaagagccaaccagccggtgggagagctagattttgacccatcttctgactccagaccagag

SEQ ID NO: 61127 - DNA, 601 bp, Human
tgccactgcactccatcctgggcggcagagctaggctccatctcaaaaaacaaacaacaacaacaacaaaaaaaaacgggcaagcttacagcagttcacacaacagcccagacaggacctgctggagactatcagcatcctgtttcctgggctctgccagctcctggaatgctaccagcatcatcaaaccctagtggtacttgtctccagtggcagtgtactccaggacctctttgagccaggtaatagactctcctgtctctgggtgccccatctcatcctcagtcagcatcctgacaayctgggagaagtcctggataaaattctgcttttcttgggcatacatatctggatttctggtctccattcattttgttcctggatgtgagttcctgcttggacagcatttttcaaattaaattttacatttagtttgtgatttctttcaagccctaccacaactcgcattagtcaaaaccagttataggccgggcgcggtggctcatgcctgtaatccccgcactttgggaggccgaggccggtggatcacgaggtcaggagattgagaccatcctggctaacacagtgaaaccccgtctct

SEQ ID NO: 61128 - DNA, 601 bp, Human
gtggctcacgcctataatcccagcactttgggaggccaaggcaggcgtatcatttgaggtcaggagttcgagaccagcctggccaacatggtgaaaccccatctctactaaaaatacaaaaattagccgggcgtagtggcgggtgcctgaaatcccagctacttgggaggctgaggcaggagaatcgcttgaacccagaagacagaggttgcagtgagccaagaccacaccattgcactccagcctgggcaacaagagtgaaactctgtctcaaaacaacaacaacaacaacaacaacaamaaaaaaaaagattacacagtaatttattgagagcctcctctccctgccttgcagttgcttggagattttgtacgctagccccaggaaggtggctgggggcagtggtgcaacacactgctcaatgagacccataaggtggctgtaaccatcttccacataccaagaacatggtcagcagatccagctcctcatatagtgcctcctccctgtaattcttctgcatgatctggtgctgttccggtgtggcccattgcagacactgaaccaccagtcagctgcatttgttgtcatctgttgtcc

SEQ ID NO: 61129 - DNA, 601 bp, Human
gcagtggctcacgcctataatcccagcactttgggaggccaaggcaggcgtatcatttgaggtcaggagttcgagaccagcctggccaacatggtgaaaccccatctctactaaaaatacaaaaattagccgggcgtagtggcgggtgcctgaaatcccagctacttgggaggctgaggcaggagaatcgcttgaacccagaagacagaggttgcagtgagccaagaccacaccattgcactccagcctgggcaacaagagtgaaactctgtctcaaaacaacaacaacaacaacaacaamaacaaaaaaaaagattacacagtaatttattgagagcctcctctccctgccttgcagttgcttggagattttgtacgctagccccaggaaggtggctgggggcagtggtgcaacacactgctcaatgagacccataaggtggctgtaaccatcttccacataccaagaacatggtcagcagatccagctcctcatatagtgcctcctccctgtaattcttctgcatgatctggtgctgttccggtgtggcccattgcagacactgaaccaccagtcagctgcatttgttgtcatctgttg

SEQ ID NO: 61130 - DNA, 601 bp, Human
ggcgcagtggctcacgcctataatcccagcactttgggaggccaaggcaggcgtatcatttgaggtcaggagttcgagaccagcctggccaacatggtgaaaccccatctctactaaaaatacaaaaattagccgggcgtagtggcgggtgcctgaaatcccagctacttgggaggctgaggcaggagaatcgcttgaacccagaagacagaggttgcagtgagccaagaccacaccattgcactccagcctgggcaacaagagtgaaactctgtctcaaaacaacaacaacaacaacaamaacaacaaaaaaaaagattacacagtaatttattgagagcctcctctccctgccttgcagttgcttggagattttgtacgctagccccaggaaggtggctgggggcagtggtgcaacacactgctcaatgagacccataaggtggctgtaaccatcttccacataccaagaacatggtcagcagatccagctcctcatatagtgcctcctccctgtaattcttctgcatgatctggtgctgttccggtgtggcccattgcagacactgaaccaccagtcagctgcatttgttgtcatctg

SEQ ID NO: 61131 - DNA, 601 bp, Human
cgggcgcagtggctcacgcctataatcccagcactttgggaggccaaggcaggcgtatcatttgaggtcaggagttcgagaccagcctggccaacatggtgaaaccccatctctactaaaaatacaaaaattagccgggcgtagtggcgggtgcctgaaatcccagctacttgggaggctgaggcaggagaatcgcttgaacccagaagacagaggttgcagtgagccaagaccacaccattgcactccagcctgggcaacaagagtgaaactctgtctcaaaacaacaacaacaacaacaacaacaacaaaaaaaaagattacacagtaatttattgagagcctcctctccctgccttgcagttgcttggagattttgtacgctagccccaggaaggtggctgggggcagtggtgcaacacactgctcaatgagacccataaggtggctgtaaccatcttccacataccaagaacatggtcagcagatccagctcctcatatagtgcctcctccctgtaattcttctgcatgatctggtgctgttccggtgtggcccattgcagacactgaaccaccagtcagctgcatttgttgtcatc

SEQ ID NO: 61132 - DNA, 601 bp, Human
aaatatttggagaatgactagaggttaaattgtaaaactgatagttcacataaatgaaaacttgtgggctgagacaaaacaatatgattgtattgaagattaaaattttacccaggcctaaaggtcgagtaggaggaaaggtggagggagggtttcctagaaagggaaaggaagaaaagtaccatataaaataagatatggaagtgggaaacagcaaaaggaaaaaagcctgtgtaggtctatgcatggaacagaaacaaaattcccttctcttttagagcattgttttctttttttcttkttttgtaagattacacagtaggccgggcgcagtggctcacgcctataatcccagcactttgggaggccaaggcaggcgtatcatttgaggtcaggagttcgagaccagcctggccaacatggtgaaaccccatctctactaaaaatacaaaaattagccgggcgtagtggcgggtgcctgaaatcccagctacttgggaggctgaggcaggagaatcgcttgaacccagaagacagaggttgcagtgagccaagaccacaccattgcactccagcctgggcaacaagagtgaaactctgt

SEQ ID NO: 61133 - DNA, 601 bp, Human
caaaaaaataaataaataaaaagaaaagagagaaaacagacccactgctggcccaaatttgctgttcagcaaggccaaacagtgggcaattcttcactgtaaccctcactacagtcaccacgtcattcctgtggaacactatgaggcctggggcaggggtggggtggaggcagagacaaggaggaaactggagccaactccacctaaagaaggtgaggcaggaaggacccaggtagagaacctctacgtggttctttttgctggagcaaagtttaaaaatttgtgaggacctcacatcagraagttgtacccacattctagaaaaatatcccccacttaagaaaccagttgcatcctacaaccaactcattagaaatcaatgtctagggtaatacaataaagttttcatagttctgagctgaaaacaaatctatcaaaccatgacctcaagcaacttgagatctgcagaaataagaggcctaggtgtaaaaatatttggagaatgactagaggttaaattgtaaaactgatagttcacataaatgaaaacttgtgggctgagacaaaacaatatgattgtattgaagattaaaattttacc

SEQ ID NO: 61134 - DNA, 601 bp, Human
cagcctgggagacagagcaagattctgtctcaaaaaaataaataaataaaaagaaaagagagaaaacagacccactgctggcccaaatttgctgttcagcaaggccaaacagtgggcaattcttcactgtaaccctcactacagtcaccacgtcattcctgtggaacactatgaggcctggggcaggggtggggtggaggcagagacaaggaggaaactggagccaactccacctaaagaaggtgaggcaggaaggacccaggtagagaacctctacgtggttctttttgctggagcaaaktttaaaaatttgtgaggacctcacatcagaaagttgtacccacattctagaaaaatatcccccacttaagaaaccagttgcatcctacaaccaactcattagaaatcaatgtctagggtaatacaataaagttttcatagttctgagctgaaaacaaatctatcaaaccatgacctcaagcaacttgagatctgcagaaataagaggcctaggtgtaaaaatatttggagaatgactagaggttaaattgtaaaactgatagttcacataaatgaaaacttgtgggctgagacaaaacaa

SEQ ID NO: 61135 - DNA, 601 bp, Human
aaaaacacacacacacttgccaaatttagttttttaactggataattttgtatatctttcacaatccagctgttaaaccgaaaatggaatttacgaaacagatggtgataacaaggtctagttcacagcagttctacagaaaaaaaaaacacaccaatctgattaaactatccatttgcttcaaaagcctctaataggctcgtcccttatcatcctacattcacttataccacgagatttcatacagatgggtgtgatggaaccatctgtaatcccatccaagtaagtaccatcagagtgygcaagccaccatcattagtgacagatgaagagataagggatcttccttcgcaacaggggttcccaaatacagccaatcaacagggagttttggaaaatatagcgtcccaagctacccagcaaaaatctcatttactatgtgtagggatggacccaggataagtcgttttaaaatctatgtgattctggtgactggctggggtgggagcacacaggcttgagagctgagggtacatgagggttgaaaacagacccactgctggccgggcgcggtggttcacgcctgtaatctcagcacttt

SEQ ID NO: 61136 - DNA, 601 bp, Human
tacaagttatccttctgccccactgctcagcttctgagatgtgcatggcagtggccagggcctctctgtactgaggtaaggggaaagtacttattttaaactgtttagatttattgctggataaaactgaaggctgccaatcatgtatactattaactctcaaagttatccaagccaaagaactcgcctttctggtctcagtttactactctgaatatttctggtagaccaaaattagagccttagaaactgtctaaggaatcaaaacagtgtattcaaggagtcatttttaaaaacacayacacacttgccaaatttagttttttaactggataattttgtatatctttcacaatccagctgttaaaccgaaaatggaatttacgaaacagatggtgataacaaggtctagttcacagcagttctacagaaaaaaaaaacacaccaatctgattaaactatccatttgcttcaaaagcctctaataggctcgtcccttatcatcctacattcacttataccacgagatttcatacagatgggtgtgatggaaccatctgtaatcccatccaagtaagtaccatcagagtgcgcaagccac

SEQ ID NO: 61137 - DNA, 601 bp, Human
aagtgaaagcacataaaatccctccaccctgatgcaattactttactgcctcttaggggaaccgcacgcacagtggttcaagatgtagaatggtaaagtagaaggaatgaataaaagagtccagagctcaagggtgttggacattgatgccaaattacaagttatccttctgccccactgctcagcttctgagatgtgcatggcagtggccagggcctctctgtactgaggtaaggggaaagtacttattttaaactgtttagatttattgctggataaaactgaaggctgccaatcatgyatactattaactctcaaagttatccaagccaaagaactcgcctttctggtctcagtttactactctgaatatttctggtagaccaaaattagagccttagaaactgtctaaggaatcaaaacagtgtattcaaggagtcatttttaaaaacacacacacacttgccaaatttagttttttaactggataattttgtatatctttcacaatccagctgttaaaccgaaaatggaatttacgaaacagatggtgataacaaggtctagttcacagcagttctacagaaaaaaaaaacacacc

SEQ ID NO: 61138 - DNA, 601 bp, Human
aatagatgttctcagctgccctcaaaatagtactgacatgcatgtttccttcagccaacccagtactgatgagctattctcatcctctcagccagccttgtcacaaacactacgtttcttggtaagagttcaagttttcacgtataaagttatctttactaacattttgctcctcattacaacagtaatattcatggaagtttatcggtaagatgtagaaataatcaaatgagaaagtgaaagcacataaaatccctccaccctgatgcaattactttactgcctcttaggggaaccgcaygcacagtggttcaagatgtagaatggtaaagtagaaggaatgaataaaagagtccagagctcaagggtgttggacattgatgccaaattacaagttatccttctgccccactgctcagcttctgagatgtgcatggcagtggccagggcctctctgtactgaggtaaggggaaagtacttattttaaactgtttagatttattgctggataaaactgaaggctgccaatcatgtatactattaactctcaaagttatccaagccaaagaactcgcctttctggtctcagtttactactct

SEQ ID NO: 61139 - DNA, 601 bp, Human
atgaaaactctctctactatctttataattattctgtaagtcagtctaaaattgtttcaaaataaaaactttctttttgaaacgaagttttgcccttgttgcccaggctggagtgcaatggcacaatctcagctcactgcaacctctgcctcccaggttcaagtaattctcctgcctcagcctcctgagtagctgggattatagacacataccaccacgcccagctaattttgtatttttagtagggatcgggtttctccatgttggtcagactggtctggaactcccgacctcaggtgayccacctgcctcagcctcccaaagtgctgggattacaggcgtgagccaccgtgcctggcccaataaaaagttttctaaaaagcaaaaggacaatgtccctcaactggaacatataaacaatggagtacactcagcaagaagatggaatgaattactgatacatgtaataacatggtttgagtctccaaagtacactacaatgtgaaagaagacatccatacacagaagagactacctatgttctagaaaaggcaaaactatagtgatagaaggcagacaggtggtttaccagggccagaga

SEQ ID NO: 61140 - DNA, 601 bp, Human
attaatttcttaaatgttgataattgtaccatggccatgtgagatgttaaacatcaggagaaactggggaaagggtatatgaaaactctctctactatctttataattattctgtaagtcagtctaaaattgtttcaaaataaaaactttctttttgaaacgaagttttgcccttgttgcccaggctggagtgcaatggcacaatctcagctcactgcaacctctgcctcccaggttcaagtaattctcctgcctcagcctcctgagtagctgggattatagacacataccaccacgcccrgctaattttgtatttttagtagggatcgggtttctccatgttggtcagactggtctggaactcccgacctcaggtgacccacctgcctcagcctcccaaagtgctgggattacaggcgtgagccaccgtgcctggcccaataaaaagttttctaaaaagcaaaaggacaatgtccctcaactggaacatataaacaatggagtacactcagcaagaagatggaatgaattactgatacatgtaataacatggtttgagtctccaaagtacactacaatgtgaaagaagacatccatacac

SEQ ID NO: 61141 - DNA, 601 bp, Human
tattaatttcttaaatgttgataattgtaccatggccatgtgagatgttaaacatcaggagaaactggggaaagggtatatgaaaactctctctactatctttataattattctgtaagtcagtctaaaattgtttcaaaataaaaactttctttttgaaacgaagttttgcccttgttgcccaggctggagtgcaatggcacaatctcagctcactgcaacctctgcctcccaggttcaagtaattctcctgcctcagcctcctgagtagctgggattatagacacataccaccacgccyagctaattttgtatttttagtagggatcgggtttctccatgttggtcagactggtctggaactcccgacctcaggtgacccacctgcctcagcctcccaaagtgctgggattacaggcgtgagccaccgtgcctggcccaataaaaagttttctaaaaagcaaaaggacaatgtccctcaactggaacatataaacaatggagtacactcagcaagaagatggaatgaattactgatacatgtaataacatggtttgagtctccaaagtacactacaatgtgaaagaagacatccataca

SEQ ID NO: 61142 - DNA, 601 bp, Human
tcgaactcctgacctcgtgatctgccagccttggccccccaaagtgctgagattacaggcgtgagccaccatgcccagccagtattaatttcttaaatgttgataattgtaccatggccatgtgagatgttaaacatcaggagaaactggggaaagggtatatgaaaactctctctactatctttataattattctgtaagtcagtctaaaattgtttcaaaataaaaactttctttttgaaacgaagttttgcccttgttgcccaggctggagtgcaatggcacaatctcagctcactgyaacctctgcctcccaggttcaagtaattctcctgcctcagcctcctgagtagctgggattatagacacataccaccacgcccagctaattttgtatttttagtagggatcgggtttctccatgttggtcagactggtctggaactcccgacctcaggtgacccacctgcctcagcctcccaaagtgctgggattacaggcgtgagccaccgtgcctggcccaataaaaagttttctaaaaagcaaaaggacaatgtccctcaactggaacatataaacaatggagtacactcagcaagaa

SEQ ID NO: 61143 - DNA, 601 bp, Human
gcagtggctcatgcctgtaatcccagcactctgggaggcagaggtaggtggatcacctgaggtcaggtgtttgagaccagcctggccaacatggtcaaaccctgtctctactgaaaatacaaaaataagccaggcgtggtggtgcatgcctgtagtcccagctactcggggggctgagacaggagaattgcttgaacccgggatgtggaggctgcagtgagccgagatcatgtcactgtactctagcctgggcaagagagaacaagactccgtctcaaaaaaaaaaaaaaaaaaaaaaaargatctggctccatcacttactagttattaggccttgggcaaggtactctgtacctcagtcttctcggctataaaatgagcataaagtgcctgcttcacagggtgtcatgaggattaaatgggcacatgtgtttagaactatgcaggcggagcaagtgctagttattgttattactattattattacaattaagattgagggagctgcaaagctatgtatctcccatgcatattgaggtacatcaaaatttaaaaagcaataatttgccttaacagagtacagaaaaggaaaaatagtaac

SEQ ID NO: 61144 - DNA, 601 bp, Human; identical to SEQ ID NO: 18123

SEQ ID NO: 61145 - DNA, 601 bp, Human; identical to SEQ ID NO: 18124

SEQ ID NO: 61146 - DNA, 601 bp, Human; identical to SEQ ID NO: 18125

SEQ ID NO: 61147 - DNA, 601 bp, Human; identical to SEQ ID NO: 18126

SEQ ID NO: 61148 - DNA, 601 bp, Human; identical to SEQ ID NO: 18127

SEQ ID NO: 61149 - DNA, 601 bp, Human; identical to SEQ ID NO: 18128

SEQ ID NO: 61150 - DNA, 601 bp, Human; identical to SEQ ID NO: 18129

SEQ ID NO: 61151 - DNA, 601 bp, Human
ggctttgttatcaagaataggcagcttcatcaaattaattgacacttcacaggtttctctacgctcttgaattatttatacacatgcaaaatttgtggttacttgaaagcttgaaagaacacttataaaactgactgggtccaggcactttcccccaaatcattaatttgaccttttctaatggttattaatgtatgcaggctttcaaactcttggtccattcctttctctccccatctttttaaaaaacgtattcatcaagatgtaaagatttataaagcatatttttagttacatatcrtctcattcctagatatcagactccccagcaacctatgatacaagattttcaacttgtagatttgtgatttctgttctttggctttttctaaattattctaaataaggagtttggactttaactgaaaagctgtggtgagccaccaaaggagcagcatgatccaatccacactttagaaagaacatcccagcagctcatgagggcaaactgaaggatcctcagagatgagaggcagggaggaggcaggagcttaacattccctccaggaggaagataagaaaggcccagcaaagacctgca

SEQ ID NO: 61152 - DNA, 601 bp, Human
tgatacgctgtgccaagaggggcattattaatctagttcaccacacccagcatcagtagttgtcagttttaatctaaaccattcttacattcttggactaaacatccctgggtcatgttgaaaacagtacttctatactagcctgacattttaagattcttacaactacattaatcagtgagatttgcctatcattttttttttttaatgctaggcttatcaggctttgttatcaagaataggcagcttcatcaaattaattgacacttcacaggtttctctacgctcttgaattatttayacacatgcaaaatttgtggttacttgaaagcttgaaagaacacttataaaactgactgggtccaggcactttcccccaaatcattaatttgaccttttctaatggttattaatgtatgcaggctttcaaactcttggtccattcctttctctccccatctttttaaaaaacgtattcatcaagatgtaaagatttataaagcatatttttagttacatatcgtctcattcctagatatcagactccccagcaacctatgatacaagattttcaacttgtagatttgtgatttctgttctt

SEQ ID NO: 61153 - DNA, 601 bp, Human
aacaccaaaagcaatggcaacaaaagccaaaattgacaaatgggatctaattaaactaaagagcttctgcacagcaaaagaaactaccatcacagtgaacaggcaacctacagcaatgggagaaaatttttatgatctacccatctgacaaagggctaatatccaggaatctacaaagcaactttaacaaatttacaagaaaatatcaaacaaccccatcaaaaagtgggtgaaggatatgaacagacacttctcaaaagaagacatttatgcagccaacagacacacgaaaaaatgctcmtcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacggtgtggcgattcctcagggatctagaactagaaataccatttgacccagccatcccattactgggtatataaccaaaggattataaatcatgctgctataaagacacatgcacacatatg

SEQ ID NO: 61154 - DNA, 601 bp, Human
gataatcgatatttctttctttggctgcttttatattaactatattttataagtatatactgcaatttactatgttttaatccaagtagggatttaatttgacttatttggaatttattaggctttctgaagaccgatattttgcatgtgttctagaaacttttttagccattatcttctctaacgttgcatctagcacattgcctctgttatctccaggaatttcaattaagggcatattataccctcccagtcttccatgtttcttaaattctcattcatattttctacctgtctttgygctgcattcagcacaatttctttagacctttcttcccaatcaccgtatttaatctatgtctaatctatttaatgagtatactggacttcagtttcatttttttaatttctaaaagttatatttcctcctcttcccaatctgcctggctaattctgcaagtttcttatccctttgtcaatttttttttgtttgttttttggcacggagtcttgctctgttgcccaggctggagtgcagcagcacaatcttagctcattggaacctccacctcccgcattcaagcaattctctacctcaggt

SEQ ID NO: 61155 - DNA, 601 bp, Human
ccctagtttattagttttcttttacaagtgaggagtaaatatgaaacctaacacatcttttcagcatgtcatgtagcttccctagattaaaaaaaaaaatctttattttgctgtcattctggaaagataatttgttgagaggtatttgctgggaaccgaattctagtttgacactgatatctatcttgcccttcagtattgctgttggcaaaccaattcagtgtaactgctgttgccttttagataatcgatatttctttctttggctgcttttatattaactatattttataagtatatrctgcaatttactatgttttaatccaagtagggatttaatttgacttatttggaatttattaggctttctgaagaccgatattttgcatgtgttctagaaacttttttagccattatcttctctaacgttgcatctagcacattgcctctgttatctccaggaatttcaattaagggcatattataccctcccagtcttccatgtttcttaaattctcattcatattttctacctgtctttgcgctgcattcagcacaatttctttagacctttcttcccaatcaccgtatttaatctatg

SEQ ID NO: 61156 - DNA, 601 bp, Human
taggagaatcagattggaactgattagacttcttcagacacctcttcataagataggtttatgtaagcacttagtaagattaacccccaagaaataaaagcctcctgatcttaacttatagcacaatctgtcaagtgataaattttcctctttttttttttttttttgagatggagtcttgttcttgccatccaggctggagtgcaatggcatgatctcagctcactgcaacctctgcctcctgggttcaagcgattctcctgcctcagcttcctgagtagctgggactataggcacccgycaccatgctcggctaatttttgtatttttagtagagacagggtttcaccatgttggccaggctggtctcgaacttctgacctcgtgatctgcccaccacagtctcccaaaatgctaggattacaggcgtgagcccctgtgcccagccagaattttcccctttcaacatctttcattctatttatgaaatataaagatgaccacgtgacttatccatttgaagatgactattcacactgaggaccttttctttaaattcatggccttttgatcatgaattcagattcaatttatggttcac

SEQ ID NO: 61157 - DNA, 601 bp, Human; identical to SEQ ID NO: 18130

SEQ ID NO: 61158 - DNA, 601 bp, Human; identical to SEQ ID NO: 18131

SEQ ID NO: 61159 - DNA, 601 bp, Human; identical to SEQ ID NO: 27320

SEQ ID NO: 61160 - DNA, 601 bp, Human; identical to SEQ ID NO: 27321

SEQ ID NO: 61161 - DNA, 601 bp, Human; identical to SEQ ID NO: 27322

SEQ ID NO: 61162 - DNA, 601 bp, Human; identical to SEQ ID NO: 27323

SEQ ID NO: 61163 - DNA, 601 bp, Human; identical to SEQ ID NO: 27324

SEQ ID NO: 61164 - DNA, 601 bp, Human; identical to SEQ ID NO: 27325

SEQ ID NO: 61165 - DNA, 601 bp, Human
acgcctgtaatcctagcactttgggaggccaaggggggtggatcactttagcttgggagttcgagaccagcctgggcaacatggcgaggcctcatttgtacaaagactatacaaaaattagccgggtgtggtggcacacacctgtagtcctagctactcaggagggtgaggtgggaggatcacttgagcccaggaagtggaggttgcagtgagctgagatggtgccactaccctccagcctaggcgacagagcaagatcctgtctcaaaaaaaaaaaaaaaatatgtggaccttaagacartctctgttaatgtgggtttggaacaggctttctccaaaggaagctggtgacctcaggctgacctttctgcaagccccagctgttcacggttgccaccttcctgagaggagtgggcagcatcagggttacaggtgtttccccagggcagtgtttccagctgagcttccagttccccacaaacacagccactttcctctgaatccaagattcagatgctctgccttgggcccctgaaggaacttgtctgatgaagggacttgtcagggttggggcttgggatggaactggagctgggtccct

SEQ ID NO: 61166 - DNA, 601 bp, Human
gcatgagatcggctcactgcaacctccgcctcctgggttcaagcgattctcctgtctcagcctcccgagtagctgggattacaggtgcctgccaccacgcctggctaatatttgtatttttagtagagatggggcttcactatcttggccaggctggtcttgaactcctgaccttgtgatccacctgcctcggcctcccaaagtgctgggactacaggcatgagccactgcgcccagcctgttatttttttttttttttttgagacagtctcactgtgtcgcccaggttggagtgcagtggcatgatcttggctcactgcaacttctgtctcccaggtttaagcgattctcctgcctcagcctcctcagtagctgggactacaggtgcgcaccactacgcccagctaattgttttactttttttttttttttttttgagatggagtctcccctctgtcgcccaggctggagtgtggtggctccgtctaagctcactacaacctctgcctcccaggttcaagcgattctcctgcctcagcctcctgagtagctgggattacaggcacgcgccaccacacctggctaatttttttgtgtgtgt

SEQ ID NO: 61167 - DNA, 601 bp, Human
aatccccttgggcggcactgctttggagtccctgcaaggcctgtggggatggcggcccagtggcatgccttccagtcctgccactcccagccaagacatcactagtctatcatggtgtgttttcttgccatgccaggttgggcggcacactagtaatcacctagaatgggagccagggggaaacccgttcgctgtccctgtgcaccgtgttcagggcagctgctgccagtggaatgctgggataaccccagtgtcgggggtcctggggcagcctgtgtactgctggatgcttgctttcaartactctgctggggtaagactctggggcagtttccatcccttccttgggcttcagcttgctggactggccctgagaactgggaggggatggcttcatgaagtcattttgatgggggatgaagatagttgctgtagaggaagaggatgagagagctgcttggcctctggaaggtgggaggagctgtcgcaggctgcacaggggctctgaggtcgagttcgtttagttcattgattaagcagtctaccaggtggccagcaaggctttgtgggtgcttgggatgcatttaagggaactaaacaa

SEQ ID NO: 61168 - DNA, 601 bp, Human
ctattttgtcccctgttgcatccccagcacctagaacagtgtgtagaacatagcagatattcaataaagacttgaatggaggccgggcgcggtggctcatgcctgtaatcccagcactttgggaggccaaggcgggtggatcacgaggtcaggtgatcaagaccatcttggctaacacggtgaaaccccgtctctactaaaaatacaaaaaattagccgggggtggtggtgggctcctgtagtcccagctacttgggaggctgaggcaggagaatcacttgaacccaggcagcagaggttrtagtgagccaagatcgtgccactgcactccagcctgggtgacagagcaagtctccatctcaaaaaaaaaaaaaaaaaaaaaaaaaaaagacttgaatagctacagaaagtcccttacctctgatcaaaggcctgtgaattagctgctaacatcccatgttgagaaagggacaccacacatcagagacgcgaattctctgcacttgcccaagatcccctagagaactagcagcacagtcctgactctcagccctttgtatttatttatttaatagatttaatatttaatatttaatagatt

SEQ ID NO: 61169 - DNA, 601 bp, Human
tctacccaagaatgttcctgtcattgtgtccctggtaacaaccacagacactattcactgagcttcttctagactacatgaagagtcactagaatgtcaaccccaaaaggacagggattttgcctattttgtcccctgttgcatccccagcacctagaacagtgtgtagaacatagcagatattcaataaagacttgaatggaggccgggcgcggtggctcatgcctgtaatcccagcactttgggaggccaaggcgggtggatcacgaggtcaggtgatcaagaccatcttggctaacayggtgaaaccccgtctctactaaaaatacaaaaaattagccgggggtggtggtgggctcctgtagtcccagctacttgggaggctgaggcaggagaatcacttgaacccaggcagcagaggttgtagtgagccaagatcgtgccactgcactccagcctgggtgacagagcaagtctccatctcaaaaaaaaaaaaaaaaaaaaaaaaaaaagacttgaatagctacagaaagtcccttacctctgatcaaaggcctgtgaattagctgctaacatcccatgttgagaaagggacaccaca

SEQ ID NO: 61170 - DNA, 601 bp, Human
gtctcctgagctgtccctaagtctatgaggccctgttctcacctgtctgagagtggacacaggtacccatctgcagcatctactacctcaggtttgcaaaaagtggagtttttaaggggctgtttttgtttctggtgttttgttttgttttgtttgagacagagtctcgctgtgtcgcccaggctggaatgcaactgcgtgatctcagctcactgcaacctccgcctcccaggttcaagcgattctcctgcctcagcctctcaagtagctcagactacaggtgcccaccaccacgcccagytcatttttgtatttttagtagagacagggtttcgctatgttggcaaggctggtctcgaactcctggcttggccaggctggtcttgaactcctgacctcgtgatctgcccacctcggcctcctaaagtgctgggattacaggcgtgagccaccgcgcccggcaagggactgtttttgaatgtcacaggcaaaacaaacccataggtcacagaggcattatgggcccttctgtccgttaaaaatgacactacacacaataaaacatgaaagagggagataacaacataaaggagtgatgtat

SEQ ID NO: 61171 - DNA, 601 bp, Human
gcttcagatctattaataggttgaaggggcagagaaagggagaggcacaatggctcatgcctataatgctagcactttgcgaggctgaggtgggaggatcacttaaggccaagagtttgagacctgcccaggcaacacagtaagaccctgtctctaccaaaaaaaaaaaaagaaaaaagaaaacaaacaaacagaggcagaaacaggatgaagggatacagcaggtagctaacagcaccaagaatcaccaaggacttacgcacccaggttctgggcacatagtgaaaagcattaaggactwcattagttctcttgacttttattaaattatcacttgaaacgcgccaagaagaacatgtacctattatttaaaggagaccaacaacctcatgaatacactgaaaaccactaattgtatattttgaaatggtgacttttatgctacgtgaatatcacgtttaaaatgttacttaaaaaaaaaaaaaagaaaagcagtgtcatatttaatattatacctgagttccaatactccagtaaaaccacccgacgtaagaaggatgccgaaaccaagcgtacactccactggtcaccagagtatgtg

SEQ ID NO: 61172 - DNA, 601 bp, Human
cgcttgaacctgggaggcagaggttgcagtgacctgagatcatgccactgcactccagcctgggcaacagggcaacagagtgagactccatctcaaaaaggaaaaaaaaaaaaaaaaggccaggcactgtagctcaagcctgtaatcccagcactttgagaggcccaggaaggcagactgcttgagctcagtagttcaagatggctctgggcaactcgagaaaccctgtctctacaaaaaaaatacgaaaagtagtcaggcatggtggttcgtgcctacagttccagctacttgggaggcwgaggttgcagtgaaccaagatcgcaccactgcactctggcctggtcaacagagcaagactaggtctcaaaaaaaaaaaagaaagaaagaaaagaaaagaaacgaaacaaggccttttcttcagcctgagacagaacaaacctccatggctcacacagctcactaacacatggcctcggccccattaatacctatttctgatgaaaactagccaagctgccacatgagtgacagagggcactcccttccctaagccccatctctgtcctcaccccctctggggtgcttcagatctattaat

SEQ ID NO: 61173 - DNA, 601 bp, Human
tttgccatgttggctaggcttgtctcaaactcctgatgtcaagtgacccacccacttcagcctctcaaagtgctgggattacaggcaaccgtccaggagaaccacctctacaaaaaatttaaaaattagccggacgtggtggcaacacctgtaatgtattccagctacttgggaggctgaggtaggaggatcacttgagctcaggaggtcaaggctgcagtgagccatgatcagaacactgcactccaggctgggcaacacagcaagatcctgtctttaaaaaaaaaaaaaaaaaaaaaaagctgggcacggtggctcatgcctataatcccagcactttgggaggccgaggcgggcagatcatgaggtcaggagatcaagaccatcctggctaacacagtcaaacctcatctctactaaaaatacaaacaattagccgggtgtggtggcgggcgcctgtagtcccagctactcaggaggctgaagcaagagaatcgcttgaacctgggaggcagaggttgcagtgacctgagatcatgccactgcactccagcctgggcaacagggcaacagagtgagactccatctcaaaaaggaaaaa

SEQ ID NO: 61174 - DNA, 601 bp, Human
aagagtgaaactccatctcaaaaaaataaattaattaaaaaatacaaaaattagccaggtgtgatgacacacatctgtagtttcagctacttagaaggctgaggcaggagaatcactcaaacccgggaggcggaggttgcaatgagccgagattgtgacaccgcactccagcctgggcagatacttaggagactaaggtgggaggatcacttgagcccaagaggtagaggctgcagtaaaccatgatcatgccaatgcactatagcctgggtgagagaccctgcctcaaaacaaaacaaaraaccatacataaataaaaaaaatacacacacacacacacacacacacacacacacacacacatagagcaggtgcagtggctcacacctataatccttacacttctttttctttttttctttttgagacagattcttgctgtgtcaccctggctggagtgcagtggcgtgatctcagctcactgcaacctctgcctcccaggttcaagcaaatattgtgcctcagtctctcgactagctggaattataagtaagaaccaccatgcctggcctaatcccagcactttagaaggccaaggtag

SEQ ID NO: 61175 - DNA, 601 bp, Human
atctgtaaatcacaagatcaacctcttggatttcaaccctcagcttggggtgacagcaatgccccccacctccaggtgtgagctccccaacatgaggtcccatgcacgctgccttcctgcccaggaccctcccaccacaaatgcattcgcttacaccacagctgcctgggcctctgcctcctaaacccacagcctctgcttcagcacgagatacagtgccacaaaactcagcttccgaaatgccccttccagcagattacctccacgctcagagagctccagagactgaaccccacccccygagtctgggtttccaaccccagaagagcagcacttcgcccacttccccagtctcctgccctccccacgctgtgcccactttgcctcttttttttcccccgagacagattgtcactctgtcacgtggagtgcagtggcgtgatcatggctcactgcagccttaactgcttgggctcaagtgattctcccacctcagcctcccaagtagctgggactaagggcacatgccaccacacccagctaatttttgtattttttgtagagatggggtttcacaatgttgcccaagctggtctcgaac

SEQ ID NO: 61176 - DNA, 601 bp, Human
agagatctgtaaatcacaagatcaacctcttggatttcaaccctcagcttggggtgacagcaatgccccccacctccaggtgtgagctccccaacatgaggtcccatgcacgctgccttcctgcccaggaccctcccaccacaaatgcattcgcttacaccacagctgcctgggcctctgcctcctaaacccacagcctctgcttcagcacgagatacagtgccacaaaactcagcttccgaaatgccccttccagcagattacctccacgctcagagagctccagagactgaaccccacmccctgagtctgggtttccaaccccagaagagcagcacttcgcccacttccccagtctcctgccctccccacgctgtgcccactttgcctcttttttttcccccgagacagattgtcactctgtcacgtggagtgcagtggcgtgatcatggctcactgcagccttaactgcttgggctcaagtgattctcccacctcagcctcccaagtagctgggactaagggcacatgccaccacacccagctaatttttgtattttttgtagagatggggtttcacaatgttgcccaagctggtctc

SEQ ID NO: 61177 - DNA, 601 bp, Human
ctggtgggcctggtgtgaaggtgggcttcctgggcctctggcagatggaggatggcattaaatgccaacacagtcagcttaccatccacaaggccagcagctgccaacagctgccctagacctatcaacaagacaacttcatggctcccaatgggaatggaggctgggcccgccctacttagagcaggggaaagaacttttccctcaaagagccggggcaggatgccagaatctaactacatcctctcccggtttgcagttctaggaagtggaatttgctgccctaggcgtggtctaaagtacaagtttagaaatgattcaactcaagttcctaaacagagtaagtgccagttgatgtcccaccgtggatcctttactccagaaaaattgtaatgatggctcggccaccgccttggctagagtcccactgcacgcgtgtcgtgagggccgatgggcaagtccgtccggttttttttgttgttgttgttgttttttgagatggagtctcgccctgttgcccagactgaagtgcaaaggcccgatctcaactcactgcaacctccgcctcctgggttcaaaggattctcctgtctcagcctcc

SEQ ID NO: 61178 - DNA, 601 bp, Human
ccggggcgctgctgttcccggtcctccccatctctcctcctgatcgcttctcaaggctcatccgtcgttctcgctgcctgtccctgtgtcgctccggtccctttccccaccctcccattctgcccccagcccctccgacctctccccgcgggcacgctctcaccaccttaccctgctccccaagactgtgaccctgcttcctgcaccagttcctcgggctgtttacagcacacacaccgccacttctgaccctgagcccctactcctatcttaagcttctccctcctgccaggccttggcrcaaagcacttccgcacctccctacctgctgctgctcccaggatgcaaagaccccactgctgcaccgcgtcctgcggcattagcagcagccggggtacctgcccaccttcccaccccgccaaccagccgcatcctggtgtccctcctcctggcatttgtcctgggggctcttacagggactgtgctttgcccgcagcatcccggggtgctccaggtggaaagccccttagcacctttcctccctggccaccgtctccttccctccccacccccactttcctgctcagcctcactttgtgat

SEQ ID NO: 61179 - DNA, 601 bp, Human
gtccctgtgtcgctccggtccctttccccaccctcccattctgcccccagcccctccgacctctccccgcgggcacgctctcaccaccttaccctgctccccaagactgtgaccctgcttcctgcaccagttcctcgggctgtttacagcacacacaccgccacttctgaccctgagcccctactcctatcttaagcttctccctcctgccaggccttggcacaaagcacttccgcacctccctacctgctgctgctcccaggatgcaaagaccccactgctgcaccgcgtcctgcggcaktagcagcagccggggtacctgcccaccttcccaccccgccaaccagccgcatcctggtgtccctcctcctggcatttgtcctgggggctcttacagggactgtgctttgcccgcagcatcccggggtgctccaggtggaaagccccttagcacctttcctccctggccaccgtctccttccctccccacccccactttcctgctcagcctcactttgtgattcagcatttttggggttggtaactttcttgcttcctgtcgtgatagggacctggctacggagctgaaggcaggggtctt

SEQ ID NO: 61180 - DNA, 601 bp, Human
ccccaccctcccattctgcccccagcccctccgacctctccccgcgggcacgctctcaccaccttaccctgctccccaagactgtgaccctgcttcctgcaccagttcctcgggctgtttacagcacacacaccgccacttctgaccctgagcccctactcctatcttaagcttctccctcctgccaggccttggcacaaagcacttccgcacctccctacctgctgctgctcccaggatgcaaagaccccactgctgcaccgcgtcctgcggcattagcagcagccggggtacctgcccrccttcccaccccgccaaccagccgcatcctggtgtccctcctcctggcatttgtcctgggggctcttacagggactgtgctttgcccgcagcatcccggggtgctccaggtggaaagccccttagcacctttcctccctggccaccgtctccttccctccccacccccactttcctgctcagcctcactttgtgattcagcatttttggggttggtaactttcttgcttcctgtcgtgatagggacctggctacggagctgaaggcaggggtcttgaccctgcggttagcagggccacct

SEQ ID NO: 61181 - DNA, 601 bp, Human
acctgagctgcctggttgggagggggctgaggagctggggaccgccactgggggttgtcttttcctccctttcatttgtctgccctgtgttgaactgtgtccaaggggagatgacataagtaatagctcttggggaagtgggctattagcatttatggaaattaatacatccacatccgaggagcaagaacaccaagttcaggccacagctgtcccactgtctgtcgtttcaggattttttctttctctgcaacttctcctccccgacaaaaaccccagcctcacccctcccctttccccmagtgccaagagtaagctcctgctctgctaaggaagccgcattcaggccccgcgttgcaggttgcagggtttggggacctacgtgtggagagtcacatctgcccacctgattctcgcctggcggccgtgtctgctgcagagccctgtgcagctcctggccctgtgctctcgcagtgtggggccctaagagtgcacttggtcctccaggtcctgtcattgtctccacggccacactcggcctcagtggcactgacagtgttcgggccgcagcacatccctcgagagcagcatggtaggggct

SEQ ID NO: 61182 - DNA, 601 bp, Human
tgatcctggcctcccagctagtgaggaaaccttgattctgttcctgccctgccagaactctgtgagaggtgccccctccgccatcacctgagctccatcgaatgcctgaaatcctcacctctgcaggagtgagtctcccaagaggccctggaggcccaggcccagaccctgggggatatggaagcactcctttgtcgtggcgtgggaagccccacactgctctttccttggtgacgggtgacccgccatgttcaggcccctcctggtctatcttcgggtgagtctattaagggatacaccrtctccgctcagccagtcccgaggaggcaaagggaacaggaccctcttccccaggagagagcacactgggggagatggggtggcacacctgggcttcgtcctgtcactgcccactggctcgaggctttcctgcctgcctgggcttggcagatgcgtgagactccctgtctcatgggcctgagcagatgctgggccctcttgtcctctgccacatcctggggaactcagatgaaggccagcctccctcttcctgcacacccaccatgggatgagccctgggctcaggcccctccctgcctga

SEQ ID NO: 61183 - DNA, 601 bp, Human
ctggaggcccaggcccagaccctgggggatatggaagcactcctttgtcgtggcgtgggaagccccacactgctctttccttggtgacgggtgacccgccatgttcaggcccctcctggtctatcttcgggtgagtctattaagggatacaccatctccgctcagccagtcccgaggaggcaaagggaacaggaccctcttccccaggagagagcacactgggggagatggggtggcacacctgggcttcgtcctgtcactgcccactggctcgaggctttcctgcctgcctgggcttggsagatgcgtgagactccctgtctcatgggcctgagcagatgctgggccctcttgtcctctgccacatcctggggaactcagatgaaggccagcctccctcttcctgcacacccaccatgggatgagccctgggctcaggcccctccctgcctgagggtgccctgccactgccacacccaggtttccactcagacccctgctggccagcgtctcaggaggctactccctgctctgcgcagtgaccacatggttagccccagagacccaggttctgcgtgtcttcagtgacagagcaacccca

SEQ ID NO: 61184 - DNA, 601 bp, Human
gggaaggaaggggaagagagggcaggaggggagagcccgttgccctggtctgcagggaatagcctccctctgagggagggacactccttgccctattctccctgaccttgggcctcgtggagggcctgcaagcctgccagacccccactgcacacctgcccacctgtctgtctgattccagcagcccctgggcaccgagtgggttgcagagccatgctctgagcatgctccccctccttcaccatgaatgtgttttcattttccacccccgggcagcttcatgatctttcattgcaatctyaggccctggtatccacaggctctcaatgcagcctaggacagaagactctagaattctgcctcggagccctgtgatcccaaacactcagccgtggcaggggctctctgaaagtgatattcttgccacccctcccagatgcaggagggtaaggaataactagaatgcatgggcaaggagattcagctcgatctattcattataaaacaaatttaaatttaaaacattgcttaaaacctatacatgccagtgaagggcgaaggtcttagcagcagacatttgaaggaccaagaatgagcaaga

SEQ ID NO: 61185 - DNA, 601 bp, Human
atggggaggactgggctcggttgaccttgggtttcgaggtctgtgtcttggacagcagtgcccactgacattgagaaggtagggctggggttcacaggagaggtgggacctggaggtgactgccacctacctactggtcacagccctgacagtgtcacctgggggtagtgccaagggtcgccaagggtacgggtttgagagggaagatgaaggtcaagacagacagtagggaaccctggattcttccagagcccggggaggagaggaaaatagaggatgaggcaggtatctgctgcatccrgtgggccagctgctgccaaggaggcagcctctgttgagaggggaagcagagctgggctcccaggagcagcgagggggcgcaggaccccagattcagcaccaccagcttccaagcactcgccaaccaacttatacccatctgactgaggcagaaacactgaaagtcaaagtggcttccctaaggcctccaagctactaggcgcaggagccaggaccccaagccagagtcccaccctggtgacctttggactttgccgccaatggctctggagagatttgaccgtgaaaggaggaaaaggaa

SEQ ID NO: 61186 - DNA, 601 bp, Human
agcttccaagcactcgccaaccaacttatacccatctgactgaggcagaaacactgaaagtcaaagtggcttccctaaggcctccaagctactaggcgcaggagccaggaccccaagccagagtcccaccctggtgacctttggactttgccgccaatggctctggagagatttgaccgtgaaaggaggaaaaggaaggtgagggcacagggtggctccggggctggcgggcgtagacgaagccgctttgctgcttaaccgcaactgccagcagcaccctctttcgtccgcccctttagaracgatttcaacggcgcattcttccatttcctgccttaatggggggcatttctggggacacccgtgaactgcgggctggggcttagccttgttggtggccctgcataggttggctgcgtagtgctttacgttctgtgtaagaattgtggagtcttggggcctgggtgggccgagggtcctgagatatcggtgtgcccagcaggcttgtagggtgtggcacctgcccagccctcaggggtcctggtgcagcttagcaagctccttggccaccagtccctggtgactcagatcaggggttcca

SEQ ID NO: 61187 - DNA, 601 bp, Human
cgcaggagccaggaccccaagccagagtcccaccctggtgacctttggactttgccgccaatggctctggagagatttgaccgtgaaaggaggaaaaggaaggtgagggcacagggtggctccggggctggcgggcgtagacgaagccgctttgctgcttaaccgcaactgccagcagcaccctctttcgtccgcccctttagagacgatttcaacggcgcattcttccatttcctgccttaatggggggcatttctggggacacccgtgaactgcgggctggggcttagccttgttggtkgccctgcataggttggctgcgtagtgctttacgttctgtgtaagaattgtggagtcttggggcctgggtgggccgagggtcctgagatatcggtgtgcccagcaggcttgtagggtgtggcacctgcccagccctcaggggtcctggtgcagcttagcaagctccttggccaccagtccctggtgactcagatcaggggttccaagaacatgctttgagaaacactccctagccctagccgtttcagtctgtcagtgaacctgcccacctctacttcttaaggaagcacacgaggaagct

SEQ ID NO: 61188 - DNA, 601 bp, Human
aaaaggaaggtgagggcacagggtggctccggggctggcgggcgtagacgaagccgctttgctgcttaaccgcaactgccagcagcaccctctttcgtccgcccctttagagacgatttcaacggcgcattcttccatttcctgccttaatggggggcatttctggggacacccgtgaactgcgggctggggcttagccttgttggtggccctgcataggttggctgcgtagtgctttacgttctgtgtaagaattgtggagtcttggggcctgggtgggccgagggtcctgagatatcgrtgtgcccagcaggcttgtagggtgtggcacctgcccagccctcaggggtcctggtgcagcttagcaagctccttggccaccagtccctggtgactcagatcaggggttccaagaacatgctttgagaaacactccctagccctagccgtttcagtctgtcagtgaacctgcccacctctacttcttaaggaagcacacgaggaagctgtttgtgatggttgaaagctccggcgagaagggctttgcgggggtttctgtaattcttgggaacatgtgaagcccacattctactggaatgac

SEQ ID NO: 61189 - DNA, 601 bp, Human
tgcatgtgatcaccacacacacacacacacacacacacacacactctcccaacacacacacagacacacagagcctgtgccaccagccctcattctctgcctcacccagggccggaaggttctggctaagcctccgggggtgccactgggagggatgcctaggagagggtctccccaaccctctagcaacctgataatcatgatcaccggttgttggagtggcctggccacctgctgggctgtatgggtgctgagggcctggctgagccccgtgatacacccatgggggtgggtctctgargagcagtctgtgtgagcagcaggagaggtggcacctcaggtcaggggacgcttccccccaggctctggaggggacaggataacacctgtccccaggcttggcggaattcctggtctctaacgcagcccggaacacacagagaaatgatccagtgtggggcagtgttgctcacatggtggtaggactgggtcctaggctcctggagccagcggcctcagaaagcccctctaggttctctgagtctttgacactgtgcagcccagactcctcattttatagacagggaaactgaggccagat

SEQ ID NO: 61190 - DNA, 601 bp, Human
ttgctttccctgcttcccacacacagatcctccccaccagagcagggtcatggggtcagaggcagggtccgtgtggtgtggagcaggggttcctccccactcgctcgctcggctgccttcagcccctgcagacacgcaggcaccgtccaccttctccactcttagcgcgagccctgccccagccaggagcactcactgagtggccacattataccctcccgtttgtctatagttcacttaaacattatttcctgggagatccggcagctcttcactcttccgaatcaggctgtgggaaacrtttgtgtgcatctcgctttatttcctctcttgaactattaggataaagtcacagaggtaggattcctggaccccaagctctggacctctactacccaatttcaaaaaggtcgtagtatatagctcatgtcccagaaccagccacgtctcctcgtcgtcgtttcaccgcaacctcgccagcaatgagtattttcatttaaaaatgtttttgtctgctggctatgtgattgcagaggcatggctggccccagcttgcagcggtcgcttctgcatctctttttattcagcggggcctttaatg

SEQ ID NO: 61191 - DNA, 601 bp, Human
gcgagccctgccccagccaggagcactcactgagtggccacattataccctcccgtttgtctatagttcacttaaacattatttcctgggagatccggcagctcttcactcttccgaatcaggctgtgggaaacgtttgtgtgcatctcgctttatttcctctcttgaactattaggataaagtcacagaggtaggattcctggaccccaagctctggacctctactacccaatttcaaaaaggtcgtagtatatagctcatgtcccagaaccagccacgtctcctcgtcgtcgtttcacygcaacctcgccagcaatgagtattttcatttaaaaatgtttttgtctgctggctatgtgattgcagaggcatggctggccccagcttgcagcggtcgcttctgcatctctttttattcagcggggcctttaatggatgtggtggagtaaagctgcctttcaaattgctgccgcagcgctgcctggcaagatgttaatcgttcatgccctgtcacgtggtcatgggacggtaatcctctttgaagccatttgttatttattcttacagtcccccggagagcagggaggagcccccagtgcc

SEQ ID NO: 61192 - DNA, 601 bp, Human
tcctcagctcagctcccacattcccctactccaccctcacccctcagtgctctgtcagaagcgctacctgaccacatccctcctctgggctctgagttcccctgtgcaagtggaaccaatctttcccctcaacttcttccaagggccgtgattgaaacccacctaaaatacaatgataagagctgttgtcgagggatcagacagcagcctgtgtaagatgagcactgggttctggggaaggacggtaaacagttcgccttattctgtgctgggcactgtgcttaagcccagcagcgggccctggctggactcagtgtccagagtgtctctgctcagggctggccgagagtcagcgctttctgtccctgtggcggacagtccgacctctccgaggctgccatagagactcatatcagccaggcgagctgggagcgccaccactccccagatagttactgcccgggcctccctgcccagtcactgcatgggggggggctcagctcctgggtgtgagtttgtgccaggctccagagaggtggggaccccagccacacccagggacagggccaagtggccaagagaccacttaaatgccagcgtg

SEQ ID NO: 61193 - DNA, 601 bp, Human
gatcagacagcagcctgtgtaagatgagcactgggttctggggaaggacggtaaacagttcgccttattctgtgctgggcactgtgcttaagcccagcagcgggccctggctggactcagtgtccagagtgtctctgctcagggctggccgagagtcagcgctttctgtccctgtggcggacagtccgacctctccgaggctgccatagagactcatatcagccaggcgagctgggagcgccaccactccccagatagttactgcccgggcctccctgcccagtcactgcatgggggggggctcagctcctgggtgtgagtttgtgccaggctccagagaggtggggaccccagccacacccagggacagggccaagtggccaagagaccacttaaatgccagcgtggccaccccatgtaaagcaatgatctctctgaaattgctcatctggtatacaccaggacactggcctcttcttccttctcccatcctgggatttaagaagttaaaacccaccccctctgcccaggaagccgaggcagcagcttggagccagagccggaggcagagcggctccatccgtggggagccgcgccacct

SEQ ID NO: 61194 - DNA, 601 bp, Human
tgcagatgctgcctggagctgtctggtttgacatggctccctctgagggagctgatgagtgagggccaggagcactacttcatcaggcatcccctcacctgcaccaatggggaggcgaacctggagctgggccattaagacccacagattgttttctccatgttgcgaagggcagggcttggatttcacgaggcagatggtgagccaagtccggttccgctgcgctgggtcccccatggcagaaaggacccgcccccccatcaccctgacagtggcttgcatgcccaagagcagccagcayccaggacaggcttccctcgttcctctgttcatcctctttaagaatcactcagagccaggcacggtggttcacgcctgtaatcccagcactttggtaggccaaggtgggcggatcacctgaggtcaggagttcgagaccagcctggccaacacggtgaaaccccgtctctactaaaaatacaaaaattacccaggcatgatggcgtgcacctgtaatcccagctactcgggaggctgaagcaagagaattgcttgaacccgggtggcgtggtggaagttgcaatgaaccaagattgcaccg

SEQ ID NO: 61195 - DNA, 601 bp, Human
aggactggcctggaacacactgtccagcctgattctgttctctccctggcttctcttgatcaacttcctgtaatgggaggaactctgacacacttcacaaaagggtgtcaaattagttttaaagggaaaaagaactgcagcatgatctggaattcgctttctgccctgcggttccactgtgaaggcaacacgccttcgaggagttgggggatgaggcagtggggccctgtgaggccctgcggtttctatcggagtgctctctgacccccggtgttccctctctgtctctctatgtctttascaggtgtttcccacactttagtcattggcctttcatctcatgatttgggtcatctgtgctatttcttttctttttttctttttttttttttttccgacagggtctcactctgccgcccaggctggaatgcagtggcgcaatcttatctcactgcaacctccaactcccaggctcaggcgattctcctgcctcggcctctggtgtagctgggattacaggcacacatcaccacacccagctaatttttgtatttttagtagagaaggggtttcggtttcaccacgttggccaggctggtct

SEQ ID NO: 61196 - DNA, 601 bp, Human
ctgaggagtccctcctcgtccctgctcaggtgaacacaggaaatggggaagcccagggtggggtgggccgccccatcttccccttagctgatgggcaggctggatgggcagggagggtctttcctgggaaggtagtggcccgggagctgggctggccctcgagtgttgaagatttaacttgaaagccatgagggcgctcttccccagaaatcatcgtggaagcggcgaatgagtggcaggaggtgcatggagagtcctggctctgcaggcgagcagcctgccccagctctttcctccttaraattgtgtgactttagccacatcatttagaagacacagatgatagaggtggtagaaatggaaagtgcaactctctacctgctgttgcccaccaccaggacgaccactgcaaatagtgtgggtgacccgttcagacctgggactcagccacacattggcccctgaggcagatgaagtccccagcagatggggagatgcagcattgctctgagggagcagcaggagtgaggacaggagctgccacgtgcacaggagcaggagggaaacaggcaggcagctgtgcccagggccaagtgtgcag

SEQ ID NO: 61197 - DNA, 601 bp, Human
aggcaggcagctgtgcccagggccaggtgtgtgggagagaggcaggcacgtgtgcccagggccaggtgtgcaggaggagaggcaggcagatgtgcaggggcagagggggttgaaggatggaaaggtagacaggagaggctgtgaatggctctggatgccgagctgaggcacttggacgtcatgctgacagccctggacctccacgaagggcttttgagaaaagcatggcatgaaaagatctgctgttgagaaatagaaacggggctctggtggcaggttgacaaccatggtccaggcaggrgcttccaaggcaagtggtggaggtgggcgagagggagagttccagggatatccgcgtggatggagccaacacctggagcccagggcaggggggtgggctgaaggggcacctgtggggcccttgcctgtggaggtgagaactgcagcttggagagcagcagaattgccccccggaaggttgctaggggaagattcccagagaagctgaaagcagtagtgctcagaggacaatgagctggcctaggatggtggaggtggaggtgatgaaggcagagggggcagaggccatggtggtggtaga

SEQ ID NO: 61198 - DNA, 601 bp, Human
tgctgggcaccaatgaggtgtcagttcctgttccgggcatgagggattcagcaggaaacgagacagacccaccccctgccctcagtgtcccgctggggccagtcaggtgaacagtcacacaggctggggtaggcgcttggcagaagacacacttgtgacgctcagagctctctggagcagcctctccgaagagatgaaatttgagcaggaaccccaaggaacagcatcccaggtagagggatctgagtctgcaaaggccctgggcacaaaagaaacaaccacccaatccagggctggggargagccctgtcagaggacagcaccagcctccccacgtggatgcccgaccagcatctgaggccagacacagccgccactggctccagggctcccccacaccactgcacccacaactcccctgtttcagaaactgaccactcacctctggaaacccaggagccacctgcacccctgtcttccccctacaccccgcatctgtccgaagaccctgcggtctcagcctcttggattgccagccactggtcacctctgtctccccgcccttgcccaggtggccccagctcacacctgcattgcctcg

SEQ ID NO: 61199 - DNA, 601 bp, Human
aggacagcaccagcctccccacgtggatgcccgaccagcatctgaggccagacacagccgccactggctccagggctcccccacaccactgcacccacaactcccctgtttcagaaactgaccactcacctctggaaacccaggagccacctgcacccctgtcttccccctacaccccgcatctgtccgaagaccctgcggtctcagcctcttggattgccagccactggtcacctctgtctccccgcccttgcccaggtggccccagctcacacctgcattgcctcggagactcctgacracacccaccccctgctgctgcccgggcccccccagcagtcggttctcagtgatcttgagaagcaccactcagctcaccctacgaggaggcctttggctgttcccgtatttgtctctggacttctctgctggccatagaacaagactgtgctttagagggtggactcccagaactgccactcaccaggtgaccaaggcaggccagctttacctctccaagcctcagttttctcagctgtcatttgtgcctaaaacatagtactaacctcataggattatggggcaaaaattacgctgaatg

SEQ ID NO: 61200 - DNA, 601 bp, Human
ggatgcccgaccagcatctgaggccagacacagccgccactggctccagggctcccccacaccactgcacccacaactcccctgtttcagaaactgaccactcacctctggaaacccaggagccacctgcacccctgtcttccccctacaccccgcatctgtccgaagaccctgcggtctcagcctcttggattgccagccactggtcacctctgtctccccgcccttgcccaggtggccccagctcacacctgcattgcctcggagactcctgacgacacccaccccctgctgctgcccrggcccccccagcagtcggttctcagtgatcttgagaagcaccactcagctcaccctacgaggaggcctttggctgttcccgtatttgtctctggacttctctgctggccatagaacaagactgtgctttagagggtggactcccagaactgccactcaccaggtgaccaaggcaggccagctttacctctccaagcctcagttttctcagctgtcatttgtgcctaaaacatagtactaacctcataggattatggggcaaaaattacgctgaatgaacgcacgggaaagcccttatccc

SEQ ID NO: 61201 - DNA, 601 bp, Human
gtctctggcatcctctcctcctcccgtcaccctcgccaggcagtgaggtcagaggctaggctcgcaggcagcatgggaaccacttggccagaagtttcctctttgacctgaaggagttcccccttccagactcagagtgtccccacagaagggcagggctgtggcttggacccatgtggggctccagcccccagaggagcaggacagcatgtgctgtacacagcaagaggatttgcacttttgccttaattttattacagacggggtcaccttccttttttttttttttttttttttttttgttttttgagatggagtctcactctgtcacccaggctggagtgcagtggcgggatctcagctcaccacaacttccacctcccaggttcaagtgattctcctgcctcagcctaccaagtagccaggactacaggtgcccgccaccatgcccagctactttttgtatttttagtagagacggtttcatcatgttggccaggctgatttcgaactcttgacctccggtgatccacccacctcggcctcccaaagtgctcagattacaggcgtgagcccctgtgcctggcctcaccttcctttt

SEQ ID NO: 61202 - DNA, 601 bp, Human
ctgtaagcccagcactatgggaggctgaggcaagaggacagtgtaaggccaagagtctgagaccagcctgggcaacataacaagattctgtctctataaaaaattataaaattagccgggggtggtggcacacacatgtagttccagctacttgggaggctgaggcagacggatcacttgagcccaggagttcaaggctgcagtgagctgtgatcatgccactgtactccagcctgggcaacagagtaagttcccttctcctaaaaaaaattaaatgaaataaataaaactgtaaaaactrttcttagctcgagggctgcacaaacacaggtgacaggctggcgcagcagttttccaacccctgtcctacagcaaggagggaagccgtcacactgcactctctgctggccagccggtgtgcagtgttgctcaggttctgggtgcctctgtcatttaggaaggaatcagcaccattaaaagagagtggcagggtgctgatgttccagagagaaactgtgccgaatgatggctaattaaggctctggagttgggcactggagcaccggactccctgctctccaaagcccagcttgccagcctc

SEQ ID NO: 61203 - DNA, 601 bp, Human
aacctgatactcagcctcttccatgacaagaacacaccaggatcgcgtccctttccaagcagaattttcccgaagccccaccctcctggactcgggttatggaccgccacaggccaccccagctggaagaaaattcaggaaatataggggtcatgggtgacaggtgggccagccagcaaccgtatctaccacatttttaaaatttctatttttattatttatttatttttgagacggagtctcgctctgtcacccaggctggagtgcaatagtgcgatctcggctcgctgcaacctctgcytcctggattcaagtgattctcttgcttcagcctcctgagtagctgggattacaagtgcccaccaccatgcctggctaatttttgtgtagagatggggtttcaccatgttggccaggctggtctcgaactcctgacctcaggtgatctgcccgcctcggcctcccaaagtgttgggattacaggcatgtaatcccacctgtaaacctgtaaggccaccacacccagcctaaaatttttattttcatatatattttttgagacaaagttttgttctgtcacccagctgaagtacagtggcac

SEQ ID NO: 61204 - DNA, 601 bp, Human
tttcccgaagccccaccctcctggactcgggttatggaccgccacaggccaccccagctggaagaaaattcaggaaatataggggtcatgggtgacaggtgggccagccagcaaccgtatctaccacatttttaaaatttctatttttattatttatttatttttgagacggagtctcgctctgtcacccaggctggagtgcaatagtgcgatctcggctcgctgcaacctctgcctcctggattcaagtgattctcttgcttcagcctcctgagtagctgggattacaagtgcccaccaycatgcctggctaatttttgtgtagagatggggtttcaccatgttggccaggctggtctcgaactcctgacctcaggtgatctgcccgcctcggcctcccaaagtgttgggattacaggcatgtaatcccacctgtaaacctgtaaggccaccacacccagcctaaaatttttattttcatatatattttttgagacaaagttttgttctgtcacccagctgaagtacagtggcacaatcacagctcactgcagcctcgaccttccaggctcaagccatcctcctgcctcagcctcccaag

SEQ ID NO: 61205 - DNA, 601 bp, Human
tgtgtagagatggggtttcaccatgttggccaggctggtctcgaactcctgacctcaggtgatctgcccgcctcggcctcccaaagtgttgggattacaggcatgtaatcccacctgtaaacctgtaaggccaccacacccagcctaaaatttttattttcatatatattttttgagacaaagttttgttctgtcacccagctgaagtacagtggcacaatcacagctcactgcagcctcgaccttccaggctcaagccatcctcctgcctcagcctcccaagtagcctggactgcaggtrcacatcaccatgcccagctaatttttttattttattttttgtagagacagggtttctccatgttgcccaggctggtcttaagttcctgggctcaagcgatccacccaccacgggctcccaaagtgctgagattacagagatttcaggcacgagccaccatgtgccatgtttattgagccagcttaaatatttggcttaaacacatacacccaaatgtggagctgctgttgactccatgatgcagaagtttctttttctttttcttttttcccagttttttctattgtggtaaaggtacat

SEQ ID NO: 61206 - DNA, 601 bp, Human
cagttcagtggtattgagtgtgtcattcagtggcattgagtgtacagttcagtggtattaggtgtatagttcagtggtatcgagtgtgtagttcagtggtattgagtgtacagttcagtggtattgagtgtctagttcagtggtattgagtgcgtaaattcagtggtattgagtgtacagttcagtggtatccagtgggtagttcagtggtattgagtgtatagttcagtggtattgagtgtacagttcagtggtactgagtgtatggctcagtggtattgagtgtacagttcattggtaytgagtgtacagttcggtggtattaaggatacagctagttggtattgagggtacagctcagtggtattgagtgtataattcagtggtatcgagtgtgtaattcagtggcattgagtgtacagttcagtggtattgagtgtgtagttcagtggtattgagtgtacagttcagtggtattgagtgtacagttcagcggtattaagtacattcataatatatgcactaccatcaccaccatccatctccagaacctttttattctcccaaactgaaattctgtccccattaaactggaacttcc

SEQ ID NO: 61207 - DNA, 601 bp, Human
tgagtgtgtcattcagtggcattgagtgtacagttcagtggtattaggtgtatagttcagtggtatcgagtgtgtagttcagtggtattgagtgtacagttcagtggtattgagtgtctagttcagtggtattgagtgcgtaaattcagtggtattgagtgtacagttcagtggtatccagtgggtagttcagtggtattgagtgtatagttcagtggtattgagtgtacagttcagtggtactgagtgtatggctcagtggtattgagtgtacagttcattggtattgagtgtacagttyggtggtattaaggatacagctagttggtattgagggtacagctcagtggtattgagtgtataattcagtggtatcgagtgtgtaattcagtggcattgagtgtacagttcagtggtattgagtgtgtagttcagtggtattgagtgtacagttcagtggtattgagtgtacagttcagcggtattaagtacattcataatatatgcactaccatcaccaccatccatctccagaacctttttattctcccaaactgaaattctgtccccattaaactggaacttcccattccccctcccc

SEQ ID NO: 61208 - DNA, 601 bp, Human
atctgcctgccttggcctcccaaagtgctgggattacagacatgagccaccatgttcagcctttgcgtatctttttatccatcagtgaacctgggttgtttccatgttttagctattgcaaatcatgctactgtgaacacacgggtacaaatatccctttgagaccctgtttgcaattatttagggtatatccccagaagtggaattgctagatcatatagtaattcgacttttagttttcaaagaaccaccatactgttttccatagtggctgtaccattttacattcccaccaacagtacacagggtccccatttctccacatcttgccaacccttattattctgggcttttttatagcggccatcctaatggctgcgaggtagtatctcactgtggttttgatttgcatttccctaatggttactgacgttgagcaccttttaatgtgtttattagccatttgtgtcttgtctttggagaagtatctattcaagtcctttgccgtttttgtaattgggctgtttggttttctgttgaattttagttctctatgtattctggatattaattccttatcagatatgggatttgcaagtat

SEQ ID NO: 61209 - DNA, 601 bp, Human
ccatcagtgaacctgggttgtttccatgttttagctattgcaaatcatgctactgtgaacacacgggtacaaatatccctttgagaccctgtttgcaattatttagggtatatccccagaagtggaattgctagatcatatagtaattcgacttttagttttcaaagaaccaccatactgttttccatagtggctgtaccattttacattcccaccaacagtgcacagggtccccatttctccacatcttgccaacccttattattctgggcttttttatagcggccatcctaatggctgygaggtagtatctcactgtggttttgatttgcatttccctaatggttactgacgttgagcaccttttaatgtgtttattagccatttgtgtcttgtctttggagaagtatctattcaagtcctttgccgtttttgtaattgggctgtttggttttctgttgaattttagttctctatgtattctggatattaattccttatcagatatgggatttgcaagtattttcactcactctgggttgccttattactgttgatagtgccttctatttttctttacctatttatttatagaggtggg

SEQ ID NO: 61210 - DNA, 601 bp, Human
cagtgaacctgggttgtttccatgttttagctattgcaaatcatgctactgtgaacacacgggtacaaatatccctttgagaccctgtttgcaattatttagggtatatccccagaagtggaattgctagatcatatagtaattcgacttttagttttcaaagaaccaccatactgttttccatagtggctgtaccattttacattcccaccaacagtgcacagggtccccatttctccacatcttgccaacccttattattctgggcttttttatagcggccatcctaatggctgcgagrtagtatctcactgtggttttgatttgcatttccctaatggttactgacgttgagcaccttttaatgtgtttattagccatttgtgtcttgtctttggagaagtatctattcaagtcctttgccgtttttgtaattgggctgtttggttttctgttgaattttagttctctatgtattctggatattaattccttatcagatatgggatttgcaagtattttcactcactctgggttgccttattactgttgatagtgccttctatttttctttacctatttatttatagaggtgggtctt

SEQ ID NO: 61211 - DNA, 601 bp, Human
gaacgttgctttgaagagattgaaatttctagcttgtgatcttcttgaaaattgttaatgaggcgttgatgtgatgtaccatcaaatgctccgttcggcagtcatgaccttgggcaccgtggttaggtcccaatgcttctgctgttgactgaaccatgtgacatctgtcgccgtgccactggtcccctcggctcaggcctcaggagattggaggagagactgaggtttctctgtgacaaacacagggaatcctgactgggatctccaatctctagtaaggtttgcacagttcttctcctcrcatttctttggctgcatctgagccaaagtctggatggagctgtcggggaactgggttatgttgacctcccaacccctgcccaccctctggggtgtccttctgacaaatgggcctttcttccagatccccatcatgacccaccaggccaacggccccctagggtcttgaccccagtgcactcagagtcagcacctgccttcgttgcagcattgaccctctgccatcagatcccacccagggaaggaatgggctcctgtgtgggcgcctggcttctgggtgagaggggaagtgtgtgttgtg

SEQ ID NO: 61212 - DNA, 601 bp, Human
aaaaaatacaaaaaaattagccaggcatggcagcgtgtgcctgtagtcccagctactcagaaggctgaggcaggagacttgcttgaacccaggaggcagaggctgcagtgagccgagatcgcgccattgcactccagcccgggcgactgaagagactccatctcaaaaaaaaaaaaaaaaaaaagatgagccttttctgggaaagtggaaaagacagagaagcctcctgacagccaaggagaccagcagccagtagagcaggtgttgtaacaaggccgaggaccctcagacaccaattttkctggtaagaccgctgcccaggatgcaccgtacaagagcagcttcacctgccttcatgcagatggcacagatgtccaggaagcagctgtggtcagtgactccccaggagtcacacccagacctggggccagagccatccctgcacctctgcctgatgtgacaccagggcggggcacaggctagtcccagctcctgcagcccccgctgcacacccctacctgttagcacactgagtcctccctcattatcatcccattttacagatggagaaactgacacagggaaggctgagagaattgcc

SEQ ID NO: 61213 - DNA, 601 bp, Human
caggagtcacacccagacctggggccagagccatccctgcacctctgcctgatgtgacaccagggcggggcacaggctagtcccagctcctgcagcccccgctgcacacccctacctgttagcacactgagtcctccctcattatcatcccattttacagatggagaaactgacacagggaaggctgagagaattgcccaaggtcatagaccagcacatggcagagccagtgccaactccaaagcccagatccgaaccactgagtgggcctaacctccttcccaggaacccagactgatcrcctcaggtcacccaaaggggatggaatagtgtcatcaaccagctcccaaagaagatcagagcatgtgcagtcagcactggcaagatttcagcttagagagagatcctctccagcctcaaagtaccgactttggatcaagacttctcactaaaggaaggttccggccagctcaaattttttgtactccagaatctgcaataaagagacagataatgtcttttgcagaaactggaagtaggtttccaggtacccactggacttataattcaatgtttataagtatgaccctggagattaaat

SEQ ID NO: 61214 - DNA, 601 bp, Human
gctcttccttgtgtgtccttgcctagaattatgtatgggtccaccttttccaaaaatctgccagccctggccgggtgcagtggctcacgcctgtaatcccaaccctttgggagactgaggcaggaggatggcttgagcccaggagtttgagaccagcctgggctgcagagtaaggcctcatctctattaaaaaaaaaaaaaaatagccaggctgggtggcacacatctctgatcccagctaattgggaggctgaggtggaaggatcccttgagccccataggtcagggctgcagtgagccrtgatcatgccactgcactccagcctggggaacaaagcaagaccctgtctcaaaaaaagaaagaaagagagaggggcatggggcagcgtggagaggaaactgccagccctaaatctcatgacttaggcttgccccaggagccagagtcccataaaggggcactatgggccttccatcagtccctgaaagagtctcaccagcaatgccttcctggggctatggctttgatgacagttcaagacccccaggatccctttctgtgtttaaacaaacttggcttcctgtcctctcaccaactctt

SEQ ID NO: 61215 - DNA, 601 bp, Human
aaccgaatattcacacagccttcaagaacctcccctgtgattcctggttaatcatgaaaaaaagaaagagcagtggccggttgcggtggctcacacctgtaatcccagcactttgggaggccaaggcaggcagatcacaaggtcaagagattgagaccatcctggccaacatggtgaaaccatgtctactaaaaatacaagaattagctgggcatggtggcacgcgcctgtagtcccagctacttgggaggctgaggcaggagaatcacttgaacccaggaggcagaggttgcagtgagcyaagatcatgccactgcagtccagcctggcaacagactgagactctgttaaaaaaaaaaaagagagagagagagaaagcaagcaagaaagaaagagaaagaaagaaaaggaaggaaagaaggaaggaaaaagaaaagaaaagaaagagctatgccctggcagacaccaccttaaccaaatggccagacctggtcttgccctcgatgggcaaacttgcttgttcgcccctgcctggacgcatgaaaaggaaaagacctccccaaaaaggttcagctaaattgaatcctgaagctacaatcag

SEQ ID NO: 61216 - DNA, 601 bp, Human
aaaagaaagagcagtggccggttgcggtggctcacacctgtaatcccagcactttgggaggccaaggcaggcagatcacaaggtcaagagattgagaccatcctggccaacatggtgaaaccatgtctactaaaaatacaagaattagctgggcatggtggcacgcgcctgtagtcccagctacttgggaggctgaggcaggagaatcacttgaacccaggaggcagaggttgcagtgagccaagatcatgccactgcagtccagcctggcaacagactgagactctgttaaaaaaaaaaragagagagagagagaaagcaagcaagaaagaaagagaaagaaagaaaaggaaggaaagaaggaaggaaaaagaaaagaaaagaaagagctatgccctggcagacaccaccttaaccaaatggccagacctggtcttgccctcgatgggcaaacttgcttgttcgcccctgcctggacgcatgaaaaggaaaagacctccccaaaaaggttcagctaaattgaatcctgaagctacaatcagacaaatccaaagcaagggactgtcagcaggacagatgacctaaacgtttcaaaaaaggt

SEQ ID NO: 61217 - DNA, 601 bp, Human
aaagaaagagcagtggccggttgcggtggctcacacctgtaatcccagcactttgggaggccaaggcaggcagatcacaaggtcaagagattgagaccatcctggccaacatggtgaaaccatgtctactaaaaatacaagaattagctgggcatggtggcacgcgcctgtagtcccagctacttgggaggctgaggcaggagaatcacttgaacccaggaggcagaggttgcagtgagccaagatcatgccactgcagtccagcctggcaacagactgagactctgttaaaaaaaaaaaagagagagagagagaaagcaagcaagaaagaaagagaaagaaagaaaaggaaggaaagaaggaaggaaaaagaaaagaaaagaaagagctatgccctggcagacaccaccttaaccaaatggccagacctggtcttgccctcgatgggcaaacttgcttgttcgcccctgcctggacgcatgaaaaggaaaagacctccccaaaaaggttcagctaaattgaatcctgaagctacaatcagacaaatccaaagcaagggactgtcagcaggacagatgacctaaacgtttcaaaaaaggtc

SEQ ID NO: 61218 - DNA, 601 bp, Human
gtgcgtgtatgtgtgcattgcatgtgtgcctgtatgtgtgcatgtctgtgcatgtggatgtggtgtgcgtgtgtgtgcctgtgcatatgtaggtgtgtgcctgtgcatgtatgcatgtgtatgtgtgtacatatgtgtgtggagagaggaaaaggggaagagaggagcgggaatgcatacaagtgagacaagaggtaaacaattggtgtatgattgcgatcaagagtatatgggtatttattgctattctaattatttccacttttatgaggtttgaaagttttcaaagtagtgagttggyaggaagaaagaaaatgcccaaagagggagcctaccgaccttcctgggtcccctgtccttgtcagccaaccacgtaaagggaaagagctaggatttaatgaccggattccttcctgggctccaagcattttcacatcttgcttctcattgctccgtgagaagttgggcaggcctttctaaatgctccatgcttcagtttctccaaatctaaatccggaagatttgctccaggtcacacgcagaccaagtggaagtggagctgatgggagggacctagcctgtgggctccctgcttggaccc

SEQ ID NO: 61219 - DNA, 601 bp, Human
tgtccttgtcagccaaccacgtaaagggaaagagctaggatttaatgaccggattccttcctgggctccaagcattttcacatcttgcttctcattgctccgtgagaagttgggcaggcctttctaaatgctccatgcttcagtttctccaaatctaaatccggaagatttgctccaggtcacacgcagaccaagtggaagtggagctgatgggagggacctagcctgtgggctccctgcttggaccctgggccctgcaccccgtcagctgctaggctcccctcttgggtctggtgtgttkgtttctgaagcctgttctcccaagtcccggaggtgtcagggatcccggggccacccagcttagctgtgcctgcctccctctgcgctaaaggagccactgtgccagcctggaactcacggcatcccctttaggatgttggctccacagggattggctccttggcagatgcagtcgctcctgattggacagtggtgtctgcagctcgacaaggtggactctgggccagtcggctctgcctgtgtgtcttgcgtcctgaaatgcaaagcaggggctgtggggaaatctcaccaacccctcctc

SEQ ID NO: 61220 - DNA, 601 bp, Human
tctgtggctgcaggctggagagctgactgctggcacagatacagcctgacctcgggtcaacacttctcggagtccagaggggtggggagtgggacaggtggcctcccagggacgcctccctgagtggccagtggtgccgcttgtccctgcacctgtagctgccctgagcacccccactggacacagtgggcattgcaccctccggagaaagctgcccttgttccacgtgcgagccctgtccccagcgccatgggctgtgctacctgcagtaacgcagactgcgagccccggctgcctctcyagtgctctctctcctctggccttcagcaggctgggtcacagaggtatccatccactcattcattcactcaacaaatatctgttccatgtctactaggtgccaggcacagctgggaaccagcagacaaaactccctgctttcccggagccggcatcttggtgggcagacagcataagcgagacgagtaggtggaggagaaggcgtgtgagcaggtgacaggcgctggggagaaacagcccaggggagggaccagggagtgtgggggagacggggactgcgatgaaagggaggcgtccaggg

SEQ ID NO: 61221 - DNA, 601 bp, Human
ctgcgagccccggctgcctctccagtgctctctctcctctggccttcagcaggctgggtcacagaggtatccatccactcattcattcactcaacaaatatctgttccatgtctactaggtgccaggcacagctgggaaccagcagacaaaactccctgctttcccggagccggcatcttggtgggcagacagcataagcgagacgagtaggtggaggagaaggcgtgtgagcaggtgacaggcgctggggagaaacagcccaggggagggaccagggagtgtgggggagacggggactgygatgaaagggaggcgtccagggaagacctccatgagaaggtgaccttggcataaagaggcaaacgtgggagcatgctcaggcagaccacggtggtcagaagttgaattcaggccggaggaggaggagtgcatgaagccctgaggtgggagtgagtctgtctgctgggttcacagaccccccagggagccagtgtggcaggggccagtgtgtgaggggctcagcgggggatgtggctagaaaggttgtggacccactgttgagattggactttggctctgaatggaatggaagccattgga

SEQ ID NO: 61222 - DNA, 601 bp, Human
gtctactaggtgccaggcacagctgggaaccagcagacaaaactccctgctttcccggagccggcatcttggtgggcagacagcataagcgagacgagtaggtggaggagaaggcgtgtgagcaggtgacaggcgctggggagaaacagcccaggggagggaccagggagtgtgggggagacggggactgcgatgaaagggaggcgtccagggaagacctccatgagaaggtgaccttggcataaagaggcaaacgtgggagcatgctcaggcagaccacggtggtcagaagttgaattcrggccggaggaggaggagtgcatgaagccctgaggtgggagtgagtctgtctgctgggttcacagaccccccagggagccagtgtggcaggggccagtgtgtgaggggctcagcgggggatgtggctagaaaggttgtggacccactgttgagattggactttggctctgaatggaatggaagccattggaaggtttggagtgaagcagtgacataatctgacttatgttctgggaggatcaccctggccgcgtagagtctgccggcgggggtggaggtgggcgcagggaatgctgtgagg

SEQ ID NO: 61223 - DNA, 601 bp, Human
agggcagaggctgattggagttggtttataagccggaagaagaagaggaatcgcagataagtgaaggaaaactttttgaggaattttctcaaatggaaggcgagaaacagtggagaagaaagtgggtctaagaaactgcttttttaggccgagtgaggtggctcacatctgtaatcccagcatttagggaggccgaggcgggcggatcacttgaggccgggagttggagaccagcctggccaacatggtgaaactccgtctctactaaaaatacaaaacttagccaggcatggtggtgcaygtctgtaatcccagctatttgggaggctggggcatgagaatcgcttgaacccaggaggcggaggttgcagtgagctgagattgtgccactgtactccagcctgggtgacagagtgagactctgtctcaaaaaaagaaaaaagaaactgtgttttttgttttctttggagatgagagaaataataacttattgggtgcagctggcagtgcgtcctgaagaaggaggaatgggcttgggatgcccttgagtgggtgtggggctggggacagccacgtgaccatggacactgtggggccggtt

SEQ ID NO: 61224 - DNA, 601 bp, Human
ggggtgcagcagtgagtgagacccacagaaccactgccctcctggaacacaccccccccagagagggaactggggcaccacagacccgtgtgcaggcagcaagggcgtggtgtcggccggggagcagcagggacccctgagccccacagtcggggctcatggcgctgagaagcactgcagcaagggcgcagccagtaggagaggagccgcaagcgcaagcatccgcagacagtgtgagctcagcgtgctgggaaggcgggggcctgggtcaagggccaggcggcagagcataggggcctgrgggggcagtgcctaggagtgggaggaaagagcatgggaccagattcactttggaaatagaagcccccaaccagcagccagccaggtggaggaaggcgtgcagagctgagagggttcaggaggcggtggggggagccactgggaggggacccaggggttcaggtgaaagacagcagtggctcagcccaagggtggcagccagagatgtgggtggacggctggatattggcagccatactcattatcaatgctgctgtaacagctcatcacaaaccctgcagcttccaactgcccagagtga

SEQ ID NO: 61225 - DNA, 601 bp, Human
ttctttgggctgttgggctgagggctcagcttctcgccagctgtcggcccgaggctgccctcagttcctgccccaagggcctctccaacaccacagcttgcttcatcagagccaggagggacagtctctagcaagacagaagtgacagtcttgccattacctttgccgtgttctgctggttagaagcgacttgctaggtgcagcccacactccaggacaggggctgcccaagggcaggaatcccaggagctgcggacatcagtggcatctgagaagctgcctgacttaggagctcaatggmagcaccaggaagctgcactgggctggagtcagggcaagggacagtgtcagcgatgaccctgggggacagcagtgcagtcaggagctcagaaagtacacagatgccccctgggcggtctcttctgcaccatgtgggcagcagaaactacacctacggtttcagaacaacagttggggtggtgtggaaggacctccacgacatatagggtgggagtgtggagtgatggagtgtggaaacccttctcacagttgtcacctgctctccagcccctcctgagcccgtggacctgcctgcctgccg

SEQ ID NO: 61226 - DNA, 601 bp, Human
cacactccaggacaggggctgcccaagggcaggaatcccaggagctgcggacatcagtggcatctgagaagctgcctgacttaggagctcaatggcagcaccaggaagctgcactgggctggagtcagggcaagggacagtgtcagcgatgaccctgggggacagcagtgcagtcaggagctcagaaagtacacagatgccccctgggcggtctcttctgcaccatgtgggcagcagaaactacacctacggtttcagaacaacagttggggtggtgtggaaggacctccacgacatatarggtgggagtgtggagtgatggagtgtggaaacccttctcacagttgtcacctgctctccagcccctcctgagcccgtggacctgcctgcctgccgtgtgtctgtctgtcgtctgtctgtctgtctctctgctgaggggctccccgatgccctgaacccagacagcctcctcagcctttgtgatcccagagtctcccggccaaacctggttgatcttttttaaccaccaccctcttcccctcccttattttgcttttcttccagaattttcccactgtaaaaaaccgagcaagtctggata

SEQ ID NO: 61227 - DNA, 601 bp, Human
gcgatgaccctgggggacagcagtgcagtcaggagctcagaaagtacacagatgccccctgggcggtctcttctgcaccatgtgggcagcagaaactacacctacggtttcagaacaacagttggggtggtgtggaaggacctccacgacatatagggtgggagtgtggagtgatggagtgtggaaacccttctcacagttgtcacctgctctccagcccctcctgagcccgtggacctgcctgcctgccgtgtgtctgtctgtcgtctgtctgtctgtctctctgctgaggggctccccratgccctgaacccagacagcctcctcagcctttgtgatcccagagtctcccggccaaacctggttgatcttttttaaccaccaccctcttcccctcccttattttgcttttcttccagaattttcccactgtaaaaaaccgagcaagtctggataagtgaggctggctccatgtatccagaatcaacgacgggctccccggctcggctctcgctgcggcagacgggctcccccgggatgatctacaggtgaccccctgccccctcacccaggccccctcccagggtcagtcctgcttcga

SEQ ID NO: 61228 - DNA, 601 bp, Human; identical to SEQ ID NO: 28210

SEQ ID NO: 61229 - DNA, 601 bp, Human; identical to SEQ ID NO: 28211

SEQ ID NO: 61230 - DNA, 601 bp, Human
cactcctagtagggcaccctcatcacaccaagcataccactaaacatggctattggatggttctttcagttacttaggcctggccctctcacagggcagaggcgttcaaggcatgtgccctgcccccatgcagctcccaggcaaggaattggcataggacactgtgccaatcagctgtccaccaagtgctgcataacaaacaactccaaaactcagtgccacgcagcaatcagcatctcttccttgctcccgtgtctgcgggttgaccaggcagctcgtctaagctggcttggctgggttygtctccaagctgcaagttggatccccatgtcctccatcttcccatgcttaactggggcctaccccaggcatgtccttcccatggcaaaagtaccagaggaaaagcagaaacatgcagggtctcttacggcctatggttggggtcagagcgctgtcacctctgctcacgtgcttttggccaaagtaagtctcaggaaccagcccacagtcaaggggctggaaatatattgcccccaccagtgggaggagctataaagtcacatggcaaagggcatgggtacagagaggggtgaaggattgg

SEQ ID NO: 61231 - DNA, 601 bp, Human
ctttcagttacttaggcctggccctctcacagggcagaggcgttcaaggcatgtgccctgcccccatgcagctcccaggcaaggaattggcataggacactgtgccaatcagctgtccaccaagtgctgcataacaaacaactccaaaactcagtgccacgcagcaatcagcatctcttccttgctcccgtgtctgcgggttgaccaggcagctcgtctaagctggcttggctgggtttgtctccaagctgcaagttggatccccatgtcctccatcttcccatgcttaactggggcctaycccaggcatgtccttcccatggcaaaagtaccagaggaaaagcagaaacatgcagggtctcttacggcctatggttggggtcagagcgctgtcacctctgctcacgtgcttttggccaaagtaagtctcaggaaccagcccacagtcaaggggctggaaatatattgcccccaccagtgggaggagctataaagtcacatggcaaagggcatgggtacagagaggggtgaaggattgggagcaatacttccatgtaccccaggtctcaaatagccctgatgatctccagaaggcagagca

SEQ ID NO: 61232 - DNA, 601 bp, Human
gcatgcgcgtgtgctgagcagaggcctctccagacccccttggctgtgggtggtggccccatacgacggggcccccagctcccctgctgcagacacagttcagagttgagtggtatgcggaagccacaggctctgtgtcccgcactcagataccaaagagcaaggcctgcccctttcgacctgtgggtccaaaggtttgtgtttctggcacgcggggatggtggaggcagcaagggtaggcctgagggacgggcaggacctccccctcaccttgggctgcaccccaaccccacgcaccgggagtcagccttgccaggttgcagcacggaactgcacttcccgagcttttaggggaagaggcactcgtgaataattcagcctctttcactgagatgaaaacgccctaatagaactaatggactcgctgcctcaaaactcgactctggtgggactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcaggtga

SEQ ID NO: 61233 - DNA, 601 bp, Human
gtggcactagttaaaggatgtttcgctgcagctgccccctgccccagggccagccatccagcctggggcacgtggggcattggcacactgtctaactcatcaccgtctggacagtggcagctcccaagccaggcggcaccatgctgtccatgacgtacagcgagagtctgcggagcgtgagcagcaggtgccactctgaatgggccctgcaccccgtccgccagacggacacgctggaactgcagcggctgcgggaggtgcgggcggctgcccaggccaggaacatggagagcttcctccrcatgcacggcctttccctggacggctgcaccgcccagcgcacaggcatgaagtatcggtaagggccgggcaggggggcggtggggtgggaagtctgatttcagccatataaatatgtataaaagggctgggcacggtggttcacacctgtaatcccagcacttggggaggcagaggcgggtggatcacctgagatcaggagctcgagaccagcctggccaacctggtgaaacaccacctactaaaaatacaaaaaatagccaggcatagtggggcgcacctgtagtcccaactactcagg

SEQ ID NO: 61234 - DNA, 601 bp, Human
ccttgttctgctggaaatttctcaagaaggagacgctgggcattcatgaggggctggtcattgattccttttgtttattcagtaaatgtttattgagagtctgcttggcaccaggcgctgagccagatcctggagctgctgcatgaacaagagcaaccaggtccccaacctcacggcagccatggcctgggggtgtggggggcagagaagcagcgagcttgcacggagacaagttccaacagcgaccactggccgaggcagcaaagcaggacaatgcaatgaagaaagaccagggaggccragggggaaccctctgagagagggatcatctgaagatgtggagaacattccagcccaagaggagaggggtctggaatggatgcctctctcagctggaggagcgaagagaaggcccaggcggctaggctggagggaggaaggtggaggacacaaggcgatgatgcaggaggggccagaccccatcctccaaactcagggaaacctcagctctctcctatgtggacaggatttgtgatggaggatagtttagtgggttaaatcaagaccccccaaaattcacattcatcctaaacctcagaat

SEQ ID NO: 61235 - DNA, 601 bp, Human
cccccaaaattcacattcatcctaaacctcagaatatgacgttaggctgggtgtggtggctcacgcccgtagtctcagcactttaggaggcagcctgggtaacatggcgaaaccccatctctaaatacaatcaaaaaattagccaggcatggtgacacatgcctgtggtcccagctacacaggcggctgatgcaggaggatcacttgaacccaggatttcaacgctgcagtgagccctatttgtgccactgcactccagcctgggcggcagagtgagaccctgtcttaaaaaaaaaaaaaraagaagaagaagaagaatgtgacattatttggaaatagggtcattgcagatatcattaagatggggcaatggggccatacaagactagaatggaccctaattcctacgactggtgtccttataagaaggccatgtggtgatagagagtggagtgacgggtccacaacccaagggactctgaggagtctcggtgttaccggtggagggtgtgcagccaggttcctggcatcttgaacaaagaattggacaaaacgcacatacaaagcaaggaaagaatgaagcaacaaaagcagccgggtg

SEQ ID NO: 61236 - DNA, 601 bp, Human
gggtgtgcagccaggttcctggcatcttgaacaaagaattggacaaaacgcacatacaaagcaaggaaagaatgaagcaacaaaagcagccgggtgaggtggctcacgcctgtaatcccaacagtttgggaggccaagacgggtgggttacatgaggccaggagttcgagagcagcctgggcaacatggcaaaagcctgtctctactaaaaatacaaaaattaaccagtcgtggtggcgggcacctgtagtcccagctattcgggaggctgaggcaggagaatcacttgaacctgggaggyggaggttgcagtgagccaagatggaacaaaagtacactccacaggatgggagtgggcaagcggctcaagaacctggatacagaattttctggggtttaaataccttctagaggtttcccattggttacctggtgtacatcttatgtaaatgaagtagtggcctgtgatcattctgattggttgcagaaagtgaccaattagaggctgaaatgaagttacaaagttacacttctatgcaaatgaagacttggcccacagccagcctgattggttgcgggaggggacaaatcagaggtattt

SEQ ID NO: 61237 - DNA, 601 bp, Human
cccaaggattgactcaacaccttgagcctgcggggacatccctgagtgtcctgggaggaacccgggctcccaccggctacctgtgtgacctcagacaagtcccctggcctctccatgactcgatttccttacccggaaagtggagaccggggtcactacagcagaattgtcctgaggactaaataagctccaggtgacataactcaaagctccaggcttggctcattgtgggagagaaatgcaggcccttcccgtccctggaaaagggaccttcccacacagcagtcgctgtccaggcacytggactgtcccctgtctatccatcttggggtctcactcgtgcacctagtctcacttagagatgtagttcagtgccgcgcagacaaggggcggaggcatcaggaaggaacaggaggagggagggaggcgagcagccagtcattccggaagagctgccgggccagacgcaggggctgggagaaagccagctggcaggcccagtgctctccttgagggcctgcccaggaccacggctggcagctgtgtggggcttgggtcggggctgggagggcttctgctggcagcgggcaccacattggag

SEQ ID NO: 61238 - DNA, 601 bp, Human
atgggccccgccagtgggatgtgcgctctgggcaaggctcacatgtcctgtcatcggtcctgtggcctcctccttccctcggcctcccactgtccctccgtgtcaagtctcccaccatctgatgcgccctctggcaaggccagtgagtcaccctactccagacacagaacctgctgctgcctcacaggctcccgccatctgccctcctgcctctgctctcaggagaaggacactcctggaattccacatggatcccaccttctccctggagccctgccatactcctgggcaccgctgatgygctctcctgctggctgacttggccttgaacacgggtggctcaggcctttcccagggacccttgcttcatgccccagctggaggaagccacactcacagcacttagcccctatggggtcttcagctcttactctcctggtggactcctcctccaggaaggccaccggccctgcctccctttgttcttagaaactgctcctttggggcagcccctcaactgttcaacatcctctgcccttccttgggcaagaagccacctttgggtgtaaaccacactccgttcagcacggacaaggcggtc

SEQ ID NO: 61239 - DNA, 601 bp, Human
tcatcttatcaacagcaggtaccggagagacagaaaaagaaccagaaatgggttgtaggttgaagtcaaccagccacgctccatgcctctgaccaaagcctaccagcactgggccgggcggtggctcacgcctgtaaccccagcaccgggccgggcgggggctcacgcctgtcatcccagcaccgggccgggcgtgtccccacacatgaatgttccaggcttcccttgtctggacgatgtgatcagggagacaccatcccagattctggctggtaacagagcaggcctcctcaaccctggyaccattgacacttgggctggacaattctctgtcatggggcagcatccgtggcctctgcctactgccagtagcacctcctgcccagttgggacaaccaaaaatgcctccctatgctgcccagtgttccctggggaacaaaacccctcccaggtaacatgcactgatacagagtaatcatctctgccaccaattttcacagattataacggaatataatgtgcataatgcaaaaattatattgaattctttttaaaattaccctccaccccaccttattccaaaaaggattgtaggtgacgt

SEQ ID NO: 61240 - DNA, 601 bp, Human
ctcctgcctcagcctcccgagtagctgggattacaggcgcccaccaccacacctggctaattttttatttttatttttaatagagacggggtttcgccatgttggccaggctggtctcaaactcctgacctcacgatccacctgcctcagcctcccaaagttctgggattacaagtgtgagccaccgtggatatttcatatgaatggaatcatacgtgttctttcatgaccgtctttaacttagcatcatgttttcaaggttcatctgtgcctgtgccagtaattttttttttttttttttgagacagagtcttgccctgtcacccaggctggagtgcagtggcatgatctcagctcactgcaacctccacctcccgagttcaagcaattctcctgcctcagcctcccgagtagctggcattacaggtgtgtgccaccacagccagctaattttttgtatttttagtagaaatggggtttcaccatgttagccaggctggtctcaaattcctgacctcaggtgatccacccacctcagcctcccacagtgctgggattacaggcatgagccaccacactggacacttccttctttttatgg

SEQ ID NO: 61241 - DNA, 601 bp, Human
agtgcagtggcatgatctcagctcactgcaacctccacctcccgagttcaagcaattctcctgcctcagcctcccgagtagctggcattacaggtgtgtgccaccacagccagctaattttttgtatttttagtagaaatggggtttcaccatgttagccaggctggtctcaaattcctgacctcaggtgatccacccacctcagcctcccacagtgctgggattacaggcatgagccaccacactggacacttccttctttttatggctgaataacacttcattttctggagagggctayatcctgtttctccatttgtcggttgatgggtgtttgggttgtttccagtttggggctattgtgaataaggctgctgtggacatttgtgttgaagtttttgtgtgggcgtatgttttcagttatttgaggacatagctagcggggggattgcctggtcatgtggtgaggccgatgacattttacacttggtgactgaaagtctcgtgagtctccctgaactctgtgctgcttaacgtgcaccactggggtaagaacacccctggggaagagtaagatgccagccattgtgggatccgatgt

SEQ ID NO: 61242 - DNA, 601 bp, Human
tgaagtaaagtagggcaggggcttcattcagccattcactcactgattgcagagtatgtattgagcgtctgctgtaacctaagttttactgggagtgttggaatctctctgtccctttgacccccgcgtttccttccttgggccatctgtgtcataaccatcaagacgcagtggcttcttcacatttctggtgatgttgcttctccatgtgccaatcccccagcggataccccactctccggagggagaaccccaagcaggtgccgctgggcatgcgccagggaggctgtgaccggagcargcactgccttgcttggagctggctgcctacaagctcagacatccagcccgcagagtccaccctggctgcagcgcctgcccaggcctcaggccagtcctggctcagcagctgtcagcccggagcagccagcgatggcctcaggggaccagccaaggcaggcggcttgtgcatcctgcttcattaataatgaatggccagacgctgcccgcgcctctccctggtcgcctcattgacatggtgggagcctcagccgcccacagcgcgcagagccaggagctggatcccaggccccctcagaaa

SEQ ID NO: 61243 - DNA, 601 bp, Human
gctccacaagatgccctgggggtggtctgatatctttccagccaggccaccatgacaaacatccgtttgatagtgagggactgtggggtgaaccctgtgatggaatgaatcttccctcctccacctgagccaggcccagggcccaattcctctagcaggcgggactcttgctccagcaggcacaggcagccaggccgcatctggagtttcccgatggtcagcccaggcaccttgcttccctccacccgggctcagcccccatctggctcccggtgctgtgacttgtatgtggggaggatgscgaccactcatgtcaggagcagggcctccctcctcttccctgccggggcctttctccaaggctgggtgaatgtgcccaggatggaaaagggagggtcccagctttgtacaaagggtcccgggagcagggttctggggcacccttctgggggccggccttcctcactccccatgtaagtctctgagtccagagccttgattgcgtccagaaccatcctccaggcataaaggaagtctccacaacacgtggtctacagaagctggaaaagctaaattaggtctctggttcccaggtttcctg

SEQ ID NO: 61244 - DNA, 601 bp, Human
attctgggttggaacatgccagcaattcagagggtactatcaagagtatttcactgatgtataaggaggaaaaaggaaacttcagttcctttttaacatggtaatagttaaagcttatttgatttgtccattgtttttgaataaagaaaaggttaccctcctgctctctttgggaaatgagacacatgtgagtcagtgtcctgtggccttctatcctcatggatcttcttctgtcctcgtggcagccaccgtgagaaaggcagcctcgtgagcccattctgcagatgagaacactgaggcwtcgggccactccataaaatgcccggtgtcctccagccaggaaagttgtaccaggatttgggctctggcttcagagcctcagcccatagccgccacccggtgcgcccctttcctgaaagaaaactcagcttttcttatgttctcctttagggaaaatcccagctctgcctacaggagcaatattgctggcagctggagtggttttaataggaaattgaaaaataaacctaggcaattttaaagtaccttcagtttggtgacacgttcaactgttttcaagctgcttacaaatattatatcc

SEQ ID NO: 61245 - DNA, 601 bp, Human
acatgtgagtcagtgtcctgtggccttctatcctcatggatcttcttctgtcctcgtggcagccaccgtgagaaaggcagcctcgtgagcccattctgcagatgagaacactgaggcatcgggccactccataaaatgcccggtgtcctccagccaggaaagttgtaccaggatttgggctctggcttcagagcctcagcccatagccgccacccggtgcgcccctttcctgaaagaaaactcagcttttcttatgttctcctttagggaaaatcccagctctgcctacaggagcaatatkgctggcagctggagtggttttaataggaaattgaaaaataaacctaggcaattttaaagtaccttcagtttggtgacacgttcaactgttttcaagctgcttacaaatattatatccactcatgagttaggagtccaggagccttataaccagggaaaccgaggctgagagggacagagtgggctcgtgtcagaagtcgggggttcagaatgaggcttgagccccatgccgccttcccaggggccaggcttggacaggaaagaggataaactgaggacatcgcatcctccgaagttggaa

SEQ ID NO: 61246 - DNA, 601 bp, Human
tggctgcagctgtgagatccacccggccacttgtcaacctcaccatctgggcagatcacgccctgcttaacaggctggggtgtgggatgcatgccaccatggtggggaacgtgagctggcagccaactgcctgggtgggatccagctcctccgcgtgctgggcaggtatcgtaacgtgggaatcgatgtcacgacaagcaaggcgcctgctgcgtagggcacctgccgcttaggactcctgccaccgcgtagggctctgctgcgtaggactcctgccgccgcatagggctctgctgcgtargactcctgcggcgagggctccctcctgccgcgtgggctcctcctgccgcgtgggctcctcctgccacatagggcacctcctgccgcgagggcacctcctgccgcatagggcacctcctgccgcgagggcacctcctgccgcgtgggctcctcctgccgcgtagggctcctcctgccgcgtagggctcccgggaggatccggggacaggatgcctggggactgcctggcctgctgcaaccctgcaggctcctaggcaacctgtgccaggacatacgggcatgccggtcctcagcagagggc

SEQ ID NO: 61247 - DNA, 601 bp, Human; identical to SEQ ID NO: 28212

SEQ ID NO: 61248 - DNA, 601 bp, Human; identical to SEQ ID NO: 28213

SEQ ID NO: 61249 - DNA, 601 bp, Human; identical to SEQ ID NO: 28214

SEQ ID NO: 61250 - DNA, 601 bp, Human; identical to SEQ ID NO: 28215

SEQ ID NO: 61251 - DNA, 601 bp, Human; identical to SEQ ID NO: 28216

SEQ ID NO: 61252 - DNA, 601 bp, Human; identical to SEQ ID NO: 28217

SEQ ID NO: 61253 - DNA, 601 bp, Human; identical to SEQ ID NO: 28218

SEQ ID NO: 61254 - DNA, 601 bp, Human; identical to SEQ ID NO: 28219

SEQ ID NO: 61255 - DNA, 601 bp, Human; identical to SEQ ID NO: 28220

SEQ ID NO: 61256 - DNA, 601 bp, Human; identical to SEQ ID NO: 28221

SEQ ID NO: 61257 - DNA, 601 bp, Human; identical to SEQ ID NO: 28222

SEQ ID NO: 61258 - DNA, 601 bp, Human; identical to SEQ ID NO: 28223

SEQ ID NO: 61259 - DNA, 601 bp, Human; identical to SEQ ID NO: 28224

SEQ ID NO: 61260 - DNA, 601 bp, Human; identical to SEQ ID NO: 28225

SEQ ID NO: 61261 - DNA, 601 bp, Human; identical to SEQ ID NO: 28226

SEQ ID NO: 61262 - DNA, 601 bp, Human; identical to SEQ ID NO: 28227

SEQ ID NO: 61263 - DNA, 601 bp, Human; identical to SEQ ID NO: 28228

SEQ ID NO: 61264 - DNA, 601 bp, Human; identical to SEQ ID NO: 28229

SEQ ID NO: 61265 - DNA, 601 bp, Human; identical to SEQ ID NO: 28230

SEQ ID NO: 61266 - DNA, 601 bp, Human; identical to SEQ ID NO: 28231

SEQ ID NO: 61267 - DNA, 601 bp, Human; identical to SEQ ID NO: 28232

SEQ ID NO: 61268 - DNA, 601 bp, Human; identical to SEQ ID NO: 28233

SEQ ID NO: 61269 - DNA, 601 bp, Human; identical to SEQ ID NO: 28234

SEQ ID NO: 61270 - DNA, 601 bp, Human; identical to SEQ ID NO: 28235

SEQ ID NO: 61271 - DNA, 601 bp, Human; identical to SEQ ID NO: 28236

SEQ ID NO: 61272 - DNA, 601 bp, Human; identical to SEQ ID NO: 28237

SEQ ID NO: 61273 - DNA, 601 bp, Human; identical to SEQ ID NO: 28238

SEQ ID NO: 61274 - DNA, 601 bp, Human; identical to SEQ ID NO: 28239

SEQ ID NO: 61275 - DNA, 601 bp, Human; identical to SEQ ID NO: 28240

SEQ ID NO: 61276 - DNA, 601 bp, Human; identical to SEQ ID NO: 28241

SEQ ID NO: 61277 - DNA, 601 bp, Human; identical to SEQ ID NO: 28242

SEQ ID NO: 61278 - DNA, 601 bp, Human; identical to SEQ ID NO: 28243

SEQ ID NO: 61279 - DNA, 601 bp, Human; identical to SEQ ID NO: 28244

SEQ ID NO: 61280 - DNA, 601 bp, Human; identical to SEQ ID NO: 28245

SEQ ID NO: 61281 - DNA, 601 bp, Human; identical to SEQ ID NO: 28246

SEQ ID NO: 61282 - DNA, 601 bp, Human; identical to SEQ ID NO: 28247

SEQ ID NO: 61283 - DNA, 601 bp, Human; identical to SEQ ID NO: 28248

SEQ ID NO: 61284 - DNA, 601 bp, Human; identical to SEQ ID NO: 28249

SEQ ID NO: 61285 - DNA, 601 bp, Human; identical to SEQ ID NO: 28250

SEQ ID NO: 61286 - DNA, 601 bp, Human; identical to SEQ ID NO: 28251

SEQ ID NO: 61287 - DNA, 601 bp, Human; identical to SEQ ID NO: 28252

SEQ ID NO: 61288 - DNA, 601 bp, Human; identical to SEQ ID NO: 28253

SEQ ID NO: 61289 - DNA, 601 bp, Human; identical to SEQ ID NO: 28254

SEQ ID NO: 61290 - DNA, 601 bp, Human; identical to SEQ ID NO: 28255

SEQ ID NO: 61291 - DNA, 601 bp, Human; identical to SEQ ID NO: 28256

SEQ ID NO: 61292 - DNA, 601 bp, Human; identical to SEQ ID NO: 28257

SEQ ID NO: 61293 - DNA, 601 bp, Human
cggtgggcagcctcctactccgggagcgcgtccctcttccagtcacctccgcccacctcttcctctccgcgcatcccacgcccaccaccttcatgtttctcagctccatttttgcctcccgctcccttgccttttcctcttggccctcatcccgagcttctttccctctccgcggcctgggcccccagacctgccctgctcgcccggttcgtcccccgccaggttactgcctccttccctgcgagaggtctcctttgttccttcctccgcatggtccgctgacaccttaccgtttcctggkccagccttgtggcagtcctcttcctctcgtccagggacccatgtcatcttcctgccaggttccctagctgctgtgggtcagtgctggggagaaaagggaacggacatccattttgcctccctgccacctttctccactccctcgactggttgaccaggtggtacatagacttcctttctcatttttgtctttgatgtgggtatgcccacctggcagttttcctatctctgttccgggcctctcctgacctgccgcctccagctccttagcttctgggccacatccttctctctcttcccc

SEQ ID NO: 61294 - DNA, 601 bp, Human
agccatttcttatgggaacccaggggaggggaaagtcacagagggctaatctgatcaccagaggccttcatgccagtagttatttattacacgcttgccttatgccagcactttgctaagggccttcacaggccattattatgacaatccttacccgggaaaatatctgtactatggatattgtcttcctctttttttaaaacaggtaagtaactttccaggtttacacagatgctggagaaggtcattgactccagctctttttggctttctggagcctgggcaggtagagaggtgggtrgaggaggaaggatactccaggtggaaaaacagcatgtgccgagctatggaggtgaggttcgtaaggcgtgtgtttgagtgacagtgagcagtgttggttttgccccccttctcttccacggcacaggccacatctgctatgtgtacctgtgattcccagcacagagcctggtgcagagtaggagcccactgcacgttcatggtggccagtggcctgagcctcacaggattccaaatgacagcgtgagtgtagaaccttctgctggtgccgtggatcctcttgactcagaccgggggtgtc

SEQ ID NO: 61295 - DNA, 601 bp, Human
ggaaagtcacagagggctaatctgatcaccagaggccttcatgccagtagttatttattacacgcttgccttatgccagcactttgctaagggccttcacaggccattattatgacaatccttacccgggaaaatatctgtactatggatattgtcttcctctttttttaaaacaggtaagtaactttccaggtttacacagatgctggagaaggtcattgactccagctctttttggctttctggagcctgggcaggtagagaggtgggtggaggaggaaggatactccaggtggaaaamcagcatgtgccgagctatggaggtgaggttcgtaaggcgtgtgtttgagtgacagtgagcagtgttggttttgccccccttctcttccacggcacaggccacatctgctatgtgtacctgtgattcccagcacagagcctggtgcagagtaggagcccactgcacgttcatggtggccagtggcctgagcctcacaggattccaaatgacagcgtgagtgtagaaccttctgctggtgccgtggatcctcttgactcagaccgggggtgtcagccaggtgtgaggggtagagaaggcatt

SEQ ID NO: 61296 - DNA, 601 bp, Human
gttttgccccccttctcttccacggcacaggccacatctgctatgtgtacctgtgattcccagcacagagcctggtgcagagtaggagcccactgcacgttcatggtggccagtggcctgagcctcacaggattccaaatgacagcgtgagtgtagaaccttctgctggtgccgtggatcctcttgactcagaccgggggtgtcagccaggtgtgaggggtagagaaggcattttgtccatccagtgacgtcactgcccagaaactgtcagcaaggaggaaggaaggcatgagttggtgaycgcatagtgctgactagctggacagggcataaactaactctctgtgtcaggagagctcctgaattcttcggtgtagagtccagagctgagggtcagtagattctagtcactagaccaccaggtctgactggctcttggtggtttgggtaaatctgtgcctctgtcttcatggaagtccagacccacttaacactcggaggctgcatgtttcttgttaagagttgtttgccatccagcacctcaacggttgtcagagctagaaggggcattagagatcattcatcctggccctcgctgatc

SEQ ID NO: 61297 - DNA, 601 bp, Human
acagaatgagtattctgatgagctgagcagaggagtttggctttatagacagaaaaaggctgaagaaagtagaaacagatcaaaaatctgattggttatttcggtcccttttaaaggttaaagcagaggagacttctgtatgttggctgaaactggcttgtttgaagatttgactgttaactcactctctcctgatcttggaaggtcagatcgacagcttagttttggcttggtggcgtggaacttcagcttgagggactccatcttggtttggtctcttgggccttgtgcaggagctcartcccaaccaatggcctcctagaaatattatttaacagttctccccttttggtcaggttctcacctaggtgagagttactaaaacagggcatcagcactactctcagtaatcatcgttttgggttttcggtcttaacacatcatttataggttaaggtgtcctcattatcatgcgtttcttggagttttatcattccagctggagagagaccatttagcattcagcagagggctgcatatagatatttaagactctttgagaggatacagtgtaacagggaaactactgtaatgactctcc

SEQ ID NO: 61298 - DNA, 601 bp, Human
cttcagcttgagggactccatcttggtttggtctcttgggccttgtgcaggagctcagtcccaaccaatggcctcctagaaatattatttaacagttctccccttttggtcaggttctcacctaggtgagagttactaaaacagggcatcagcactactctcagtaatcatcgttttgggttttcggtcttaacacatcatttataggttaaggtgtcctcattatcatgcgtttcttggagttttatcattccagctggagagagaccatttagcattcagcagagggctgcatatagayatttaagactctttgagaggatacagtgtaacagggaaactactgtaatgactctccccaggataatactaagagtttacaatatgacgcttagccagggacccatgaaccaaaccaactaaaattgaagagatcaaagaatgagccagatgaggaatttaccctttttaagcaagtactatttgttcatttttttgcaactgagtctcaatacactatgtgtctatccatgtgcaacagaaagtgtcagcaattgcacagattccctgttcgctagtaggtagcagttctattatctag

SEQ ID NO: 61299 - DNA, 601 bp, Human
acaaaaaaaggtagatgtaatcaaggataaagtggaagtcttattccaatgaaactcttgttcagaagttttgggaaagcatgaagttgtcaacttcttgtcctggtttgcagtttgattgtctctggttatggcattgggcattttggtgaactctttgtgtagcgtacacgtcaggcatgagacttgtcccttgaaatgtatatcaagttgttcagcttctgtttatagggctttaggcacagaacagttcctgttcttagttggagaattgtagctagttattggaagaaactggaaraattcagaattcaatccatcttataggtagatgataaaaacttgaaaatgatcaacaaggctacaatctaataacagatgtactatagtttttctttaggaacatattttttctctctatagtcacccccatttctaccaaagataatcagggtaagtgggaggcagaggtcacagtgagccgagattgcaccactgcactccagcctggatgacagagcaagactccatctaaaataaaataaaataaaataaataaaataaaattcagactaatttgcttgcagaaaatatttagtca

SEQ ID NO: 61300 - DNA, 601 bp, Human
aacatacatcaataaatataactcaaagaagattaaacatcatttcttgtttgacaatgcttcccatataattaatacatcaaatgagcctaactagtttagtatctcccctttgcagaatctttgagatgttccagggccccctgaaatgttccaaagttacttcaagttcagaaagccttaatttagaatttgattttgggaagtttgtacaaaatgtcaaaggtttaaaattaaaacacttaatcagcctgggcatggtggctcatgacggtaatcccaacactttgggaggccgagkcaggaggataccttgagcctaggggttcgagaccagtctgggcaacataggaagaccccatttctatattaaaattttaaaaaattagccaggtgtggtggtgtgcacctgtggtaccagctacttaagcagctgaggtgggagaattacttgagcccaggagattgaggacaggtgagccacgatcgcaccactgcactccagcctggatgacatagtgagaccttatctcaaaacaaaaacaaaaaagcaaaacaaaaaaaatcacttgatcaaaataggatcacaggtcactgtgaa

SEQ ID NO: 61301 - DNA, 601 bp, Human
cttcccatataattaatacatcaaatgagcctaactagtttagtatctcccctttgcagaatctttgagatgttccagggccccctgaaatgttccaaagttacttcaagttcagaaagccttaatttagaatttgattttgggaagtttgtacaaaatgtcaaaggtttaaaattaaaacacttaatcagcctgggcatggtggctcatgacggtaatcccaacactttgggaggccgaggcaggaggataccttgagcctaggggttcgagaccagtctgggcaacataggaagacccyatttctatattaaaattttaaaaaattagccaggtgtggtggtgtgcacctgtggtaccagctacttaagcagctgaggtgggagaattacttgagcccaggagattgaggacaggtgagccacgatcgcaccactgcactccagcctggatgacatagtgagaccttatctcaaaacaaaaacaaaaaagcaaaacaaaaaaaatcacttgatcaaaataggatcacaggtcactgtgaagtcacagtcattcatctaaccagaatgataattaaaagacttcaaaatgaaaatataga

SEQ ID NO: 61302 - DNA, 601 bp, Human
ggtcactgtgaagtcacagtcattcatctaaccagaatgataattaaaagacttcaaaatgaaaatatagaatgttacattgttgcagaaaaaacagctcttttatagagaggactccattttcttaagtaatcaaggacctagtaaagacaacatgaagcacagggaatcatcttgatgaaacaaaggatctttctttaggagaattacctaaaaggtacagaaaaacctttcactgtttccttttaagaacagatcaatacttcaagaaaaccttgttttaacagagaggaccaaattctgatttttcatcagtgtacttttgatattaaggctcatcaaaaaaaaaaaaacacaaaaactataagttagcccattcgaccacacttgaagttcttttctcttcacaacttccttgtatccattggtttgtcctgtactgttcctctttctcattgtgaaataaccagtcactctactttagaacaaaatgactctctttttcccttaattaaaatacatccttacattttatgacttcctttataaaccgtgccatacttcccttgcatacagaattatgtcccttattatttttagt

SEQ ID NO: 61303 - DNA, 601 bp, Human
ttcaaaatgaaaatatagaatgttacattgttgcagaaaaaacagctcttttatagagaggactccattttcttaagtaatcaaggacctagtaaagacaacatgaagcacagggaatcatcttgatgaaacaaaggatctttctttaggagaattacctaaaaggtacagaaaaacctttcactgtttccttttaagaacagatcaatacttcaagaaaaccttgttttaacagagaggaccaaattctgatttttcatcagtgtacttttgatattaaggctcatcaaaaaaaaaaaaacacaaaaactataagttagcccattcgaccacacttgaagttcttttctcttcacaacttccttgtatccattggtttgtcctgtactgttcctctttctcattgtgaaataaccagtcactctactttagaacaaaatgactctctttttcccttaattaaaatacatccttacattttatgacttcctttataaaccgtgccatacttcccttgcatacagaattatgtcccttattatttttagttttagttgcttatattaattagtttttactccttagtaatcttaatttctag

SEQ ID NO: 61304 - DNA, 601 bp, Human
tgccaacctaggacaggcatgaagagatggaggtttgggtgagggaagagacttcagaggagagtggacaggatgtggaggcaggtggggatcagcaatcccctggtaggggcagagggattgcatcctgggcctggcatgcaacaggccctgaccatacctgcctttgtgcaggctgccttgcaggtgaggtttaaagccaaaggatgcaccccagcttgcagatacttggataggctcaagttgctatccttgtgtgctaagggagtcaagaaggctccccaaaaagtgtgtggtgggrgggtgttgaggaggttggggaaatggcatcataggatgtagctcacctcactctgctaaatacttttgacgtctgactctggtaaatacctccatctacttcctcttcccaaccccccacccacctccctccttcgaggagtccagaagctacaatgccaaaagcagactaccagcaagaaaggtgggggaaagaagggggtggtgtggccacaggccttcctcccagctcgcagagccccctcccttgtatcagccccaagaagggccagcttagttgccttctttccagggatgcgtc

SEQ ID NO: 61305 - DNA, 601 bp, Human
cggccagcagccttgtggcccggggcctgatgcaggggccagactctggcctcaaggcttctttccccgcagttcctggattccagatgctcctgtttctgtctggggacccagttcctgataccctttaccccagtcactcaagctctgcccactaccagtatctctggccccaggaaacttccctaagggtcccctggggaattccagatcccctaaggcatgttctccaccctctggaactgatcccatttagagccccagggacaaaggcaataccagggcttttcctggggggtgrggggctggggggatggcgaggagcagggcaaactccttcaacatctctcagcccccatccctggccccgattagtaatggagaaacagataccattatgaggcagtatgacttatgctaatcatccaaaacacaggttcccttttgtgagacgctagaaatgcagaccaactggaatatctcagaggtccttttccaaggaaggtgtgacctttgtcataagagctttgggatcaggtgctttgaggttggcaggggtgaggcattgcattaggggagatgggcgggcagagggggtacc

SEQ ID NO: 61306 - DNA, 601 bp, Human; identical to SEQ ID NO: 25876

SEQ ID NO: 61307 - DNA, 601 bp, Human; identical to SEQ ID NO: 25877

SEQ ID NO: 61308 - DNA, 601 bp, Human; identical to SEQ ID NO: 25878

SEQ ID NO: 61309 - DNA, 601 bp, Human; identical to SEQ ID NO: 25879

SEQ ID NO: 61310 - DNA, 601 bp, Human; identical to SEQ ID NO: 25880

SEQ ID NO: 61311 - DNA, 601 bp, Human; identical to SEQ ID NO: 25881

SEQ ID NO: 61312 - DNA, 601 bp, Human; identical to SEQ ID NO: 25882

SEQ ID NO: 61313 - DNA, 601 bp, Human; identical to SEQ ID NO: 25883

SEQ ID NO: 61314 - DNA, 601 bp, Human; identical to SEQ ID NO: 25884

SEQ ID NO: 61315 - DNA, 601 bp, Human; identical to SEQ ID NO: 25885

SEQ ID NO: 61316 - DNA, 601 bp, Human; identical to SEQ ID NO: 25886

SEQ ID NO: 61317 - DNA, 601 bp, Human; identical to SEQ ID NO: 25887

SEQ ID NO: 61318 - DNA, 601 bp, Human; identical to SEQ ID NO: 25888

SEQ ID NO: 61319 - DNA, 601 bp, Human; identical to SEQ ID NO: 25889

SEQ ID NO: 61320 - DNA, 601 bp, Human; identical to SEQ ID NO: 25890

SEQ ID NO: 61321 - DNA, 601 bp, Human; identical to SEQ ID NO: 25891

SEQ ID NO: 61322 - DNA, 601 bp, Human; identical to SEQ ID NO: 25892

SEQ ID NO: 61323 - DNA, 601 bp, Human; identical to SEQ ID NO: 25893

SEQ ID NO: 61324 - DNA, 601 bp, Human; identical to SEQ ID NO: 25894

SEQ ID NO: 61325 - DNA, 601 bp, Human; identical to SEQ ID NO: 25895

SEQ ID NO: 61326 - DNA, 601 bp, Human; identical to SEQ ID NO: 25896

SEQ ID NO: 61327 - DNA, 601 bp, Human; identical to SEQ ID NO: 25897

SEQ ID NO: 61328 - DNA, 601 bp, Human; identical to SEQ ID NO: 25898

SEQ ID NO: 61329 - DNA, 601 bp, Human; identical to SEQ ID NO: 25899

SEQ ID NO: 61330 - DNA, 601 bp, Human; identical to SEQ ID NO: 25900

SEQ ID NO: 61331 - DNA, 601 bp, Human; identical to SEQ ID NO: 25901

SEQ ID NO: 61332 - DNA, 601 bp, Human; identical to SEQ ID NO: 25902

SEQ ID NO: 61333 - DNA, 601 bp, Human; identical to SEQ ID NO: 25903

SEQ ID NO: 61334 - DNA, 601 bp, Human; identical to SEQ ID NO: 25904

SEQ ID NO: 61335 - DNA, 601 bp, Human; identical to SEQ ID NO: 25905

SEQ ID NO: 61336 - DNA, 601 bp, Human; identical to SEQ ID NO: 25906

SEQ ID NO: 61337 - DNA, 601 bp, Human; identical to SEQ ID NO: 25907

SEQ ID NO: 61338 - DNA, 601 bp, Human; identical to SEQ ID NO: 25908

SEQ ID NO: 61339 - DNA, 601 bp, Human; identical to SEQ ID NO: 25909

SEQ ID NO: 61340 - DNA, 601 bp, Human; identical to SEQ ID NO: 25910

SEQ ID NO: 61341 - DNA, 601 bp, Human; identical to SEQ ID NO: 25911

SEQ ID NO: 61342 - DNA, 601 bp, Human; identical to SEQ ID NO: 25912

SEQ ID NO: 61343 - DNA, 601 bp, Human; identical to SEQ ID NO: 25913

SEQ ID NO: 61344 - DNA, 601 bp, Human; identical to SEQ ID NO: 25914

SEQ ID NO: 61345 - DNA, 601 bp, Human; identical to SEQ ID NO: 25915

SEQ ID NO: 61346 - DNA, 601 bp, Human; identical to SEQ ID NO: 25916

SEQ ID NO: 61347 - DNA, 601 bp, Human; identical to SEQ ID NO: 25917

SEQ ID NO: 61348 - DNA, 601 bp, Human; identical to SEQ ID NO: 25918

SEQ ID NO: 61349 - DNA, 601 bp, Human; identical to SEQ ID NO: 25919

SEQ ID NO: 61350 - DNA, 601 bp, Human; identical to SEQ ID NO: 25920

SEQ ID NO: 61351 - DNA, 601 bp, Human; identical to SEQ ID NO: 25921

SEQ ID NO: 61352 - DNA, 601 bp, Human; identical to SEQ ID NO: 25922

SEQ ID NO: 61353 - DNA, 601 bp, Human; identical to SEQ ID NO: 25923

SEQ ID NO: 61354 - DNA, 601 bp, Human; identical to SEQ ID NO: 25924

SEQ ID NO: 61355 - DNA, 601 bp, Human
ctttgggagaccaaggctggcatattacttgaggtcaggagtttgagaccagcctggacaacatggtgaaatcacgtctctactaaaaatacaaaaattagctgggtgtggtggcgcatgcctgtaaacctggctactctggaggctaagcaatgagaattgcttgaacccaggagatgaaggttgcagtgagctgagattgtgccactgctctctggcctgggtgaaacagcaagactctgtctaaaaaaaaaaaaaaagtgtatttaaataaaatagataccgtaaggttttgtaccaytgacagaatgtaaattcagctctgaattttcagaggatagaagaagacattatttcaaaattgatataaggtgaatttacaccagttcctcagaaaaagtagcttttactgaacatgaaatttgagaggaaattcttccttggactctcatggagagtcttttgtttctgtgttgaacagtatctccaacaatagttttacaaagaacatgacggtgagttttaataggctgcttcttataatccaaggatgtaatgtaaaaatgtattactatgaactacaattcctaaataatctggt

SEQ ID NO: 61356 - DNA, 601 bp, Human
tatccgaaataggcatgtagtttacatatttacttgacacatcattgagtaggaataaaagtgaatccttttcctcaattccttgaagccaatgtactgtttataaaaaaaggagtaaattaacctaggttgcttctctatgtgtgtgtgtgttttaaaaatttttcaaattctcttgatctattatgtttagatgcagaattttacctgctggttagatggccaaacatattattagtagttgttgttttacagtactggcattttggtttcataaggtatagtctgagatgacacatayggtattttttaaaattagtagaggagcagatgatacaagattataattttaaaggttttttgtttttgtggcatcatgttttattgctgagaaactatattttatgaagtattgagagactatgtattttgtcaaaacaccaattaaaccgtttctttttgtgtttttatgtttagtatgcctcctttcaaagatacatgaaattggcatagatttgaaagaccatatgtgagttgttagaggattttttgatatatatctactcagtggaatgtattttttagactatttaaattaaaa

SEQ ID NO: 61357 - DNA, 601 bp, Human
agtagttgttgttttacagtactggcattttggtttcataaggtatagtctgagatgacacatacggtattttttaaaattagtagaggagcagatgatacaagattataattttaaaggttttttgtttttgtggcatcatgttttattgctgagaaactatattttatgaagtattgagagactatgtattttgtcaaaacaccaattaaaccgtttctttttgtgtttttatgtttagtatgcctcctttcaaagatacatgaaattggcatagatttgaaagaccatatgtgagttkttagaggattttttgatatatatctactcagtggaatgtattttttagactatttaaattaaaatagacctattgcttgatagttttccttgtatattttgcttatctttttatcttacaatacattccttttgatggagagtgtacatagctaatgttagcttaattcatctctgactcagcttaatacagctatctgactttctgaaattggatgaataaatagagataaggacataagtaactggccaccacactagtctctgtttttctgccatttcttctttagtctccctgttc

SEQ ID NO: 61358 - DNA, 601 bp, Human
gagtgtacatagctaatgttagcttaattcatctctgactcagcttaatacagctatctgactttctgaaattggatgaataaatagagataaggacataagtaactggccaccacactagtctctgtttttctgccatttcttctttagtctccctgttccctctccagtcttgtgaacaggttttgttagaaattttggcttaggttctctctgcttattctgcttggttagcagatgtgttacagtctccctaagctccttagaattcagttcttagtgacattgaagatgaaagtgygcttgtaaattattcattcttattatacgcttcaatggacagggtctacttcaagcatcttcttccatgtcacccctgtccctagatctttgttgttttaacagatgtgagcttgctttttaattctggagaatggaagactgaattgcatttctaaaattcatgaagtagtttttgcatttataggattactgtcaaatatgtgcatttatataacattactttttcatgttattttaaatcttgtcccctctccccagtttccactttgttatcctgcatatttgtctctaaaaaaat

SEQ ID NO: 61359 - DNA, 601 bp, Human
gaagatgaaagtgcgcttgtaaattattcattcttattatacgcttcaatggacagggtctacttcaagcatcttcttccatgtcacccctgtccctagatctttgttgttttaacagatgtgagcttgctttttaattctggagaatggaagactgaattgcatttctaaaattcatgaagtagtttttgcatttataggattactgtcaaatatgtgcatttatataacattactttttcatgttattttaaatcttgtcccctctccccagtttccactttgttatcctgcatatttrtctctaaaaaaattatttacatgacttttctgacctagctataaaacagtttgatgtttataataggcagagctatatttaatttgctacattttcagctgggcaaaggcaggagagtagcttttctaagttccatttttctgttagcattgttttgtcagtaaggtaccctagtcatttattgtctctgcttgaagtgggataatgttgcatgagaagactatacaagggactagtagtgaggttaaccccaagaatgaagtggtagatctatctgtaggcactgagccttgttgtgag

SEQ ID NO: 61360 - DNA, 601 bp, Human
ttcttcattaactccctttaggaaggatgaaaagttctgattgatactcaaagtcatgtaatggagttatttctgaagggtgtgccttattatttgtttcatgtttacattggaaagtgatttgcatattcatttgtattatgaaaatgacagcttgtagataacaagaactattaacttcaaaaatggactcgtatattctataaagatgtcactaacttcagtctagttcactaagaggcaaggtgtacttctgaagaacaaatagcattgctatttgatttgaagaaatatctacttmtttttcacagaaagagaattagatctaatttaatgctcattgttatgacgttagataatgatataaatagtaaaattatgttatgataacaaatataatttttagtagcatacaggtaggaagctggaagcaatgaagaaatgttataaacacgggtttataatcctttctttgtgacactgtttaatgcatctttagtgtttaaaatatttcatcacctgtaaaagtcactaatatatgaagtcactgttttagttatcacacagtgtcatttcctttttattgtcaagtttgagagaa

SEQ ID NO: 61361 - DNA, 601 bp, Human
agagataatgataaaacattaaatcatggaacaaaaaagttctgggaattacaaatgtagactctacgttgtagaggaaaagataccagcagatgaatctgatgatttcagatagaatttcctgaagtagacattagaaagctggagcaattgttaaagtttaaagttggcagagttcaaagtaagggaagttcctttttgagttgttttcattttctttaggcaagaccacctaaggtgttcagtaaagaaacaacgagaaagctagaaagaagcatatgaagttgtgatcagagagtastggttttccagtattaggtatcattgaataaaggaaaaattcctgccactgaaatggaagagatactctaaaaatcatttggagtagcattgacttcagttatctgaggcagtatgaagaaaaaaaggtagtcaataattggaaaagtagataacctcttgcattagtttccttcggttgctgtaaaaaccacagacctggtggcttaaaatgacagacatttattctctcacagttttggaggccagaagtctgaaatcaaggtgtctgcagggctaccttccttctggaattctgaga

SEQ ID NO: 61362 - DNA, 601 bp, Human
gataccagcagatgaatctgatgatttcagatagaatttcctgaagtagacattagaaagctggagcaattgttaaagtttaaagttggcagagttcaaagtaagggaagttcctttttgagttgttttcattttctttaggcaagaccacctaaggtgttcagtaaagaaacaacgagaaagctagaaagaagcatatgaagttgtgatcagagagtagtggttttccagtattaggtatcattgaataaaggaaaaattcctgccactgaaatggaagagatactctaaaaatcatttrgagtagcattgacttcagttatctgaggcagtatgaagaaaaaaaggtagtcaataattggaaaagtagataacctcttgcattagtttccttcggttgctgtaaaaaccacagacctggtggcttaaaatgacagacatttattctctcacagttttggaggccagaagtctgaaatcaaggtgtctgcagggctaccttccttctggaattctgagagagtatctgttttttgcctcttacagcttctggtggttgctggctttcttggcttgtggccactccaatccgtgcctcttt

SEQ ID NO: 61363 - DNA, 601 bp, Human
tagtggttttccagtattaggtatcattgaataaaggaaaaattcctgccactgaaatggaagagatactctaaaaatcatttggagtagcattgacttcagttatctgaggcagtatgaagaaaaaaaggtagtcaataattggaaaagtagataacctcttgcattagtttccttcggttgctgtaaaaaccacagacctggtggcttaaaatgacagacatttattctctcacagttttggaggccagaagtctgaaatcaaggtgtctgcagggctaccttccttctggaattctgrgagagtatctgttttttgcctcttacagcttctggtggttgctggctttcttggcttgtggccactccaatccgtgcctctttaccttgtcctttgtctgtcctctgggtatctaaggacatttgtcattggatttaaggtctgcctggacaatccaggatgatgtcatctcaagatctataattacattacaaagactcttttttccaataagatcacatcacagattctagggatttgatatagatatctttttttggtggaggggaaggaacacttttgtgcctaccatattcttaa

SEQ ID NO: 61364 - DNA, 601 bp, Human
tagtaaaggaccatttatctgcctctagtgatagttacctgcaaaatattccaagttatacctcaaatttatctttatttctgatatccttcctgggggaaacaaggaccacaaatctctttttagtacactggatcaatgtattccccttccccaattttttttttgattgtggaactttttaaagacataaaaaagtggtgaggatgtataaagaaccccatttttcaacaatcgagctttaaccattatcagtgaaggggctaatcttgtgtcaccccgactcctgattgttgtgtgaacacacacacacacacacacacacaccatgttttctttatctgttcatctgttgattccatatcttggctattgtgaatagtgctgcaatatgcatgttggtgctgatatccctttgatatactaattttcttttctttggattgggggattaagtggtcattctatttttagtttttttcagaaacctccaatctgtcgttcccagtggctgtagtaatttacattcccaccaacagtgaataagagtccccttttctctgcatcttcagcagtattgttatttttgtctttttgataa

SEQ ID NO: 61365 - DNA, 601 bp, Human
gacaattttctcttgatgttttcagaattctctctttgtctttgacttttgatagtttgactataatatgcttggcggaggacctttgtgggttgaatctgtttgggaattattgagcttctggatctggataaccaaatctcttgcaagtcttggagagttttcagttattttgttaaataggctttttatatctttacccatcatttcaccttctgggattcctagaattagaatatttgtctgctttatagtgtcccatatgtcacataggctttctttagtttcttttattctttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgcggtgtttggttttttgttcttgcgatagtttactgagaatgatggtttcc

SEQ ID NO: 61366 - DNA, 601 bp, Human
ccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacgctgctttgaatgcgtcccagagattctggtatgtggtgtctttgttctcgttggtttcaaagaacatctttatttctgccttcatttcgttatgtacccagtagtcattcaggagcaggttgttcagtttccatgkagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattctttctttctttatttttttttgtactgactgggttatttaaaaagacttgtctt

SEQ ID NO: 61367 - DNA, 601 bp, Human
tcagcagtgggcagagcagacctatctgcaggcctctggataacgcatgcgggtgccagcatcagttgggtgggtatttcccagttcctaggctcccagatgatgtgcgcaggtgttggccatggttagcagggcagacctcttctcaggcccctgattatgcacataatgcaccaatggtaggcagggcagatcagtcctcagtcatcctgatgacaggcgcagctactggcagcagtggtgaacaagggcaggactaccctcatgcccccagattttttacatggcccctaattgtttyatgtgtattttaagatttattagcttgaatagggacccaaataagattcatcatacaatatattgtgattgattagtaggtctcttaatttttcattggtttgtaatgacaccatttggtacagaaggcactagccatatgtagctatttacattgattaaaactgaaatgaattaatctggtccttagttgccctacccatatatcgagtactcagtagcgatatgaggttaggggctaccatactggacagtacagattatttctcttattacagaaaattctgtttgttagagctaa

SEQ ID NO: 61368 - DNA, 601 bp, Human
tgtatatttcaatatatttggtatattttggtacagtgcagttttatccctattaatgattaaattctcatctttggccagtgggagcctattcagttggttttctcattccttttgatagactcttagtatcctattataacttcttttctatttgatattacaaaaatttccagacttgacatatatatttccagcctgggacctccaatcagccatttttccagggactgttggttgtttttttttttttttttttttttttaagtaataatcatggaatcttacttccttttagacrccacatactggacactgctttggaagtatcattgctactgggttattcactgtttcaggctttctgtttcatggaacagaaatgcatgcatatatacactcttataaatataaatgtatatatatattttaggataaaattctttattctttaaagcttaaagtcttagtacactttggatttgacaaaatgtgtctactgtagctgaaaagataaactgcgatgattttaagcattaagtaatactcttaggcatggcaaccacaagcataactttttgggattagggtattgggggtg

SEQ ID NO: 61369 - DNA, 601 bp, Human
taaatacatttcaaattttctcttgttccacaattgctgtgcagttccaaaatatgttcttattaggttcctcacaaaggaatcttttggccattacaacaagaaaatgagatagttaattttaaaggatacatcaaaataagataatttacattgtaagatttattattttcacgttcctgttttttctgtatgggatcctctaacatgttagcaaaacaatatgtcgtctttctataagactataatttccacttaaggaaaactatgatatgattcactcttgacatggcaaaaaaargttaggttaataaatttacagcaaagaagaatttttaacaatacaaaagtaacacaatatattaggtagatatcctcagaagcagtttattcgcaatggccatgaaagaatcttcctaaaagtagtagtaagagaatgactaatggagaaaaagggatttgaactggatcttgaagcatggttaacatttagatagccttaggagagggccttctaagcacagagaagcaacaagacgaaaccaaaagaatgcacatttctaagacattcagggaagatttagtagaacacttaaaatga

SEQ ID NO: 61370 - DNA, 601 bp, Human
acatcaaaataagataatttacattgtaagatttattattttcacgttcctgttttttctgtatgggatcctctaacatgttagcaaaacaatatgtcgtctttctataagactataatttccacttaaggaaaactatgatatgattcactcttgacatggcaaaaaaaagttaggttaataaatttacagcaaagaagaatttttaacaatacaaaagtaacacaatatattaggtagatatcctcagaagcagtttattcgcaatggccatgaaagaatcttcctaaaagtagtagtragagaatgactaatggagaaaaagggatttgaactggatcttgaagcatggttaacatttagatagccttaggagagggccttctaagcacagagaagcaacaagacgaaaccaaaagaatgcacatttctaagacattcagggaagatttagtagaacacttaaaatgaagcatggagggttatcactggagaatagttagctgtatggataaagccagcttcccaaggagcttaaataatttaaaaagttggactttatttggtagactagtgtattctaagatttggagttactagt

SEQ ID NO: 61371 - DNA, 601 bp, Human
cagacttacatgtataggtttgttacataggtaagtttaaatcatggggatttgttgtatagattatttcatcaaccaggtattaagcctagtacccattagttatttttcctgatcctctccctcctaccctccaccctccgataggctagtgtgtgttgctcccctctatgtatctatgtattttcatcatttagcttccacttataagtgagaacacaaatagaatgaagtgcagtggtttaattttaatagtggaattgtttttcaagttatacctgtccctgctgtcctttggacktgagagattctacctttttaaagtacctacataacactatctgaatagggctgtggaatataggcagacccaattctcccctgttcctgtttatagattttgtgttgtgaacctagaaggattgtgcttcctgattttagttttctttttcttgtctttactgcaactctccagaaaacctacagaatgtttattggaaacaccttggtagaagagaagtgttgtttgttgtaaacataaatcctaatcttttgtgcaaaatattttagaaatattttaacttttatttcttagtaagag

SEQ ID NO: 61372 - DNA, 601 bp, Human
gcataactgactcctatttttagccctaaatattcaaaagaacaggaaaacgtgactctgcatatgactttccttaaatattttttgaatgttttatttgaaatatcatgcaactaaaaatttcaaactctttcataaaggtaatgtttaattttttatgttgtaaagttaaatattgttttttaacaaaaattttccccaaaatgaaatgtcgaatttgcatttttaaaagataatttttaaatctttatcttcagatagctgtagtcttataagcatgtaaagtttttttttttttttgggggggggggggcgggggcggggacaagtctcgctctgtcgcccaggctggagtgcagtggcacgatcttggctcactgtaacctccatctcccaggttcaagcagttctcctgcctcagcctcctgagtagctgggattacaggcgcccaccaccacacccggctgatttttgtatttttactagagatggggtttcaccatgttggccaggctggtctcaaactcctgacctcaggtgatccacccgcctcggcctcccaaagtgctgggattacagacaggcatgagccgccgtgcc

SEQ ID NO: 61373 - DNA, 601 bp, Human
aggtaatgtttaattttttatgttgtaaagttaaatattgttttttaacaaaaattttccccaaaatgaaatgtcgaatttgcatttttaaaagataatttttaaatctttatcttcagatagctgtagtcttataagcatgtaaagtttttttttttttttgggggggggggggcgggggcggggacaagtctcgctctgtcgcccaggctggagtgcagtggcacgatcttggctcactgtaacctccatctcccaggttcaagcagttctcctgcctcagcctcctgagtagctgggwttacaggcgcccaccaccacacccggctgatttttgtatttttactagagatggggtttcaccatgttggccaggctggtctcaaactcctgacctcaggtgatccacccgcctcggcctcccaaagtgctgggattacagacaggcatgagccgccgtgcccggccataagcatgtaaagttttaaagaaaagcagcttttatctctcctggttagtgtgttttttaaacagcttttttgaagtataattgacatttaataaactgtatatatttaaagtgtgcaatttgataagttat

SEQ ID NO: 61374 - DNA, 601 bp, Human
tagtcttataagcatgtaaagtttttttttttttttgggggggggggggcgggggcggggacaagtctcgctctgtcgcccaggctggagtgcagtggcacgatcttggctcactgtaacctccatctcccaggttcaagcagttctcctgcctcagcctcctgagtagctgggattacaggcgcccaccaccacacccggctgatttttgtatttttactagagatggggtttcaccatgttggccaggctggtctcaaactcctgacctcaggtgatccacccgcctcggcctcccaargtgctgggattacagacaggcatgagccgccgtgcccggccataagcatgtaaagttttaaagaaaagcagcttttatctctcctggttagtgtgttttttaaacagcttttttgaagtataattgacatttaataaactgtatatatttaaagtgtgcaatttgataagttatgacatttgtatacactggcgaaaccataaccacactcaagatagtgaacatatccatcacccccaagagtttcctcatacctttttgtaatctctgcttcccaccgcatctcactctatcccttct

SEQ ID NO: 61375 - DNA, 601 bp, Human
agcagttctcctgcctcagcctcctgagtagctgggattacaggcgcccaccaccacacccggctgatttttgtatttttactagagatggggtttcaccatgttggccaggctggtctcaaactcctgacctcaggtgatccacccgcctcggcctcccaaagtgctgggattacagacaggcatgagccgccgtgcccggccataagcatgtaaagttttaaagaaaagcagcttttatctctcctggttagtgtgttttttaaacagcttttttgaagtataattgacatttaataamctgtatatatttaaagtgtgcaatttgataagttatgacatttgtatacactggcgaaaccataaccacactcaagatagtgaacatatccatcacccccaagagtttcctcatacctttttgtaatctctgcttcccaccgcatctcactctatcccttctcagtcaaacactgattggctttctttcactgttgatcagtttacattttctaaagttttatatgtatttagacagtatgtactcttgtttgtctggcttctttcagtcaacctaattattttgagattccaaagtagc

SEQ ID NO: 61376 - DNA, 601 bp, Human
cacccgcctcggcctcccaaagtgctgggattacagacaggcatgagccgccgtgcccggccataagcatgtaaagttttaaagaaaagcagcttttatctctcctggttagtgtgttttttaaacagcttttttgaagtataattgacatttaataaactgtatatatttaaagtgtgcaatttgataagttatgacatttgtatacactggcgaaaccataaccacactcaagatagtgaacatatccatcacccccaagagtttcctcatacctttttgtaatctctgcttcccaccscatctcactctatcccttctcagtcaaacactgattggctttctttcactgttgatcagtttacattttctaaagttttatatgtatttagacagtatgtactcttgtttgtctggcttctttcagtcaacctaattattttgagattccaaagtagcagtgcaattttacgttcacttagaatgtgtcaatgtttcattttttttccatgtcttcaccaatacttggtattgtcaatctatttaattttagtcattacaataggaatgtggtgttacctcgttgtgtttttaatttaca

SEQ ID NO: 61377 - DNA, 601 bp, Human
tttttgaagtataattgacatttaataaactgtatatatttaaagtgtgcaatttgataagttatgacatttgtatacactggcgaaaccataaccacactcaagatagtgaacatatccatcacccccaagagtttcctcatacctttttgtaatctctgcttcccaccgcatctcactctatcccttctcagtcaaacactgattggctttctttcactgttgatcagtttacattttctaaagttttatatgtatttagacagtatgtactcttgtttgtctggcttctttcagtcarcctaattattttgagattccaaagtagcagtgcaattttacgttcacttagaatgtgtcaatgtttcattttttttccatgtcttcaccaatacttggtattgtcaatctatttaattttagtcattacaataggaatgtggtgttacctcgttgtgtttttaatttacattttccaaatgactaacgatattgagacttttcctatttatttgccgttggtatatcttctttaggaaaatgttcaaatcttttgcctatttgaaaaattgggttgtttttctcctattcttgagttttg

SEQ ID NO: 61378 - DNA, 601 bp, Human
taaccacactcaagatagtgaacatatccatcacccccaagagtttcctcatacctttttgtaatctctgcttcccaccgcatctcactctatcccttctcagtcaaacactgattggctttctttcactgttgatcagtttacattttctaaagttttatatgtatttagacagtatgtactcttgtttgtctggcttctttcagtcaacctaattattttgagattccaaagtagcagtgcaattttacgttcacttagaatgtgtcaatgtttcattttttttccatgtcttcaccartacttggtattgtcaatctatttaattttagtcattacaataggaatgtggtgttacctcgttgtgtttttaatttacattttccaaatgactaacgatattgagacttttcctatttatttgccgttggtatatcttctttaggaaaatgttcaaatcttttgcctatttgaaaaattgggttgtttttctcctattcttgagttttgagggtttttttttttttaatttttttatttttattttcgagatggagttttgctctgtcacctaggctggagtgcaatagcgtgatctcag

SEQ ID NO: 61379 - DNA, 601 bp, Human
attattttgagattccaaagtagcagtgcaattttacgttcacttagaatgtgtcaatgtttcattttttttccatgtcttcaccaatacttggtattgtcaatctatttaattttagtcattacaataggaatgtggtgttacctcgttgtgtttttaatttacattttccaaatgactaacgatattgagacttttcctatttatttgccgttggtatatcttctttaggaaaatgttcaaatcttttgcctatttgaaaaattgggttgtttttctcctattcttgagttttgagggtttttttttttttaatttttttatttttattttcgagatggagttttgctctgtcacctaggctggagtgcaatagcgtgatctcagctcactgcaacctctgcctcccaggttcaagcaattctcctgcctcagcctccctagtagctggtactacaggcacctggctaatttttgcatttttagtagagacagggcttcaccatgttggccaggctggtctcgaactcctgaccttgtgatctccccgtcttcgcctcccaaagtgctgggattacaggtgtgagccaccacacctggc

SEQ ID NO: 61380 - DNA, 601 bp, Human
gtccctgggtacttgagattagggagtggtgatgactcttaacgagcatgctgccttcaagcatctgtttaacaaagcacatattgcgccgcccttaatccctttaaccctgagtggacacagcacatgtttcagagagcaccgggttgggggtaaggtcacagatcaacagcatcccaaggcagaagaatttttcttagtacagaacaaaatggagtctcctatgtccacttctttctacacagacacagcaacaatctgatttctctatcttttccccacatttccccccttactattygacaaaaccgccattgtcatcatggcctgctctcaatgagctgttgggtacacctcccagatggggtggcggctgggcagagggtctcctcacttcccagaaggggtggccgggcagaggcgcccccccacctcccggatggggcggctggccgggcgggggctgccccccacctccctcccgaacggggcagctggccgggtgggggctgccccccacctcccagacggggcggctgccgggcggagacgctcctcacttcccagacagggcggctgctgggcggaggggctcctcact

SEQ ID NO: 61381 - DNA, 601 bp, Human
acatcccagacggggcggcggggcagaggcgctccccacatctcagacgatgggcggccaggcagagacgctcctcacttcccagacagggtggcggccgggcagaggctgcaatctcggcactttgggaggccaaggcaggcggctgggaggtggaggttgtagccagccgagatcacgccactgcactccagcctgggcaacattgagcactgagtgaacgagactccatctgcaatcccagcacctcgggaggccaaggctggcagatcactcgcggttaggagctggagaccagccyggccaacacagcgaaaccccgtctccaccaaaaaaatacgaaaaccagtcaggcatcgcggcgcgcgcctgcaattgcaggcactcggcaggctgaggcaggagaatgaggcagggaggttgcagtgagcagagatgggggcagtacagtccagcttgggctcggcgtcagagggagaccgtggggagggggagagggagaggggggagagttctttttatattttagatacaagacctttatcagatgtagattttgcaaagatttttcaaaagtagagcttttaaattttgatgtagt

SEQ ID NO: 61382 - DNA, 601 bp, Human
acacatatcagttgttctaacaccatttgttgaaaagaccatcctgtctccactgtattgcttttgtatgcagtagttgccccttatctgctggggatgcattccaagacccccagtggatgcctaaaactgtggatggtaccaaattatatatacaatatttttctatacatttatacatacatatgataaagtttaatttctaaattaggcacaataagagactaacaataataaaatataacaattataacagtatgtcagcatcattactcttgccctttgtggccattaaataaartaagtgttacttgaacacaagcactgaagtaccatgatagcctgataactgagatggctactaagtgactaaagggtgttagtgttgttccctatacgaagggatgattctcatcccaggcaaaatggagcaggaaggtgtgagatttcacagtgctattcagaatgacatgaaaaaatccctatgaattgtttatttctggaattttctatttaatattttcagacagctgttgacaatggtaaccgaaactgtggaaagtgaaaccatagtttaagggggctattttatttgtcaaaa

SEQ ID NO: 61383 - DNA, 601 bp, Human
attgagatgatcatatagcttttctcttttagtttgttaatgtggcgaattacattgattttcacatgttaaattgaccctgcattcctaggagaaaccccacttggtcattacatatcctttttatatgttgttgaattagatttgctaaaattgtattagaatttttacatctgtatttatatgggatattgttctctagaagtcttataatgtctttgtcttgttttggtatcagggtaatgtttacctcatagaatgaggtaaactaatgaaaagaaagaattcttttcattagtgyggaagagtttgtatatatctggtattattctttttaactgtttggtagaatccactaataaagtcatctggacctggaactttcttcatgggaagattttaataggattgtttaggttatctgttttttcttgagtgaactcttgatagttggtatctttcaaggaatttgtctatttaattaaaattgtcaaatttattggcttaaagttatttataatatttccttattatcctttacatagtgatagaagctatagccttgtcaactctcacattcctgatattggccatttgtgtt

SEQ ID NO: 61384 - DNA, 601 bp, Human
ttaactgtttggtagaatccactaataaagtcatctggacctggaactttcttcatgggaagattttaataggattgtttaggttatctgttttttcttgagtgaactcttgatagttggtatctttcaaggaatttgtctatttaattaaaattgtcaaatttattggcttaaagttatttataatatttccttattatcctttacatagtgatagaagctatagccttgtcaactctcacattcctgatattggccatttgtgttgtcttcgttcccttcctcctccttctcatccttctctagcatcatcattatcagtctggttagagatctatcaattttactgtcttagtcatttccttgatttttctctcatattttttccctgttctctctctctctctctctctctctctctctctctctctgtcgtctgtctgtctgtctgtctgtctcgtctcatcttgttgcccaggctggagtgcggtggcacaatcatagcacgctgtaacctcaacctcctgggctcaagcattcctcccatctcagcctcctgaataattggggctacagacgcatgccaccatgcccagctaag

SEQ ID NO: 61385 - DNA, 601 bp, Human
tttattgatatccactctttattatttccttgctctgtgctctttgggtttaatttatcctgccttttctggtttttaaaagtataagcttttgtctctgctaaaatctctgttgctttatttttggctcttaccatcagccctctgcaggtataaatttcaggttctaaacttcacacctgattgtcaaattggtaatgttctaggctaagtgtcttcagaaagtaagttcacctctcttaagattcttcccctctggaattaggtcttttacctctagtttttgctctttcagcagctrtttgctaccttgaaacaaatgacttaggtatattattcagttttctgtttgtttaacttgtaggtggtagttggcctccaggtcctccttcttgcctggaagtgaaccctccttaaatggattatttttcaatattcagtaatctgctcgtcttctagaagctcatattgattcacagaagcaagccatgccaaacacacgtaattttctttttcctttttttggagatggagtttcactcttgttacccaggctggagtgcaatggcacaatctcagctcactacaacctctgcctcct

SEQ ID NO: 61386 - DNA, 601 bp, Human
atttggaccagtgggtatggagtggcaaatttcgcttgttagaactttcacgtagttaaatttgcccccaaataaaattgttggagatgtcattaaattttggaattgaatgttatgtagctaccacatagggacattagggagaatttttgcatttggcaagaagaggactagatcagtgattcataactgtggttgcacattagaatcacctgggcaacattaaaaaacaaaaatcttggacagactgcatgcaccctaagctgactaaatcagaatcttgggacttgagcatctgtatttttttttttttttttgagacagagtctcactctgtctcccaggctggagtgcagtggcgcaatctcggctcaccgcaacccctgcctctggggttcaagcgattctcctgcctcagcctcccaagtagctgggattacaggtgcccaccaccacagctggctaatttttgtatttttagtagagacgaggtttcaccatgttggccaggctggtctcaatctcctgacctcatgatccgcccaccttggcctcccaaagtgctgggattacaggcatgagccactgtacccagccggat

SEQ ID NO: 61387 - DNA, 601 bp, Human
taactgtggttgcacattagaatcacctgggcaacattaaaaaacaaaaatcttggacagactgcatgcaccctaagctgactaaatcagaatcttgggacttgagcatctgtatttttttttttttttttgagacagagtctcactctgtctcccaggctggagtgcagtggcgcaatctcggctcaccgcaacccctgcctctggggttcaagcgattctcctgcctcagcctcccaagtagctgggattacaggtgcccaccaccacagctggctaatttttgtatttttagtagagwcgaggtttcaccatgttggccaggctggtctcaatctcctgacctcatgatccgcccaccttggcctcccaaagtgctgggattacaggcatgagccactgtacccagccggatctgtatgttttaaagctcttcaggtcatgataatgtgcagcaaagtttgtgaattagattataatgtattttccaaattaattttacaacataattctgaccattcaatggtaacgctttgttttcctggaacagattttgaatgatctgcatttgtaaaatacatagaaaacctgggatatataa

SEQ ID NO: 61388 - DNA, 601 bp, Human
tggaagttttgcttttttggtagagatacaacataaaagacttgaggaaataggtcatggtaattatctgtcatccagtaaaagaaatttgaaaatcattgatgtaaagcagcatttataaattgatgaattagagtaattataaattgatgaattagagatatggttttatatggcatgaaaaatgaatattataatttaatatattactagagtagcgattttcaaagtgtggttcttagaccaacagcatcacctgggtacttgttataaatgctaattcttggacctcaccccagayctactaaatcagaaacttctggggtggggcctggctatcggtgttttaacgaggtcttcaggggatttgaatgcatgcttaagtttggaaaccatggatttagaatactattgccttttgttgtaccagccaataaattaaattttgtgtatgctttctattcaagagttatgtgcccttatcatgcctttatatatatctccatatcagtatgtataaaagaatcagagggtaaaatgagagccttttgtggttaaatgtcattcaaatttagaaggaggccaggcgtggtgactcatg

SEQ ID NO: 61389 - DNA, 601 bp, Human
caaggtggtgaaacttcgtgtctacaaaaaatagaaaaaaaaaattagtcatgtgtggtggtgtgtgcctgtattcccagttactctagaggctgagatgggaggatggcttgagcctgggaggtcaaggctgcagtgagcctcccaagtagctgggattacaggagcccgccaccacacccggctaatttttgtatttttagtagtgacagggtttcgccatcttggtcaggctggtcttgaactcctgacctcgtgatctacccgccttggcctcccaaagtgctgggattacagacaygagccaccgcgcccggcccttaaaatgttactttaaattaacatacacactcagttatatgttttgattttatttagaactttcattttaagacaagactaagtgaaattgtagaaattagttgagaaatgagactgtgcatttcatattggcctgtggtgtaaaatgatctgacatataatgaaacttagttgaatacaaatgttattttatcagttttgtttttatctgataagttaatttatagttattaaccttgatttgactgtccttttgaaaaatcttgcctaagaaaactaa

SEQ ID NO: 61390 - DNA, 601 bp, Human
agacacgagccaccgcgcccggcccttaaaatgttactttaaattaacatacacactcagttatatgttttgattttatttagaactttcattttaagacaagactaagtgaaattgtagaaattagttgagaaatgagactgtgcatttcatattggcctgtggtgtaaaatgatctgacatataatgaaacttagttgaatacaaatgttattttatcagttttgtttttatctgataagttaatttatagttattaaccttgatttgactgtccttttgaaaaatcttgcctaagaaractaaatgatcatcaaaacactggtcttaaaatagagttcaggctgttttttagcttgatacagttgtctctcttgctttgctttccttctgaaatgatgtttccattttggggactgggaagagcatgattatttatagactagtgtgttttggacaggtggtatgtttacacagatcagtggaattatttgtcccccaagacctttaatatgaatgcatttcattttatcactttttgtaattaaaagagcaaaataattatgtgggtgagtagagaacatcgtctttaattttgtat

SEQ ID NO: 61391 - DNA, 601 bp, Human
gctgaaactttctatattacattttatattttaaaaattaaagttataaagtaaccattagcaatactgcataacagaaactttacaacttaaaatacttctgaaatttagcatgtgcacatatttttgagatttacaactattgttatattaattatgtaggtaacgtcaaagttatatactccaattattataccagggccttttttgccataaaaggtaccaaatcaaagcatcaaatgaaattctttcagtcaatctatatatgttagcagttttctctagtaaaactctacataargaactgctttcttccttatagcaggaactactttcattttattcctttttgagagcccctgcctcttgagaaaatgcttcccatctggttagagactagatgacataatatagtcccattcagaaagatattgataataaaatagtctcttccttttctcttcccttacctgtcttcaactcttctggaacctcctctctgtcctttatctgttatgccctggtgatccagagccatcttaattttaaaattctccatcatattttttattatattgaattaacaattcattctagggtc

SEQ ID NO: 61392 - DNA, 601 bp, Human
aattattataccagggccttttttgccataaaaggtaccaaatcaaagcatcaaatgaaattctttcagtcaatctatatatgttagcagttttctctagtaaaactctacataaagaactgctttcttccttatagcaggaactactttcattttattcctttttgagagcccctgcctcttgagaaaatgcttcccatctggttagagactagatgacataatatagtcccattcagaaagatattgataataaaatagtctcttccttttctcttcccttacctgtcttcaactcttytggaacctcctctctgtcctttatctgttatgccctggtgatccagagccatcttaattttaaaattctccatcatattttttattatattgaattaacaattcattctagggtcatccagatacatcatttaccaggagaagcagttagcttgcctcttgagatatttggccgtttcattattgtgtcacatggttgaaaacctttctttttggatgttgtatatgaccattagtgcttttcagtcttttctgttcttacagttcatatttttacctttctttttgcaaacaaagatgg

SEQ ID NO: 61393 - DNA, 601 bp, Human
gtcttggagacagaaaatatgaatgaaaaagtaacactggtatatggcggtagtgagaaaaaggagttgtttataactgggggggggggtagtaatgaaaactatgttgatggggctacaagctgtgggcagtgagagaggataccacaaactgataccagccagctataaagacttgaaaggaaaatgcaattacttagaggaactgccggaaacaagatcataggtgatatttatcctcaaagtcagtacttttcagacttaattggacagatgtatcatcttggatcttgttaaagcrcatattccgattaactaattctcaggtggttcctaagattctgtatttcaaataagctcccagaggctgctaaaactttaggcatcactcgataagtcatatatgcacattagagtttgagaagcattgctgtatgtcattattttacaggtgaggtaatggaagctcagagaccttagttgacttgctcagtattccaaagcttgtgagaacaaaacctggattcgaatacaaatggcctcatatcagacttcacattgtttccctaatttcttagaaacatggaatgccaaaattagg

SEQ ID NO: 61394 - DNA, 601 bp, Human
aatgaaaaagtaacactggtatatggcggtagtgagaaaaaggagttgtttataactgggggggggggtagtaatgaaaactatgttgatggggctacaagctgtgggcagtgagagaggataccacaaactgataccagccagctataaagacttgaaaggaaaatgcaattacttagaggaactgccggaaacaagatcataggtgatatttatcctcaaagtcagtacttttcagacttaattggacagatgtatcatcttggatcttgttaaagcgcatattccgattaactaattytcaggtggttcctaagattctgtatttcaaataagctcccagaggctgctaaaactttaggcatcactcgataagtcatatatgcacattagagtttgagaagcattgctgtatgtcattattttacaggtgaggtaatggaagctcagagaccttagttgacttgctcagtattccaaagcttgtgagaacaaaacctggattcgaatacaaatggcctcatatcagacttcacattgtttccctaatttcttagaaacatggaatgccaaaattaggaattacaataattgttaaatt

SEQ ID NO: 61395 - DNA, 601 bp, Human
tttggttttttgttcctgtgttagtttgcttaggataatggcctctagctccagctatgttcctgcaaaggacatgatctcattacttttcatggctggatagtattccatggtgttatatgtatcacatttttaaaatccagtataccattgatgggcatttaggttgattccctgtcttcgctgttgtgaatagtactgcgattaacatatgtgtgcatttgtctttatggtaaaacattttatattcctttgggtgtatactcaatagtgagaatgatagttctgttttaagtggcarcggtagttctgggtcattcccaatagtgggaatgatagttctgggtcaaatggtagttctgttttaagttctttaagaaaacactgaactactttccacaatagttgaactaatctacattcccaccagcagtttatgtgttcccttttgtcctcaacctcgccagcatcttttattttttgactttttaataatgccatgctgactggtgtgagatggtatctcattgtggttttcatttgcatttctctaatgagtggtaatgttgagtattttttcatatacttgttggccatgtgt

SEQ ID NO: 61396 - DNA, 601 bp, Human
gttcttgactttcattttccaaaagaaggatttatagagaaacctttatgatgaatttgtttatcagtatattagcaaatatttattgaaactgtgtattctacacatgaaatatatatgacacaaattctgcctccattaagcttactgtttagaagaggtgttaagatttacatgaataattttccccctatattccatacttaaagtttccaccatttcctgaatgtgccagagtctggcagccaggctctatcacagctacttgcatttgcgtattaagcccttctccttttggcaratttttcccccactgtgttatttctttttttgtttgttttttagatagggtctcactccgttgcttaggctggagtgcagtggcacaatcacagctcacagcagccttgacatccatgctcaagtgatcctcccccctcagcctcctgcatagctaggaccataagtgttcaccaccatgcccagctaatttttttttttattttttgtagagatgaggtcttgctgtgttacctaggctggtcttgaactcctgggctcaagcgatcctcctcccttggcctcctggatcaaaaacttt

SEQ ID NO: 61397 - DNA, 601 bp, Human
tccgttgcttaggctggagtgcagtggcacaatcacagctcacagcagccttgacatccatgctcaagtgatcctcccccctcagcctcctgcatagctaggaccataagtgttcaccaccatgcccagctaatttttttttttattttttgtagagatgaggtcttgctgtgttacctaggctggtcttgaactcctgggctcaagcgatcctcctcccttggcctcctggatcaaaaactttcttctttaaaaattcattgcaaatatccttgctttggtgaatctttgtgtattcagrtgattctctgttccctgcatctgtaacacttcattcattactctagaatttgttacattgtattaatatattaggttattcagataattaaagtggttatgatataccattttactagtgcctagtttagaattattggtgtcgatctgcaccattcaatagaaatacaatgtgaaccacatatgcagtttaaaattttctgtaggtagacttttaaaaataaaaagaagtgttaccgaaacaccagaggtttggtctaggtcctgctgcttgccacacagaaagctaatcactaataaa

SEQ ID NO: 61398 - DNA, 601 bp, Human
ttttgaaatgcctttctaggctgggcgtggtggctcatgcctgtaatcccagcactttgggagaccaaggtgggcagatcacctgaggtcaggagttcaagaccagcctggccaacagggcaaagccccgcctctactaaaaatacaaaaattagccaggcgtggtcacgtgtgcctctaatcccagctactcgggagcctgaggcaggagaattgcttgaactctggaggcggaggttgcagtgagttgagattgcgccactgcactctagcctgggtgacaaagtgagactccatctcaaaaaaaaaaaaaaaaaagaagtaaaataaaatgctttctgaagtaagacatttttttcaatacatcaagtaaaaataactttctgggtcttgatgattaaaattttcccttttactatgaatttgatacattttctcatggttatttttatcttaatatgcgtaactcctagtaagatttttcagaagctcatgtattttttattactgttttgtattagataatattctcataattttaaggtggcctttaattgaatattccagaagtagatcttcatgaaatactggtgtgaaacta

SEQ ID NO: 61399 - DNA, 601 bp, Human
agagtatcttcttcagggtcagatatttaataagaaagaggcagagccaggatttcaacccaggcagtctttattcctgagcctttgcttctaactattatacttacaggttactgaatttagtgttggacatgttaagtttaaggtgcatgtgttaccaaaacaccgggggttcagtttagggcctgctgcttgctgcacagaaagccaaccactgaaaaaggagtattggcagggaagaaggctttaatcaggttctgcaaccatgataggagaccagtctcaaatccatctctctgamcaactaaaattaggagtttgtttatatagcaaaagaaatgtaaccatttgtgggaaaacaggaattagtgaggggtaaggaagaggaattggtcaacagcaaacaggcagtgggttaggcaatcatgatgggtgaggggtctggcatcttattgttcaaatgcaatgatctgagaagtttcaattccttgatctgagaggcctgatagttggtttgcagagaaaggaactcagataagacaaatgtaacttgaaactttctcaagtttcaagactgggaggggccatttctgtgtggtac

SEQ ID NO: 61400 - DNA, 601 bp, Human
gatttgtgtacaatcattaaatttaacattttatttattgattaaatagtgaaagctgatcaatctgacattctcttgaactctattaactattcccttcatctacaatttaatgataatcaatgcttttaacaaatcggaagcactacagtttgtaaaacagacttctaaataagatagttaagaataaattatgttcacaagtttcattataatttccaccgtatcctaattatttgacaatttgtaatccacgttatagtaaaaatatcatttttatttgttgacggtcttctagttkcagttcccatcctttacatgaatctcttttatattattactgagatggatggtcacatatccttcttttcccatctctggagttcattacccctcaaggcattcagcaaccagtcatgagtatctatgaatactagacaccaggatatgggatatggcaatgaacaaaatagatactagccctgtcctcatggagtctataacctcattctgattttaaatacataattagaagtatgtaagcaatgtgaagaagaaatagagtgctatagaagaatatgatgggaatgtaacataatgg

SEQ ID NO: 61401 - DNA, 601 bp, Human
gacttcttgtacagttttatgaatttaaacacagatgtaaatccatgtaatcagcaccacaatgaagatacagaagagttccatcagtctaaaacattccttgagttattcctttgtagttatacactcctcctatgcataacccgcgccagctgctgatctgtttgtcattactatatttttaacattttgagaatgtcatataaatagaataatacagtatgtaatgttttgatactttctctttccatacagcataaccctctgagattcatgctggtgttgcttttgtcaataattmattcctttttgttgctgagtagcattccgttgcataatggatataccatgatttgtttatccagtaggacatgtgggttgtttccagtttttggtgattatgaaaagaagctgcttcaaatatttgtgtacaggtttttgtgtaaagttaagtttttatttctgtagatactaaggagtgggattgctgggttatttggtaaatacataactttattttatttatttatttttatttttttgagatggagtcttgctctgtcacccaggctggagcgcagtggcacgatcttggctcact

SEQ ID NO: 61402 - DNA, 601 bp, Human
tttatttatttttatttttttgagatggagtcttgctctgtcacccaggctggagcgcagtggcacgatcttggctcactgcaacctcctcctcctgggttcaagtgattctcctgcgtcagcctcccgagtagctgagattgcaggtatgcgccaccacgcccaactaatttttgtatttttagtagagatgaagtttggccacgttggccaggctggtctcaaactcctgaactcaagtgatctgcacaccttgcctcccaaagtgctaggattacaggtgtgagccgctgcacctggcccataactttacaagaaactgccaaactgttttccagagtagctgtaccattttgcattcccaccagcaacataagagttggagttgctctgtatctttatcatttgatactgttagtatgttttattttagctatcttaatatttgtataaataggatctcattgcatatttaattttttagaatctttattgaggtctaattcacctaacataaaaattacccatttaaaatgttcagttgtttagtggttttagtatattcagagttatgtaaccatcacaatcttaaggttacaac

SEQ ID NO: 61403 - DNA, 601 bp, Human
cagcagattcccatgtctgaagggcctgctttctggcccctagatgactgtctcctcactgtgtcctcacatggtaaaaggggcatggaagcttcctgtctcttttataaaggcattaatcttgatcaaaagggctctgccatcattacctaattgttcaccaaaggcccacctcctaataccatcacattgggggttaggatgtcaatgtatttatgaattttagggtgacacattcaatctataatacctccttctattttctgagattgtatagagttggtatcactttgttaaatgttggttgatcccctccttgaagttatctgcgtctagagatttctgcttttttttgagacggagtctcactctgtcgcccaggctggagcacagtggcacaatctcggctcactgcaacctctgcccccaggattctagtgattctcctaccttattctcccgagtagctgggattatagatgcctgccaccacgccgagctaatttttttgtatttttagtagagatggggtttcaccatgttggccaggctggtctcgaactcctgatctcgggtgatccacacccttcggcctcccaaa

SEQ ID NO: 61404 - DNA, 601 bp, Human
tcaattcttttaaatttggtaaggcttattttatgacccaggatatagtctgtcttggtacatagttccatgtgcattttgaaaaggataagtatgtatattctggtggcgttcctgaaattttctttaaaggttaattacatccacttggttaattgatgttcacttcttctatattcttgctgatttgctgtctacttatattcattttattgattactaagagttatgttgaagtctccagctataattgtatatttatctctttctcctttcatttctgtcagtgtttgattcatayatcttgaagctctgttgtaggtgcatccacactttcaaagtaatgattttttttgatgaattgactcttttatgagatgtgatatctctatccttggtaattttgtttactttgatgcttactttgatattaatagtttcatcttccttttgattagtatttgcatggtgtatctttttccatcattttacttttaaacttcactttatattatgtttgaagtgagtttcttgcaggcaacatatatagttggacatttaaaaaactcattgtgacagtccatcttttaattggtatgtt

SEQ ID NO: 61405 - DNA, 601 bp, Human
taaaaataagttaatagggaaggctttttactatttaaatattacatgatacagaaaaattaatctgattttaattgaactctacaaggtagaagcaatgagacagcacagatatctgtacagagtgaacagaacatatgtacaaagaaaaatagaggctttatagccataaaagcgaagcaagccagtcagtttctcaattgccatggctttccaattcccatgaagcatgcctctatcaaggtttctgtggtggggaccccagctcaccaactgaaaccattatgtctgtgaaacaaaycttttatttaaagtgattgtctgttctttgaaatcagaagaacaacaaccaaaacaaaacaaaacaaaacagattttccacttaaacatttacaaacaagaaaatcttatgtgaatcatattataaaagtttactataaattatatctttgataacctggtaggtaccatacacatttagagtcatccataccccagcttgaatcactgtgttaccatttaccacctgtgtgatttttggacaaatcattgctaagttttaattctcttgtctgtgaaacatttctatggtgtctagcca

SEQ ID NO: 61406 - DNA, 601 bp, Human
cagcttgaatcactgtgttaccatttaccacctgtgtgatttttggacaaatcattgctaagttttaattctcttgtctgtgaaacatttctatggtgtctagccagtggtatattggagctggcttataccagctcacaagagccaattgttaaattttcagaaatcttgtcggctgattgttaaacacaaccattaataagaattatataagcttataattaaataggttatattaaaagcaaagtcaataaatgctcaaaactcatcacttaattattttgctactctgtgttattawttatgtctttttttttttttttttttttttttttttttttttgagatggagtttcactcttgttgaccaggctggagtgcaatggcgccatctcagctcactgcaacctctgcctcccgggttcaagcaattctcctgcctcagcctcccgagtagctgggattacaggcatgcgccaccacgcccggctaattttgtatttttagtagatgtgggatttctccatgttggtcaggctggcctagaactcctgaccccaggtgatccacccacctcagcctcccaaagtgctgggattac

SEQ ID NO: 61407 - DNA, 601 bp, Human
tataattttaagtatgtaaagggacagtgagctcatctttcacatagactattgaaaattgtttccatcaaggaggaaggagaaaggaagaattaatgtctaaggggaataaacgtgtcgcccataagtctggggatatgaacttggaaacttataatacaaaaaataccaatataatgatatcatcatctatgacacttagtagtggaaacacaagagtgctagaaaatgtgaaaggaaatagtatgagtgaaaatatgattgaagctaagtaaaagttgaatatttatggcatgaattracactcactcacaggctgggatgctaaccatggctggcagaagatgcaatgggatggaaaaggaatgttggctataaaaacagaagaaatgtgacaaaataaaggatagttgttaacttagaaaactacattttaaaaaggattatttattcttttctttttttgatattatgtggttaaattagttgattctctggtataattttagtatggatgttaaaattatgcatatgaaaatttggatttggaagtttaccataaaactggacagtattggtatctccctatttttatctgtat

SEQ ID NO: 61408 - DNA, 601 bp, Human
ctgctgttcttatagttgttttatagtactatttcccaccattcaaacctatctgtcctgaaacatgtcaatcattctttagagcctttatattttctgtaccttctgctcttacatctttgcaagtctgactccttatctttcaactctcaggtcaaatgccaccttctccaagtttttctttgactaccgattctaaagtcactctctcgacacttgttcaactatcatatcacctagtttcattttcttcattgccatatgactatttgaaagtgtctcaatttatttaattacttawcttctgatagaatgtcagtttcctaaaagcaagatcctagtatgtcttatactattatctattctggctactaggttctttctctgtctctaatttatttgttgtattccttttaattgataggtatatgagaactcattatactttcccctctagttttatatacatgtgaaattttccacaataaaaagtttttttataaaggattaaatggatttatagtatagaaaaatatttaatacagaatgatatgaaacccaagtttgtcctgtactcttctcctttcttgtattttttgtt

SEQ ID NO: 61409 - DNA, 601 bp, Human
ttgaagaaggtactcaggagctcttcctgattccagggctgggagagggtcagagtacctcctcacaaagtgcttattaattacaagaggaaaacaaattaatttatagtggagatgtctcccacttaagtcatcaccttaatcaagagatcacagtcaccagtaatcaaacaagtctgtcatgtgccatctgattaaatgcagtgtgaagaatagagcatcacttctgtgatattcctgccaaagatgcataacttaaatccaatcaggaggaatcatcagacaaacctgaattgaggcrcattttacaaaataactgtcttgcaatcttctgaagtgtaaaggttaaaaaatcaaagaaagattgaagctgtgtttcagattgccacacttgtcattttctaagttttaaaattatagccatcctggaggatatgacgtgatatctcattgcagtttttatttgcatttatcgtctgggtaatgctgttgagcatattttcatatgcttattagccatttttatttcttctttgggataagtctattcacatcctctgcccattttaaaattgtgtagtctttatattattgcattata

SEQ ID NO: 61410 - DNA, 601 bp, Human
cccacttaagtcatcaccttaatcaagagatcacagtcaccagtaatcaaacaagtctgtcatgtgccatctgattaaatgcagtgtgaagaatagagcatcacttctgtgatattcctgccaaagatgcataacttaaatccaatcaggaggaatcatcagacaaacctgaattgaggcgcattttacaaaataactgtcttgcaatcttctgaagtgtaaaggttaaaaaatcaaagaaagattgaagctgtgtttcagattgccacacttgtcattttctaagttttaaaattatagycatcctggaggatatgacgtgatatctcattgcagtttttatttgcatttatcgtctgggtaatgctgttgagcatattttcatatgcttattagccatttttatttcttctttgggataagtctattcacatcctctgcccattttaaaattgtgtagtctttatattattgcattataagagttccttataaatacaagtccttcgtcagttgtattggcaaatattttctcccattctatgtttaccttttcatgttattgatggtgtcctttgaataacaaaagttataaattttg

SEQ ID NO: 61411 - DNA, 601 bp, Human
atgcataacttaaatccaatcaggaggaatcatcagacaaacctgaattgaggcgcattttacaaaataactgtcttgcaatcttctgaagtgtaaaggttaaaaaatcaaagaaagattgaagctgtgtttcagattgccacacttgtcattttctaagttttaaaattatagccatcctggaggatatgacgtgatatctcattgcagtttttatttgcatttatcgtctgggtaatgctgttgagcatattttcatatgcttattagccatttttatttcttctttgggataagtctrttcacatcctctgcccattttaaaattgtgtagtctttatattattgcattataagagttccttataaatacaagtccttcgtcagttgtattggcaaatattttctcccattctatgtttaccttttcatgttattgatggtgtcctttgaataacaaaagttataaattttgataaagtctaatttatctcatttttctttcattcattgtgcttttaatgtcatatgtaagagaggtttgtcttatcttcagtcatgaagattttcttatttttattttctaagagcaatgtaatga

SEQ ID NO: 61412 - DNA, 601 bp, Human
ccaatcatggttcactgcatcactacaacctcaaactcctgggctcaagagagccttccgcctcagccttttgagtaggtaggactacaggtgcacaccaccatgcctggataatttttacaaatttttttgtagagatagaatcttgctgtgttgcccaggctgatctaaaacttctggcctcaagcgatccttctgcctcccaaagcactgggattgcaggtgtgagtccccacccctggcctcactgtctttttgcttattctctgctctgtggtataaagatattgttgaaaatgtaaaaaaaaaaaaaaaaaaaaaaaaaagcctgtacatacccctatgggttatagtgataagaaaaagaggaagcctttatgttgatgttgatatgtagtagagaaagcccagctattggagaaactggatagtagtttaaatgtgaaatgtcttacagaagagtatggtgttggaatgaccaccatacatgtcctaaagaaatagaaggatatatgtatacatatatatgaacatatagaaggatacacacacacacacacacacacacacacacacattattcagccacatttaaaaaaga

SEQ ID NO: 61413 - DNA, 601 bp, Human
tggaatgaccaccatacatgtcctaaagaaatagaaggatatatgtatacatatatatgaacatatagaaggatacacacacacacacacacacacacacacacacattattcagccacatttaaaaaagaatgaaatcctgtcctttacggcaatatggatggacctgcaggccattgtgttaagtgaaataaactaagcacaaaaagataaatatagcatgttctcattcatatgtgggagctaaaaaaatagatcttatgaaaataaggaatagatttgtggttaccagagacggggraggggaggaggggatatgaagggaaaataaataatataaaagtatttattaccactgaagtatacacttaaaaatggtaaagatggaccagccatggttgctcatgcctgtaatcccagcacttgggaggccgaggtgggtggatcatttgaggtcaggagttcaagaccaacctggtcaacatggtgaaaccccatctctactaaaaatgcaaaaattagccaggcatggtggcgcatgcctgtaatcccagttactcaggaggctgaggcaggagaatagcctgaacccaggaggcgg

SEQ ID NO: 61414 - DNA, 601 bp, Human
gtaaagatggcaaattatgtatgtatattttacctcaataaaacatgaagaagaaacagaaatataaactgttgaagttctgtggtgaacgttatgaacagaagttaattaaaaatagaaaaactgcataaagctaaaaatgaattatcttgatcatacattgtaagagtggacccatcagcattccagtgaatacatgccatttaatggtatgctgttcataaaacaagcaaagatctttcatggtggactaaaaattaaagggaactgtgaaccaaaaaattaagggaacaggctggcmttaactttttaaagatttgtggtgaatgagcatctgctgatcacaaagcagcagagaaattgactagttttccaagggatcgctgatgaaaatcagataccagaacaagtctataatgctaatgaaacattactgtttggtgttattgccccagaaagacactgactacagctgatgagatagttcctataggaattaaggatgcctatgacagagtaactctactgggatgtactaatacagcagacatgtataactataaacttgctgtgatagtaaaaagcttgcatctttacactt

SEQ ID NO: 61415 - DNA, 601 bp, Human
cattcataacagaacaagatatattggtcagcttataaaattaaagagtgacttctaaatcaaaaactgttgctaatgaagcagatgactctggaggaaacactttaaaaagccatccagcagatgtgtccttatccctagaggacccacttcctggtccctcagttgcttccaatattttatctcacctaaaaaaataaaatactgtgtacacaataaccctttaatcaaaacatagaattgtaggttgttgctgttgtctaacagctgatacagatattctggtgatgctactgtgttkttaccgtgaatgcattatttttcactttgttaatggtatgccttaatttttcctgataagtacttatgtgtgaatatgtgtaagagagtgattgcttgtcattatagtgtataaattcaaagttgggattgatggtgatgccaaacaaccacagatcatttacatgggtggctgagctagtgacacctttgctttctgattgttcagtgtacacaagctgtttaatgcgcaaaattattaaaaatattgtataaaattaccttcagccgatgtgtgtaagttgtatatataaaacataag

SEQ ID NO: 61416 - DNA, 601 bp, Human
ccacagtatagtctgccaaattccaaattaactttacatttgcctcaatgccagccaatctaatcttcttactaacttgctcatgcattatgctggactgatttcagtattctgttctaagtcagttatgcaaactattttccttatttgtttatatctcttctctctgactactagatctttcttagcctccgaaaatctaggtcaagttccatctacaactactttcaaatacagttgtcctttggtatgtgttgagggttggtttcaggactcccctcagatatctatcaaaatctgygggtgcccatgttccttatataaaatggcatagtatttacatataacataagtacattttcctgtatgttttaaatcttctctggattacttatcataccttatgcaatgtaaatactatgtaaatagttgtattgtttttaaatttgtattattttttattttcttttttttccaaatattttcgttctgcagttggttgaatctgaggttggttgaatccaaggatggggaacccatgaatatagagggctgactgaatatgctcccttttttctgaactttttagtgtattggtagt

SEQ ID NO: 61417 - DNA, 601 bp, Human
catgcatatgtattaatagaaaaaatacgccagtatagtggctgagattgtcatgaggattaggagcactgatgtttttatataatgaaggtttattactcttatcacaagaaactttttttttttttgagacggagtcttgctctgttgcccaggctggagtgcagtggcgcaatctcggctcactgcaagctccacctcccgggttcacaccgttctcctgcctcagcctcccgagtagctgggactacaggcgcccgccaccattcctggctaattttttgtatttttagtaaagacrcggtttcactgtgttagccaggatggtctcaatctcctgacctcgtgatccacccgcctcggcctcccaacgtgctgggattacaggcatgagccaccgtgcccggcccacaagaaactttttaaacaaattttcagttaaactgaatgagtagaggtttgacctaaaactaagatttactatagagttttttttttttagtttgagtgctgtgtcaattctagagactacatattatgtcctgttcatatctttctaggaggatttgcttcattcatagacgatttataggtttctgaa

SEQ ID NO: 61418 - DNA, 601 bp, Human
ttatccaacatttttagatgttttgtgctatgaaggttgctcagagtatctaatttactttgtttccagaaatgaaagtctcagtctcttcaacctcaactaaaaataactttgtttaaaaatgcaccagattattttactcccctgcttactatcttttaaagtgttacatggccccttcatctggcggtccctctctcttcagcctcattttacattactttctctttcatttggtattgttaatcactgttggttttctttcccaagtcaaccttgctctcaactcccgcttattatyatttttcctgcctcacatccctcagctccttctttatatctcaactgaagtgtttcagagactttctggatctttttataatgggttagtgcctgtcgatgtgctcccctagcattctgtgccttcctatttattacatacattgattgttcttctaattacttctttacgtctgttttctctcaaagcacagggaatgtgtttgcctccttcatcactatatccttagttaataaatagcatggtgcctggcatatagtagacactttaaaaatatttgctgttgaatatataacattg

SEQ ID NO: 61419 - DNA, 601 bp, Human
tggcatatagtagacactttaaaaatatttgctgttgaatatataacattgatatttaagattcattattaccctatcgtatgaattaagtagctcaggtagtggtattacaattaagtcattctcttgattaagtttgaattggttttttttttaatttgtctttaggccctagacattttgaattaatctgattttgtatgaaataattttaaacttacagaaaagttgcaagaatattacagaagagttcatatatactctttacccagctttccttaatgttaaaacgtactcaatygtagtgcaattaccagaactaggagattaacatgttggtatagtattactgactcaactacagaccttactcaagttttaccaggtttttttcttcatgtccttcttggtgccaggaaccaattcaggatctcacgttgcatttggttgttgtgactcttcagtatccttcactctgtgacacttccttagtcatgactttaacactttgatgcgtattgtgctttgataattgatttgtacaatatctaagtttatttctgcctgatgttttctcatttttggattcaggttgtgcctt

SEQ ID NO: 61420 - DNA, 601 bp, Human
aggtttttttcttcatgtccttcttggtgccaggaaccaattcaggatctcacgttgcatttggttgttgtgactcttcagtatccttcactctgtgacacttccttagtcatgactttaacactttgatgcgtattgtgctttgataattgatttgtacaatatctaagtttatttctgcctgatgttttctcatttttggattcaggttgtgcctttttgtcaagaataccagagaagtgatgttgtgtccttcatagtgcatttttttcagggggtacctgtagttgctatgtcttaytttattggtagtattaaccttgattacttgtttaaagtggtgtctgccaagtttctccatggtaaagttactgtttctccctttggattgataaatatcttcttgttcctcaaactttgacccattgatttctattatctatggatggatcttgctcgcaagggttactactgtggtatttgcctagtggtaattctatatttttctcatttcttctacatttattaattagaattattctataaggaagagctgttctttctcacacatttattcagttatttatttattcatatcaac

SEQ ID NO: 61421 - DNA, 601 bp, Human
aaaactgactaatacatacacatatctgtatttctatatctatttgcatatatattaacaaccatgagttcacactgttaacctctgattttactctatcactctatcatacaaattttattgtagctccccagggtacagttccccagtaccctttctcctattctgtacttgaaatttacctgatattccttgtatcaagagatagagactagtaaatagtcaatcatttaatgtgttgaatatgctcagggttatgttggtcagtaatgtctctgaaaagggttatttaagagggtgkcagatgactagggagaaaatgtgactatgaatgttgggatttgggaaaagagatggtttggggatacttggggaaaaaaaatgttcagacgggagaacaaacatcatgtattaaggtccagagataaggaaagtatggctgctcccaggaactgaaaattgctcaggatagctatataggttgagatatcagatgaattaaagctgaagagaagtagcactgactcttgtaagactttataaactatgttgcagggtatgaacagtatcctaagaacaacagagagttactattttaagc

SEQ ID NO: 61422 - DNA, 601 bp, Human
gaagagtgtctttatcagacaaacaagtggctgcatttctggtctaatttgaagaatactgaaatgtcccagaatatagaggaagagagaagtatataaaaccctggctttgagggaatttgagctaagaacttaattttctttatttggttatgttgctgtgaaatcagaataaaagagaatattgcaggaattttgcaacaaagatgtagtttatggatgttaaagaattaacaaaggataacccatatctggattttttaatactttttttaaaaaaagaaatctgtctttcctatctttttttttttttttttttttttgagatggaagtcttggtctgtcgcccaggctggagtgcagtggcgtgatctcggctcactgcaagctccgcctcccgggttcatgccattctcctgcctcagcctccctagtagctgggactacaggcacccgccaccatgcccagctaatttttttgtttgtttgtttttttgtatatttagtagagatggggtttcaccgtgttagccagggtagtctcaatctcctgacctcgtgatctgcctgcctcggccgcccaaagtgctgggattacagg

SEQ ID NO: 61423 - DNA, 601 bp, Human
gcaacaaagatgtagtttatggatgttaaagaattaacaaaggataacccatatctggattttttaatactttttttaaaaaaagaaatctgtctttcctatctttttttttttttttttttttttgagatggaagtcttggtctgtcgcccaggctggagtgcagtggcgtgatctcggctcactgcaagctccgcctcccgggttcatgccattctcctgcctcagcctccctagtagctgggactacaggcacccgccaccatgcccagctaatttttttgtttgtttgtttttttgkatatttagtagagatggggtttcaccgtgttagccagggtagtctcaatctcctgacctcgtgatctgcctgcctcggccgcccaaagtgctgggattacaggtgtcagccaccacgtctggcctgtctttcctatctttttatatctgaccaatattgatgttcatcataaatgtgttttctctttagctatatgtcttagtccatcctttctgctataacaaaatactttagtctgggtaatatataaataatagaaatttatttctcatagttctggaggctgggaagtccaggatc

SEQ ID NO: 61424 - DNA, 601 bp, Human
agtcttaataataattttgatctgttgctttgcaagagtgaaaaagaactaggattactaatagtttagttaaaagtggatctaactagatagatttacttaacaaaatgactttaaataatggtatactttgtggtatataaagtgattaattagctaacagaattagaaaataaaaggccttcagttaaaaatacctaattctcttgaaactgtcatctgtatacaaagtagtattttgtcatatttgttaaatggagaagagtgctggaaaaaaaaatcccctttttattgtcctttragagaattcatttccagatttatatccagatatatgtggatatattcatttacatatgtactaattcctgaaattgattggtctgaataattagtctacagtcaagaagtcctctttcaaattgcctttccttgactttataaaagaaaggcttgtctcttacgcaatctaaattttgctgtgatacgttgttgccattttggatcccaaacaaaggaattctctgaaatactcaaatactcattgtaggtattaagaaagtgagtaacagggtaacaaatcctttgcaagtccagtttt

SEQ ID NO: 61425 - DNA, 601 bp, Human
agtgaaaaagaactaggattactaatagtttagttaaaagtggatctaactagatagatttacttaacaaaatgactttaaataatggtatactttgtggtatataaagtgattaattagctaacagaattagaaaataaaaggccttcagttaaaaatacctaattctcttgaaactgtcatctgtatacaaagtagtattttgtcatatttgttaaatggagaagagtgctggaaaaaaaaatcccctttttattgtcctttaagagaattcatttccagatttatatccagatatatrtggatatattcatttacatatgtactaattcctgaaattgattggtctgaataattagtctacagtcaagaagtcctctttcaaattgcctttccttgactttataaaagaaaggcttgtctcttacgcaatctaaattttgctgtgatacgttgttgccattttggatcccaaacaaaggaattctctgaaatactcaaatactcattgtaggtattaagaaagtgagtaacagggtaacaaatcctttgcaagtccagttttttgttttcactgaaactgaaagaagacttaattgta

SEQ ID NO: 61426 - DNA, 601 bp, Human
tgaaactgtcatctgtatacaaagtagtattttgtcatatttgttaaatggagaagagtgctggaaaaaaaaatcccctttttattgtcctttaagagaattcatttccagatttatatccagatatatgtggatatattcatttacatatgtactaattcctgaaattgattggtctgaataattagtctacagtcaagaagtcctctttcaaattgcctttccttgactttataaaagaaaggcttgtctcttacgcaatctaaattttgctgtgatacgttgttgccattttggatcycaaacaaaggaattctctgaaatactcaaatactcattgtaggtattaagaaagtgagtaacagggtaacaaatcctttgcaagtccagttttttgttttcactgaaactgaaagaagacttaattgtaagcttatttatcattaaaattaattttcaataaatcaccatgtggcttttggaaaatacataggcattcaaagattgacattgctgcaacaaactttcattctgatctacttatttatgttaacaatatttcttaacatttatgtctataagatgaaaccaaatacataaa

SEQ ID NO: 61427 - DNA, 601 bp, Human
tgaataattagtctacagtcaagaagtcctctttcaaattgcctttccttgactttataaaagaaaggcttgtctcttacgcaatctaaattttgctgtgatacgttgttgccattttggatcccaaacaaaggaattctctgaaatactcaaatactcattgtaggtattaagaaagtgagtaacagggtaacaaatcctttgcaagtccagttttttgttttcactgaaactgaaagaagacttaattgtaagcttatttatcattaaaattaattttcaataaatcaccatgtggctkttggaaaatacataggcattcaaagattgacattgctgcaacaaactttcattctgatctacttatttatgttaacaatatttcttaacatttatgtctataagatgaaaccaaatacataaagtagttattgaattaattcaagtagttattgaattattatggcatttaatttccattataattttggaaattgtataattgtataattatacaattggattgtataatggaataattgtataatggaaattatacaatttccattatacaattaaaacaaagtccttgtattttaaa

SEQ ID NO: 61428 - DNA, 601 bp, Human
tacataggcattcaaagattgacattgctgcaacaaactttcattctgatctacttatttatgttaacaatatttcttaacatttatgtctataagatgaaaccaaatacataaagtagttattgaattaattcaagtagttattgaattattatggcatttaatttccattataattttggaaattgtataattgtataattatacaattggattgtataatggaataattgtataatggaaattatacaatttccattatacaattaaaacaaagtccttgtattttaaaatgtaaatrattgcagggtaccagaaattacattgtttataattatttaaatgtgttcaaaatcagttatcatgacttaacaattgcaagatagttattcaaaattattttagaagttacaagggcaaaaatcatttgaaaaccactgttacattcctcccactttactaatgaattatgcccttgtttgaattatttattgatatttcatttattgttgttctttacctagcagacattaggtaaatactcattgggataataaatagcttggattgtattgtatctagtgccagtgagattgatttt

SEQ ID NO: 61429 - DNA, 601 bp, Human
ttgtgtagggactacttaagcctagttatattcagaatcattttgcagaaattagcagttttagttagaaatttgcaattaggaaaagacttagagattacctattcaaatgcccttatttttcaaagtgaaaacaggcctagagtgttacttgctcaagctaatataggtagttggcaacagaaccatatctagtctgcactaaaacctactgattttacctccagaatatcttttgaattttttcacttctctgtctccagtgccctcaccctagttgaggctattgtgatctctcccstggtatctactgtactacgtctcactggtctcccgacaaccttatttagaaagcatatttgatcatactattctctctgcttaaaatccttcaaaaatgtctcattggtctcaggaagaaggctagtcctttattctaccctttgtatatttgtgagattatttgattaaagtttttttcctcagatagactgtagactgtaatgtcaaagggcagaatttatgtttattttgcttatcgctgtatccctacccctgccacattgcctggtacataggagggacttggtacttgttgaat

SEQ ID NO: 61430 - DNA, 601 bp, Human
agaatagagttcaaacttcataacatgggctttgtgcgtgaaagggcctttacctgcctccctgacctcacctcctatcaccacctggtggcagtaacattgtgagctgctttcagttctttaggcatctcagtttcttttctaacatgctgttccctctgttgggaattattttatccttgttctttcttatcctttaggttcagtcttagattaaatgtcatctcttaaaaagagatcttttctgatcatttcttactctgccagaaaggatagccatccatcccagttcttacactctatctcatcaccctatttgttgtcttcattcactttttatagtctataattctttgtttacttgtgtagatttctttctgtctcagtcactagaatgtaaactgtgtgagggcaggacctacatttatctcattcatcatatccctagcatttaatagagagcctggcatctaataggtacaattattatttgttgaataaatacatattattaatataattcacatataaaattcactcttttaaagtgtataattcaaggctgggcatggtggttcatacctgtaatcccagcattttg

SEQ ID NO: 61431 - DNA, 601 bp, Human
gaattattttatccttgttctttcttatcctttaggttcagtcttagattaaatgtcatctcttaaaaagagatcttttctgatcatttcttactctgccagaaaggatagccatccatcccagttcttacactctatctcatcaccctatttgttgtcttcattcactttttatagtctataattctttgtttacttgtgtagatttctttctgtctcagtcactagaatgtaaactgtgtgagggcaggacctacatttatctcattcatcatatccctagcatttaatagagagcctrgcatctaataggtacaattattatttgttgaataaatacatattattaatataattcacatataaaattcactcttttaaagtgtataattcaaggctgggcatggtggttcatacctgtaatcccagcattttgggaggctgaggcaggtagatcacctgaggtcaggagttagagaccagcctggccaacatggtgaaacatcatctctagtagaaatacaaaaattgggtgtggtggtgggcacctataatcccagctactcaggaggctgaggcaggagaatcacttgaacccggg

SEQ ID NO: 61432 - DNA, 601 bp, Human
cttttgcatgtgactatccaattgttggagtgttgttttttttttactttaataaagtatcatatttttcacaaaatatgaacattgtttcaacatttacaattttaaaaatagtgtgtggagcacatactgtgtaccagacattatgttgggtatgtcgtctatacagatttaaaaaaagacataatccccatcctccatgtctcacagatctggaaattaagaaaattgagaatagtaatgaaaatttgaatggaacattaaagatatttgatggtgttgatagtggttttaaataaayggtttttgagaagattggccttttatgtatttaacccaaagattgcatgaaaaagcttgatgacattattagtataaaaataaaaatattcctgaatgttgctgtaaaaagcacttgatggtggctgctatgcaataggagtattttaccttgattggtactctttttttttttttaaacacccctggttttattttcccttcactccaattttctcacttgtttgcttttttttaaaattttattattattatactttaacttttagggtacatgtgtacaacgtgcagacttgttaca

SEQ ID NO: 61433 - DNA, 601 bp, Human
aaagatatttgatggtgttgatagtggttttaaataaatggtttttgagaagattggccttttatgtatttaacccaaagattgcatgaaaaagcttgatgacattattagtataaaaataaaaatattcctgaatgttgctgtaaaaagcacttgatggtggctgctatgcaataggagtattttaccttgattggtactctttttttttttttaaacacccctggttttattttcccttcactccaattttctcacttgtttgcttttttttaaaattttattattattatactttaasttttagggtacatgtgtacaacgtgcagacttgttacatatgtatacatgtgccatgttggtgtgctgcacccattaactcgtcatttagcattaggtatatctcctaagaatcattttctttttgagacagtctctgatgcccaggctggagtgcggtggcacgaactcggctcactgcaaactctgcctcctaggttcaagcgaagaatcattttctattaacagtaatttgcggggtggatgagaaagcaattgtctgtcatccacaaatgcaaggtggagataagacaattataga

SEQ ID NO: 61434 - DNA, 601 bp, Human
tatgcaataggagtattttaccttgattggtactctttttttttttttaaacacccctggttttattttcccttcactccaattttctcacttgtttgcttttttttaaaattttattattattatactttaacttttagggtacatgtgtacaacgtgcagacttgttacatatgtatacatgtgccatgttggtgtgctgcacccattaactcgtcatttagcattaggtatatctcctaagaatcattttctttttgagacagtctctgatgcccaggctggagtgcggtggcacgawctcggctcactgcaaactctgcctcctaggttcaagcgaagaatcattttctattaacagtaatttgcggggtggatgagaaagcaattgtctgtcatccacaaatgcaaggtggagataagacaattatagagatgacaaagaaatcagtctctctttctctctctctcagtgtaactgtgtgtctctattttagtataactcactgatttaatatttatttaactcagagcaaaggaatctctaagacagtgttctcaaagtcattctttacctgttttttattttttttctctcgtt

SEQ ID NO: 61435 - DNA, 601 bp, Human
agtgcggtggcacgaactcggctcactgcaaactctgcctcctaggttcaagcgaagaatcattttctattaacagtaatttgcggggtggatgagaaagcaattgtctgtcatccacaaatgcaaggtggagataagacaattatagagatgacaaagaaatcagtctctctttctctctctctcagtgtaactgtgtgtctctattttagtataactcactgatttaatatttatttaactcagagcaaaggaatctctaagacagtgttctcaaagtcattctttacctgttttttattttttttctctcgtttgacttccttttttctgttactgctaatcttacaattgttgatatatctttctaagatttgtacttatttatgcttgctctctctgaactaggcttagtcttttgtgactaattattgaattcaggacatatttagcccattgtattagtctactcagactgccatagcagaatactacagactgggtgctttaaacaacagaaatttgttttctcgtatttctggaggcttgaaagtccatgatcaagattcaggcagaattcgtttctagtaaggcctctttt

SEQ ID NO: 61436 - DNA, 601 bp, Human
ggggcagtgggggaatctctggtgtctctttttttataggaacattagttttgtgggattaaggctccattagccttaagtcctcatttaaccttagttgcctctttaaaggccctgtctccaaatacaagtcacattgtggggttagggctcccacatatgattttgggtacacagttcacttcataatacccatgtagcacgtagtagtcacttttatacagttaatatgtttatattccttatttgataataaaatacagtgatttttctataaaacttatattgatattggggtggrgaaaactcatgtcacctaggctctttgtacctcagttttctcatctataaaataacaatattgggctcgttgatttttgaatgctgaaattctctgattctccaattcagagttactgatttctaacattattcagcaggtacattataggaaacatcttataatagaaattgatgttctgtaaatgagcattctataagcttctcataactgaagtgaaaggcttaatcattctatatactggtatagataatctatttcctgtggtcccagctactagggaggctaaggtgggaggat

SEQ ID NO: 61437 - DNA, 601 bp, Human
caaaggaggtaaccacaacagattgttatgcatccttgcaatctttctatgaatgtacatatgaatattaacttatgtacatattttccattaatgggatcatgctatatatattctgttatttattttttcctcaacaatgtttcttgattttttatacacaccaggatgtatgtatattattttttaaatgcttaatgttacataatatcataatgtacttaaccactccccttttggacatcagtttgtttctttttcactattaaaaataatggtaaggctgggcgtggtggctcamacctgtaatcccagcactttgggaggccgaggcaggtggatcacctgaggtcaggagtttgagaccagcctgaccaacatggcgaaaccccatctctactaaaactgcaaaaattagcggggcatgatggcaggcacttgtaattccagctacttgggaacctgagacgggagaatctcttgaacccggaaggtgtaggttgcagtgagccgagatcatgctgttgcattccagcctgggtgacagagcaagactctgtcttaaaaaaaaacaaatggtgaatgaatatccttggaaata

SEQ ID NO: 61438 - DNA, 601 bp, Human
gatcatgctgttgcattccagcctgggtgacagagcaagactctgtcttaaaaaaaaacaaatggtgaatgaatatccttggaaatacagccatttgtatagagattcctttagaatacatttcctacatgtgggattaaacactgaaaattttaatagctattgccaaattgtcttcctaaaatttacatttccatcaacaaggaatgagtgtgttcatttatcattaccattgccacatgataccactgttttaaaactctttctaacctgatggttgaaaagctatatttcctttttyaaaaaagttgcatttatatgacatctggcatcctttcatttgttcattggccatttatatttctttttctatgaaatgctgtaatttacctacttatggaatcaaatatctttttaatattgacttgtaataatttttaaaaatatattttgcatgttaatcatttattttaaatgttgtagatatatatttatgctgcttctcttttaactttgcttgtggtgttttatggaatggaaattttttattttctgaaagtgtcaatcatttcctttatggcttctgtgttttgtgtaatat

SEQ ID NO: 61439 - DNA, 601 bp, Human
tctgtcttaaaaaaaaacaaatggtgaatgaatatccttggaaatacagccatttgtatagagattcctttagaatacatttcctacatgtgggattaaacactgaaaattttaatagctattgccaaattgtcttcctaaaatttacatttccatcaacaaggaatgagtgtgttcatttatcattaccattgccacatgataccactgttttaaaactctttctaacctgatggttgaaaagctatatttccttttttaaaaaagttgcatttatatgacatctggcatcctttcattkgttcattggccatttatatttctttttctatgaaatgctgtaatttacctacttatggaatcaaatatctttttaatattgacttgtaataatttttaaaaatatattttgcatgttaatcatttattttaaatgttgtagatatatatttatgctgcttctcttttaactttgcttgtggtgttttatggaatggaaattttttattttctgaaagtgtcaatcatttcctttatggcttctgtgttttgtgtaatattaagaaggccttccccatgtggaattattgaaatgttctat

SEQ ID NO: 61440 - DNA, 601 bp, Human
aaaactctttctaacctgatggttgaaaagctatatttccttttttaaaaaagttgcatttatatgacatctggcatcctttcatttgttcattggccatttatatttctttttctatgaaatgctgtaatttacctacttatggaatcaaatatctttttaatattgacttgtaataatttttaaaaatatattttgcatgttaatcatttattttaaatgttgtagatatatatttatgctgcttctcttttaactttgcttgtggtgttttatggaatggaaattttttattttctgraagtgtcaatcatttcctttatggcttctgtgttttgtgtaatattaagaaggccttccccatgtggaattattgaaatgttctattttttatagtattttatatcatctctttaactccattttgagtttcttctaaattgatggctggttcacccagccctattgatgtataattcattcttttctcactgagatttgaagcctcctttattgtaatctaaatttgtatacattatgcagatttacttctagactctgtattctgttctttttgctgtgtttttctcatttatttact

SEQ ID NO: 61441 - DNA, 601 bp, Human
cctgacctcaggtgatccctctgccttggtctcccaaaatgctgggattacaggcatgagccaccacacccagccagataaaacaatctttaaagcaaagaaataaattcttaggagactgattcatgggtagaatattcatgctttaacacatgaagtttatgtatattttagtttctcagaggcctggattttttgtttctgaattcttggtgatactataaatagttgatgttgaatatacaacctatgtgaacgttaatatatattaaaaattattttagaagagaagctatgtttraatcattttgctgaacaattgtatttctattgctttatgttaataaaacttgtctgttaagaggaaaacacagtaaatacgaccaagcccatgttttgcttttgggttttctttcctaacaatagagaataaaataaaaataattagataattaagtagaataagctgttactcttattttatatcagctatagctagatgttagttattataagagctgcatctgttaccatagagcttccttaacgcaaactcagcttttaaaaaaaaaaaaagcaagggaaaaagaaaaagagaaag

SEQ ID NO: 61442 - DNA, 601 bp, Human
catagaacaaaatcaactcgtttttcccagaaacacattatacattcatgtcttcatacctttgctttgcattttttccttccctaagatatttattctcttgctgaatgaattctactcagctcagctcctagtaccttgaattttacttgatcaattctgtctacagttttttttctcttctaaagtcttagaacacttgttttctccaacattgtaaatttattatagtagagctttaggaaagtctcattcacttaaagaaggtttgtgtgtggtcttacaaagaggttttttttgktttttttttgttttttttgtttttgtttttttgaaacggggtcttgctctgtcacccaggctggagtgcagtggtgcaatcttggctcactgcaacctccacctacctcagcctccagagtaggtgggattacaggcacccaccaccacacccagctaatttttatatttttagtagagacgtgatttcaccatttggccagtctggtcttgaactcctgacttcaagtgatctgcccgcctcggcctcccgaagtactgggattacaggcatgagccatcgcactcggcctgaaaaggt

SEQ ID NO: 61443 - DNA, 601 bp, Human
gttcactttttcagagaaatacatataaagttgtcattttaaaaactcaaaaagtaatcttagtttttgtttccttagttttctcaattggcctttggacattaaatttaaatattgttttcctgtctttcagttacagatgaggacacagtaaagaggtattttgccaagtttgaagagaagtttttccaaacctgtgaaaaagaacttgccaaaatcaacacattttattcaggtgagtaattaagagacttttttttttgctgccggggaaggataaattgtaccatatcattgtttraacttctgatcaatgtttttaaattgagtcttgttttccttactatactgcacttaagaggtattttcttgagctgggataagaacacgtctggtttctcaatgtttaagctttctgtggtcattgcctagaaactcttgcagtcaaaaggatattgggacttcgttgagaggcaatacctcggtagagcttcactgtggcccagttcaaagcttgaagagtcagaaacttgattttatcattttggccagagatgaattacacagttccagcttatcagtgatggcagttttatacctt

SEQ ID NO: 61444 - DNA, 601 bp, Human
cttatcagtgatggcagttttataccttttcattgcctagaacacttatacttatttctctaaagcactggcctccagagtggcatctacagtatgccactcgaatgtgagaataaaatattggaacttatatatatatttatgtctgactcttttgaactttattttttgtacatgtatgttgcaatgtacataatatacattagtaaaacaatgtctttatagtgaaaaattttggaaactttagagcactaccgtagacatcaggagtcctgtgagacctagttaataatcagatagyttcatgagtacagaatctgaacaaagtgagttagattcagaaggatatttcatctagactctggaaacgttacacatagttcctgttacaccgccagatatacagcctaatagctggaatacctatcctattgaatgtaatgtatctattccctgagcagtaattgatgaaaaaaaaagtagtctgtaattttatttaatatccaaaatataaaattactctattttttattttcatatttaatatgcacattacatgcctgctattgagaatatattctcatctcttggcaaagacttt

SEQ ID NO: 61445 - DNA, 601 bp, Human
catgcccagctaattttttttatatttttagtagagacggggtttcaccgtgttaaccagggtggtcttgatctcctgacctcgtgatccgcctgcctcagcctcccaaagtgctgggattgcaggtgtgagccactgtgcacagccaaaatataaatattatttaaagccatgcaaacaggtagattttctgtatgggaaaaatatacagaaaggatttcagtgttctcaagaagaaagataatttctataattaggagatagaaagataaagaggaaccagcaatgtagacagagaagwccatatagcaggaggaggaggaggaaactaaaagaggagggcatttgcagtgaaacaaatgtctagattgagaaagcgtattggaaatgatgtaaggctgtagactatgaatatataaaatcaagtttattagcttttttcttttactatgacattttttgaaaaagaaggatctctaagctcaattctaaatggatgatttgtatcacaaagaatagaaaatgcttctttgtttatgaagaaaaatatctactcttggtagtagatactttgttttttttgtttgtttgtttttgagac

SEQ ID NO: 61446 - DNA, 601 bp, Human
tgttaaccagggtggtcttgatctcctgacctcgtgatccgcctgcctcagcctcccaaagtgctgggattgcaggtgtgagccactgtgcacagccaaaatataaatattatttaaagccatgcaaacaggtagattttctgtatgggaaaaatatacagaaaggatttcagtgttctcaagaagaaagataatttctataattaggagatagaaagataaagaggaaccagcaatgtagacagagaagaccatatagcaggaggaggaggaggaaactaaaagaggagggcatttgcartgaaacaaatgtctagattgagaaagcgtattggaaatgatgtaaggctgtagactatgaatatataaaatcaagtttattagcttttttcttttactatgacattttttgaaaaagaaggatctctaagctcaattctaaatggatgatttgtatcacaaagaatagaaaatgcttctttgtttatgaagaaaaatatctactcttggtagtagatactttgttttttttgtttgtttgtttttgagacaggatctcactctgttgtccaggctggagtgcagtgtcatgatctcggct

SEQ ID NO: 61447 - DNA, 601 bp, Human
ttccacacacttgcttataaaacaaacagattgattcccaaccctctagggttccacatgttaggatcagaagctattttcaatattcagaaaacctgatgtaagttactttgttagtctttattgtttattatgtatctttggttaaaaaattgacatttatttagatttatagataaaatcagtatttgaagatcataggaagagaagggaattgtgaaagggaggggtcctttgtggtaaaaacattgctaatccctaacctagaagtctcttagttctcttctgtcactaaaaatgrtatcaatcatgaaggctataccgttagaaacctttttttttgtggtgatcagtaatgtctttttccagtggacaagtgatccaactgatcacttttttcaaaccagtttgccttttctctttattcaaaatacttagtttctaaacagtgtttatttgcctaatgttaaaaaaaaagtcagaatatatgtgttgcttctaatatttcacaaaacagtcaagccttttttattggctggaattttgaaatagctaagtgctttttctttgtttttgaataacttcttttttttctggatga

SEQ ID NO: 61448 - DNA, 601 bp, Human
gtgtgcaatgaatcatgagaatcttttacactgaaatagtaaatgttcattttacaaatgatacatgtgtctagtatgcatgtatttaaactatgacttaatggctggttttgttctttgctcatgtgtgtgttaaaatgtagattaagtaggtatttttaatgagagtggtcataggttggtatattgttttaaattcccatgtgttaacgtatcttcctgtgtcatgattctcttgagttcattacagtagaatcagttacttaagaactgtttaaaggagcagggagggtagtagggraagtgaaattaaagcagccactcttgcttgctttgttgttaatacatctgaaggaaattacaattacaatatttatattgtccacaataaattttcctttctttattttgttaaaaaaaagtgttttataagcatctattaaaaacaagccacgtgaaaaccaccctcattttctttctctcctttttttctctttccttccttccttctgtctctctcctatttttccttttttctttctgagactgaaagaaaggatgaggaatgtctatggtcatgagtaacacaatttccaaatgg

SEQ ID NO: 61449 - DNA, 601 bp, Human
aaatgctcttaagggaggttgtttggggatggctgtagggagaggtgggatttagtgctccagagcaagggaaaaaatctatccagatgcacagtggtgttaaagtacatgacatatttggggatgaagacaataacaaatagtcttttgaggctgaagttgtaagatattaaggagtgagttgctggttagagagaaaagtggaaaaattagatgttttattcacatacagatttcagactttggtatttgaggtacacagtttcaagtagtaagaattccagataaaagataaaagcartataaaaaatgcatgtaatgtaacaaagttaactatcttgaatcatctgtgatgggtcaacattctcataaacttactttatattttgaataacaccaaggtccataaattgaattagcaagatggtaatattgtaagacaggtaaacaaataataaaaatattctaagacactaatttgattttagaaagagttattcttcaattgcataacaacataacagctttgccattctgaagatagcttgtagttcttgaaataactttttctaaaagtaaaagaacgatgaatttggtgaaa

SEQ ID NO: 61450 - DNA, 601 bp, Human
acttttatatatacacacacacacacttttccaggttctgtgcagtcccatgtgtttgagctttctggcgatctggctctagaaaactgaagtgtcattgcaaaatagattgggatacttggtgtcaaaagcagtatttcttattctttttaaacctatacccctttgatagatatgaaaatctcataccatagctgtagtaatattgaatatgattttttcaaactacatatggtttatattcccctacccccacctacggattctcataggctcctctacatagttatgcccttaaggragagagtcattactttaaagaaagtagcaaaatacacctgaaatgttgatttcttcatcatttctatatgggaatgtaggctactagagagaacttttacctatttattcattcagcaaacatggattgagtatactgtatgcaagctctttatggtacaaagataatgatgataggccacgcaaaaacttgtatgagagtgttaacagcagcattatttacatagtttaaaaaactagaaacaattcaaatgtctgcagactgaagatatttaaacaaaatataatcgcttctcggcct

SEQ ID NO: 61451 - DNA, 601 bp, Human
tactgtctttgctgtgaaatgagttccttgatcagaagcaaggctgtatagaataccatgatagtggataaagcatttcaggagatggtggtgctggagaagcattatgggtggagaaggtacatccatatcaagaatgcttttattccagggaggacaaatctctgcccactgcctaatagaaggcatccaacacaatcaacctgccagtaggtagctggccagtcccaggggtgactctggggttcagtgctagtctctgctgcctggtgagtagctgcattatcagatgtgtagctgyatgccaggggctagaggttgtattgattttcctcagtgaaaataccatatccggaatagcagctgctatcacagagaccacctagtttacacaatccagttattcaccaagattcatccaacttgcgtaaacaaatgagttaagagaggatgtggtaggtatcctatccctttgtctttaaagtctgtgattgttgtactaatttctgcagttctatcttgataaggaaaagttccaggaactgttatagccctttcttcatcatgttccttccttcatcatatttcttacctgtggttc

SEQ ID NO: 61452 - DNA, 601 bp, Human
taaagcatttcaggagatggtggtgctggagaagcattatgggtggagaaggtacatccatatcaagaatgcttttattccagggaggacaaatctctgcccactgcctaatagaaggcatccaacacaatcaacctgccagtaggtagctggccagtcccaggggtgactctggggttcagtgctagtctctgctgcctggtgagtagctgcattatcagatgtgtagctgcatgccaggggctagaggttgtattgattttcctcagtgaaaataccatatccggaatagcagctgctrtcacagagaccacctagtttacacaatccagttattcaccaagattcatccaacttgcgtaaacaaatgagttaagagaggatgtggtaggtatcctatccctttgtctttaaagtctgtgattgttgtactaatttctgcagttctatcttgataaggaaaagttccaggaactgttatagccctttcttcatcatgttccttccttcatcatatttcttacctgtggttcagaatcactagagagtctaccagtggcctagtaggtctattccaattatacatcttggaactgaaaaa

SEQ ID NO: 61453 - DNA, 601 bp, Human
agtgctacaggaaccacccgaaagcaaggccagcttccacttcagtcaggggtcttgggtttttgaactagcgttgatctggaagctggtaagaggtagtgactctctgttgtagtgactaatatcaagtatttggccaccagacctggagtttttttctgttacatcaattaagcaatattctagtaggttgcccatttctgtctttcctagggataaccatgatcaattaaccacagccaaaatctctgtgtgcaaaaacatctgtcctgttgccttttatggtaaatgcacccacctygttttgatagttaagtgctgccatctggcctttctgttccaaggatcattgaatgtgcattgcaatcagggaacccatctcaatagatacatctctcatggccattcctggccttcactggggagtaaacatagagctttttaaggatgcaggtgctctcctcactaacgtaattctggatgccttaatgaagggagtattttctgggccccctcagggggatgtgattggtgttggagaggcgtaagagtggtccctaggagctaaaagcaggtcccagatgggttgacccacataaat

SEQ ID NO: 61454 - DNA, 601 bp, Human
tttttgaactagcgttgatctggaagctggtaagaggtagtgactctctgttgtagtgactaatatcaagtatttggccaccagacctggagtttttttctgttacatcaattaagcaatattctagtaggttgcccatttctgtctttcctagggataaccatgatcaattaaccacagccaaaatctctgtgtgcaaaaacatctgtcctgttgccttttatggtaaatgcacccaccttgttttgatagttaagtgctgccatctggcctttctgttccaaggatcattgaatgtgcrttgcaatcagggaacccatctcaatagatacatctctcatggccattcctggccttcactggggagtaaacatagagctttttaaggatgcaggtgctctcctcactaacgtaattctggatgccttaatgaagggagtattttctgggccccctcagggggatgtgattggtgttggagaggcgtaagagtggtccctaggagctaaaagcaggtcccagatgggttgacccacataaatggatgaaatttatttggaaagaggaatggaaacatgatttttgttttgaatacagtctt

SEQ ID NO: 61455 - DNA, 601 bp, Human
agaaggaaattctctaggagaaagagagagtgaatcattaagcagtgccagacaggacaaaaatactaaagattgattgaagacaacagcaagacagtatagcagtagataaagcaaggaataggagaattatgagaaagcataagttgtaaataattctttgttattattatataatttttatcattatttattgagtgctatgtcccttggcatttttttttttttgagacagtgtctcactctgtcacccaggctggagtgcagtggcacaatctcggctcactgcagcctctgctcrctgcaacctctgcctcccgaattcaagcaattctcttgcctcagcctcccaagtagctgggattacaggaatgcaccaccacgcccggctaattttgtatttttagtagagacagggtttcaccatgttggccaggctggtctcgaaatcctgacctcaggtgatccacctgcctcagcctcccaaagtgctgggattacaagcatgagccattgcacccagccggtcccttggcatttctatgcctcatttaatctttacaaccactttatgagggagttggtatttccatttcatcta

SEQ ID NO: 61456 - DNA, 601 bp, Human
ttatatagacacacatgcatgcacaccacattttgtttatttgttcctcaattgatggacatttggattgtttccactttctggctattataaatgcaagttagtatatgtatgcaagttttcctgtgagcatatgttttcagctctcttaagtatatgcctaggaatggaattgctgaatcatatgtttaacctttcgagaactgccagctattttccaaataccagagaggctgtaccattttgcgttttcactcttagtggctctttacattttatttattcatttgtaaaaagaaarggtacatgaggttttatggggggtaaaatgaaaggagagtgttacacaaaaatattttttcctatagagttctaaatattacatgtaacggttttcttctagaaattctaagggagcaaatgggaattattaaaaattcagaagtcagtaggaacttttttatcttactgatttgacagttccgttctatttcttatagagaagctcgcagaggctcagcgcaggtttgctacacttcagaatgagcttcagtcatcactggatgcacagaaagaaagcactggtgttactacgctgcga

SEQ ID NO: 61457 - DNA, 601 bp, Human
taaatgcaagttagtatatgtatgcaagttttcctgtgagcatatgttttcagctctcttaagtatatgcctaggaatggaattgctgaatcatatgtttaacctttcgagaactgccagctattttccaaataccagagaggctgtaccattttgcgttttcactcttagtggctctttacattttatttattcatttgtaaaaagaaagggtacatgaggttttatggggggtaaaatgaaaggagagtgttacacaaaaatattttttcctatagagttctaaatattacatgtaacrgttttcttctagaaattctaagggagcaaatgggaattattaaaaattcagaagtcagtaggaacttttttatcttactgatttgacagttccgttctatttcttatagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttc

SEQ ID NO: 61458 - DNA, 601 bp, Human; identical to SEQ ID NO: 31152

SEQ ID NO: 61459 - DNA, 601 bp, Human; identical to SEQ ID NO: 31153

SEQ ID NO: 61460 - DNA, 601 bp, Human; identical to SEQ ID NO: 31154

SEQ ID NO: 61461 - DNA, 601 bp, Human; identical to SEQ ID NO: 31155

SEQ ID NO: 61462 - DNA, 601 bp, Human; identical to SEQ ID NO: 31156

SEQ ID NO: 61463 - DNA, 601 bp, Human
gtaagtagtttaaattttgaattaatttattcttaccaatatgcctgtgtcatattctgcccctctgtaaggaattatgcatgcaactaccaaagctactgaaagataaatctatcagggctaagttttttgtccttataaatgtggttttttttagttgtttgttttgttggcgttttttccccatttgggtatggttattctctaaaacattgctcatgtatgacttctttttcttcatcattttccagtttctgtatataacttctatataatttttcagagtttatttatcaaaaascttggctttcttgatcatagatgaggataaataatgttacaaaactcattcacaaagctctttcactttgcttattggagaccctctcgcatccttttcagaatctatttacaattactttgcatatagtgttaagaagcttggttgtataatttcctattctatagaagtaaaaacaattagaaagagataggaaggattcctaggagcagctgcactcacaacatcaaaaaatgatataacagcaaaggaagcataatcttactaaatctccccaaagaatttgacacaccccacagt

SEQ ID NO: 61464 - DNA, 601 bp, Human
tgggttcacacgattttcctgcctcagcctcctgaatagctgggattacaggcacacaccaccacacctggctaattttttgtatttttagtagagatgaggtttcactatgttggccagactggtcttgaactcctgacctcgtgatccacccacctcagcctcccaaagtgctggggtttacaggcatgagccaccgcgcccggccagcagccatttcttgtttagtgtatagcagccttctggactcggtctccttgcatctactcttgcctccttatagctactagtgtcttttttyccccccccccaatggaagttagatcatgtcactctcctattcaaaattcattcatggctactcttaaaataaaatccaaactccttgccattgcctgcaagaacttacaggatctcacctctgtgggcctttccgatattatattgtcatcttccccccacacttagcttcactttgtttccgaccacacttgtgttagtacttcttagatgcatcaagctcattctaatctaagagcctctgcagttgcctaaagagctcttccccaagatgtctacctagcttatttcatcacttgtc

SEQ ID NO: 61465 - DNA, 601 bp, Human
gggttcacacgattttcctgcctcagcctcctgaatagctgggattacaggcacacaccaccacacctggctaattttttgtatttttagtagagatgaggtttcactatgttggccagactggtcttgaactcctgacctcgtgatccacccacctcagcctcccaaagtgctggggtttacaggcatgagccaccgcgcccggccagcagccatttcttgtttagtgtatagcagccttctggactcggtctccttgcatctactcttgcctccttatagctactagtgtcttttttcccccccccccaatggaagttagatcatgtcactctcctattcaaaattcattcatggctactcttaaaataaaatccaaactccttgccattgcctgcaagaacttacaggatctcacctctgtgggcctttccgatattatattgtcatcttccccccacacttagcttcactttgtttccgaccacacttgtgttagtacttcttagatgcatcaagctcattctaatctaagagcctctgcagttgcctaaagagctcttccccaagatgtctacctagcttatttcatcacttgtct

SEQ ID NO: 61466 - DNA, 601 bp, Human
acctcagcctcccaaagtgctggggtttacaggcatgagccaccgcgcccggccagcagccatttcttgtttagtgtatagcagccttctggactcggtctccttgcatctactcttgcctccttatagctactagtgtcttttttcccccccccccaatggaagttagatcatgtcactctcctattcaaaattcattcatggctactcttaaaataaaatccaaactccttgccattgcctgcaagaacttacaggatctcacctctgtgggcctttccgatattatattgtcatcttccccccacacttagcttcactttgtttccgaccacacttgtgttagtacttcttagatgcatcaagctcattctaatctaagagcctctgcagttgcctaaagagctcttccccaagatgtctacctagcttatttcatcacttgtctgtattcaaatgctacattcttagtaaagcgttccctgatcacccaaccctaaaataatctattctgtccctttagcctacgttagttttcttctgagtacatatacttacctgacattatatattatatatttatatttcttgtgatctcttt

SEQ ID NO: 61467 - DNA, 601 bp, Human
ggttctatttccttaggtgaatacagtttacttacatagaatacatgaaaataatacaatttaaaaactcagatctatgttatcaagctagctgtagtggagagaacaaaaggcctgcatgggtttcagtttcagctccactgttagttgttttggctttaaggacatcatttaacttctctcaaacagtttcctcatctgttaaatgagcttaacaccttaaatttgcagggttgtttagggttcattcattcattcagcaagtaaattttatgtgtctaagggttatgcttgatgcctrcaagtcttaagataaataagagaatccctttccttatgaaatgtattatgccagggagattaaggcatatattaaagcaatatactgcaagatagaaggtgttaaattttctaagcggttcaaagagacaactgattacttttaaatgagagcatcagggaatacttcatggaagaaataacgtttatgctagacattggtggaatcaaagccatttcgagagaaggagacagttgagcaaagagatttagttggcctggggtggggatggagtgtagaaggagggagtgagttatgaag

SEQ ID NO: 61468 - DNA, 601 bp, Human
cagcgggtgcttaaaagataacagtgttgagagtcaaagagaaacacagtcgtagtatgcatgtacaagcacgattctttttttcaaacattcacattaaaaaatgtgcataattgctgtggtttttcaaggggacatgacctagtatttaataatttctctgaaaatcacgtgtttcagataattaatttcattaagatgaaaagttgactgtttagatttttttttcaaacttgtttcttttgcaggttcctactaacatatataacttaatttggtacaataacagtataccatattkcacttactggtttggccatttacagtgggtataaggtgtgaaataggctctggtacactagtggtaagagtactcattgttgctatctctttggaggataatttggcagtgtgtgtaaaaattttaggcaaaattatgttgattaagccgttttgtttctagaaatttatcctacaaacatacttgtacatggttgcaaagacatgtatgctaggaggatagtcattgccattttgtttatagtagaaaaatcctagaaaccactcaaatattcataaattgatagctctttaaattata

SEQ ID NO: 61469 - DNA, 601 bp, Human
ggataatttggcagtgtgtgtaaaaattttaggcaaaattatgttgattaagccgttttgtttctagaaatttatcctacaaacatacttgtacatggttgcaaagacatgtatgctaggaggatagtcattgccattttgtttatagtagaaaaatcctagaaaccactcaaatattcataaattgatagctctttaaattatattacctctgtacagtggaataccatggagatattaagatgaatgaggtaatggtgggagtgaaaatggacacagcactttggagaactttttggcmacaggaatcagttttgtggaagacaattttttcactgggctggcgggtaggagaggggatggtttcaaggtgaaacccttccacctccgatcatcaggcattagttagattctcataaggagcgcgcaacctagagatccctcccatgcgcagctcacaatagggttcgttctcctctgagaatctaatgccgttgatctgacaggaggtggagctcaggaagtaatgctctctcaccagccgctcacctcctgctgtgtggcctggttcctgacagagcacggaccagtactggtccat

SEQ ID NO: 61470 - DNA, 601 bp, Human
tctgtacagtggaataccatggagatattaagatgaatgaggtaatggtgggagtgaaaatggacacagcactttggagaactttttggcaacaggaatcagttttgtggaagacaattttttcactgggctggcgggtaggagaggggatggtttcaaggtgaaacccttccacctccgatcatcaggcattagttagattctcataaggagcgcgcaacctagagatccctcccatgcgcagctcacaatagggttcgttctcctctgagaatctaatgccgttgatctgacaggaggyggagctcaggaagtaatgctctctcaccagccgctcacctcctgctgtgtggcctggttcctgacagagcacggaccagtactggtccatggcctggagattggaaacccctgtactaacctatgacccagttctaatagaaatgcttacatatgtccaccaaaagacatgtatgagaacacttaagtaatattgtttgtaatagtatccagtcatgtaccatgtaacaatgtcttggtcagcagcagactgcagatatgaaggcagtcccataagattataatggaactgaaaaattgc

SEQ ID NO: 61471 - DNA, 601 bp, Human
cacaaagaatacatattacatgattccatttacatggagttcaaaaaacaggcaaaaatcaggagtttacccttggggaatggatagcaattggaaagaatatgagccggaacttctaggatgcttgtaatatgctgtgttctgggtgctgattcacttcatttttcatcatgttgtatacttatgatttatccatttttctatatgtatgtaacacttaaattcaaaaagtttacattagaaaatgagtgagatctttgtgcactgatactggaaaatctccactccaggatataagtgaaaaaaaaaaaggcctggaatagcatatatagcatgctcccagttgtaattggtgatttgttttttaaaaaatagtatgtgtttctctatgcatcaagaaattcttgaaagataatagacaaattgttagcatggttttcttcagaagatctggagtgagacgaggcttctcatattctttataatatttgtggttcttttcctatacacatacattacttgttaaaatttttttaatgttcctttaaagaaaagtgagttggcaacttaatacagagaggactgtaattttgtaagtttt

SEQ ID NO: 61472 - DNA, 601 bp, Human
gttttttaaaaaatagtatgtgtttctctatgcatcaagaaattcttgaaagataatagacaaattgttagcatggttttcttcagaagatctggagtgagacgaggcttctcatattctttataatatttgtggttcttttcctatacacatacattacttgttaaaatttttttaatgttcctttaaagaaaagtgagttggcaacttaatacagagaggactgtaattttgtaagttttagaacaaacttctgtttgggttttttttttttttttaaacaggtacatatttgcttackaacacaacctagccccattgttaagtgtgcaggctttggagccagattgtagggttattacatccttgtgatcctgggcaaggaacctattttgagtaagccttagtttcttcatgtatctgctgagaaaaaccaatttatagtgttgctgtgagaactaatgaaattatgcatgaaaaacattgagtatattgcttaccccaaaataaatgcttaatgattgttagctgatttttaagttaaaaattcatgaagccatgggaagtttgtgatgggaccttatatatcttttatttttgg

SEQ ID NO: 61473 - DNA, 601 bp, Human
ttttggttttcgctgacttttctaacaaattgtggagttcaaggatattttattcagatcatatttactgaaagccttagagattttctagttcctatgttatcaagtagaacttaggtaaatatgtgtttagattttataaatatggattacattttctgttcatggcaattttcttcctatgtaggacagaatactactgttgctagggtcatgaatatttgaaccctaagcaggctatttcgctttcttttatgtatggccacagatattaactagacagaattagaaaattttgatrtattagagcaaatctatcaccaccactactaaaacagttcaaaatatatgcctaggccgggcgcggtggctcatgcctgtaatcctagcactttgggaggccaaggcgggtggattgcctgagctcaggagttcgagaccagcctaggcaacatggcaaaaccccgtctctactaaaattacaaaaaaattccctgggtgtggtggtgtgtgcctgtaatcccaggtacttgggaggctgaggcaggagaatcacttggacccaggagggggagggtgcagtgagccaggatcatgccat

SEQ ID NO: 61474 - DNA, 601 bp, Human
accactactaaaacagttcaaaatatatgcctaggccgggcgcggtggctcatgcctgtaatcctagcactttgggaggccaaggcgggtggattgcctgagctcaggagttcgagaccagcctaggcaacatggcaaaaccccgtctctactaaaattacaaaaaaattccctgggtgtggtggtgtgtgcctgtaatcccaggtacttgggaggctgaggcaggagaatcacttggacccaggagggggagggtgcagtgagccaggatcatgccattgcactccagcctgggcaacasagcaagactctgtctcaaaaaaaaaaaaattatatatatatacacacacatacacacatacctaacatagaaattagtaatgacatcttaagatatatttattacttttttccttttctgttttttttaattgaggtgaagttcacataacataaaataaatttcattttaaagttaataactcagtggcattcaagtacattcacagtgttgtacaaccaccacgtctatctagttcccagacattttcatcagcccaaaaggaaaccccactctccattccctctcctcagctgctgg

SEQ ID NO: 61475 - DNA, 601 bp, Human
atataaattagtatataggctgggcatggtggctcactcctgtaatcccagcactttgggaggccgaggagggcagatcacctgaggtcaggagttccagaccagcctggccaacatgatgaaaccccgtctctactaaaaatacaaaaaattagctgggtgtggcgtcacgcatctgtaatcccagccactcaggaggctgaggcaggagaatcgcttgaacgcgggaggcagaggttgcagtgagccaagatgacaccactgcactccagtctgagcgacagagcaagactccatctcaaaaaaaaaaaacaaaagtttgtatgtaattaaattccaaatgagcagtactgtcaataaattttatagttatttggaaaatcattagaccaaatggaagtgtttctcatacagtgggcttaaaacgaaatatgttgattcagtgaatttatgaacaggtaaggatccaggatctgtctcttaaatagtaagtagaatttgaattagtggagagaaagaacaaggccattttaagtagagggaacaacataagtaaatgtgaaaaacaaacttattaaaaggataataaaattcatcacga

SEQ ID NO: 61476 - DNA, 601 bp, Human
tctaagccacttcaccatgattctttgtaatctaaaaaactaatagaacaatgggatgacatgctgaaagtcaagttttgggaaattattctagtgacattctgcagagtaaaatgaagacgagaaagaacccacaggcgactttttaaggctcttaaaataatctaggtttggccaggcggggtggttcatgcctgtaatcccaacactttgggaggccaaggtgggtggatcacgaggtcaggagatgaagacaatcctggccaacatggtgaaaccctgtctgtactaaaaatacaamaattagctgggcgtggtggtgcgtgcctgtaatcccagttactcgggagactgaggcaggagaatcgcttgaaccagggagtcggaggttgcagtgagccgagatcacgccattgcactccagcctggcaacagggtgagactgtctcaaaaaaataaataggtagatagatagatagatagatgatagataatctaggtttaggttttatttatgaaaaatttctatgccagggctatatcattgagaatgaagacaaaagattattaattcaagggaagttatgaattttataactga

SEQ ID NO: 61477 - DNA, 601 bp, Human; identical to SEQ ID NO: 31157

SEQ ID NO: 61478 - DNA, 601 bp, Human; identical to SEQ ID NO: 31158

SEQ ID NO: 61479 - DNA, 601 bp, Human; identical to SEQ ID NO: 31159

SEQ ID NO: 61480 - DNA, 601 bp, Human; identical to SEQ ID NO: 31160

SEQ ID NO: 61481 - DNA, 601 bp, Human; identical to SEQ ID NO: 31161

SEQ ID NO: 61482 - DNA, 601 bp, Human; identical to SEQ ID NO: 31162

SEQ ID NO: 61483 - DNA, 601 bp, Human; identical to SEQ ID NO: 31163

SEQ ID NO: 61484 - DNA, 601 bp, Human; identical to SEQ ID NO: 31164

SEQ ID NO: 61485 - DNA, 601 bp, Human; identical to SEQ ID NO: 31165

SEQ ID NO: 61486 - DNA, 601 bp, Human; identical to SEQ ID NO: 31166

SEQ ID NO: 61487 - DNA, 601 bp, Human
gtatgattattaattttagaagctctttgtctaatgcaacatatgcaaataattgttaggaaaataaaaatattgttaatttcagtacacatttaccagtgcaatattttatgatgaaataattttatcatattctttaaatgtgcttttgcaaaaaatctggaacttcagattacactcatctgagctatggaaaatatctgcaatatacctgtaggtgaggaaaaacttactcctctaccctcttaagtaattggggcctgcaaatgaaattgacaacagatagattaataaaagaaayggtttgttatgtacacagaggtcttcatagaaaggaagacccaaaagaagtgtttagactaggggttggagaggggcttatataccatttttacaaagaatgataaattgtgaaaaagtaagtttagacaaaagtaggggattgggcttctggatggtaaattgtgaaaaggtaaatatatggagattctaatgaaagaaaaggattatttagtaaggtttgttatgcataccaaagttggtgtcttctccattgataagcgtcatctctggtaaagaagtgttgccctcggccgggcgc

SEQ ID NO: 61488 - DNA, 601 bp, Human
ttgttaatttcagtacacatttaccagtgcaatattttatgatgaaataattttatcatattctttaaatgtgcttttgcaaaaaatctggaacttcagattacactcatctgagctatggaaaatatctgcaatatacctgtaggtgaggaaaaacttactcctctaccctcttaagtaattggggcctgcaaatgaaattgacaacagatagattaataaaagaaatggtttgttatgtacacagaggtcttcatagaaaggaagacccaaaagaagtgtttagactaggggttggagrggggcttatataccatttttacaaagaatgataaattgtgaaaaagtaagtttagacaaaagtaggggattgggcttctggatggtaaattgtgaaaaggtaaatatatggagattctaatgaaagaaaaggattatttagtaaggtttgttatgcataccaaagttggtgtcttctccattgataagcgtcatctctggtaaagaagtgttgccctcggccgggcgcggtggctcacgcctgtaatcccagcactttgggaggccgaggcgggtggatcatgaggtcaggagatcgaga

SEQ ID NO: 61489 - DNA, 601 bp, Human
atatatgtccatgtgtaagcacctcgttccttcattctagttctgagttagatgcatgaccaggtagataggtagacagggaggcagagcaggcatacattcagcaagtacttactaagaatattttatgtaacatgccgtgctaagcactaaaaaaaatagcaacaaagcacaacacaattcttgcccttaataatttataatctagtgggggaatagacaaagtaaaaaggcattaattggttcttaatagtattgttaagtgtactgttttagacatggcttaaaatggtaaattttrtttgtttttaccacagtttttttttaaaggcataaaaatagagtataaagagataagcagggtaccgaaagaacccccagcacaggtctctaactcagtctcctaggcctcagaatgggaggaagacttctggaggtaacatctaagctgtatcctattgtttatattaagttaaggaggattctagttaccctgttatgtgccttgctcaaggacatgtaatttgtgagtggtggaggtgtagtagttctcagttctattcttcagcctagggattttttttttttccagacaaagcga

SEQ ID NO: 61490 - DNA, 601 bp, Human
cactagaaaacatggactttagaaataatcattaagccaaaagaaaagattcaatatgattaattgggtagatacttttctatgaaatgtatgtgtactgttacaaaggataaattttagaggggcaaggagtaaaagacagtgaggtaaccttgtttggattcagagatctgagtcttttcaaagaactagcctgcaagagttaccatagcaacagcattatattaggggcattttcaagattgtttcagagtgtctcatgttttgctgcatgatttgtaaaaattgagatgtaagagtwaaccgtgtgtctagaatcattttttggaaagtaagggaggaggttggaggtttaggcagcccatttgagggaaattaaggatgataatataagtgagctagcactcacttatattaaaaaggaaaacacgtttgaaatatttcagtatattttttctatcattgattttagaaacaaaggaatttagctagtagccagtctccatattttaagaattcacatttcattacatggctaaatttgaaggcaattcctacaagtgttttgttggaattgggattggaggaggcacaaacgtgt

SEQ ID NO: 61491 - DNA, 601 bp, Human
agaaaacatggactttagaaataatcattaagccaaaagaaaagattcaatatgattaattgggtagatacttttctatgaaatgtatgtgtactgttacaaaggataaattttagaggggcaaggagtaaaagacagtgaggtaaccttgtttggattcagagatctgagtcttttcaaagaactagcctgcaagagttaccatagcaacagcattatattaggggcattttcaagattgtttcagagtgtctcatgttttgctgcatgatttgtaaaaattgagatgtaagagtaaacygtgtgtctagaatcattttttggaaagtaagggaggaggttggaggtttaggcagcccatttgagggaaattaaggatgataatataagtgagctagcactcacttatattaaaaaggaaaacacgtttgaaatatttcagtatattttttctatcattgattttagaaacaaaggaatttagctagtagccagtctccatattttaagaattcacatttcattacatggctaaatttgaaggcaattcctacaagtgttttgttggaattgggattggaggaggcacaaacgtgtttta

SEQ ID NO: 61492 - DNA, 601 bp, Human
tgcaagagttaccatagcaacagcattatattaggggcattttcaagattgtttcagagtgtctcatgttttgctgcatgatttgtaaaaattgagatgtaagagtaaaccgtgtgtctagaatcattttttggaaagtaagggaggaggttggaggtttaggcagcccatttgagggaaattaaggatgataatataagtgagctagcactcacttatattaaaaaggaaaacacgtttgaaatatttcagtatattttttctatcattgattttagaaacaaaggaatttagctagtasccagtctccatattttaagaattcacatttcattacatggctaaatttgaaggcaattcctacaagtgttttgttggaattgggattggaggaggcacaaacgtgttttaaatggtttttgtgtgtccttgaggtttcttggctttggcaaagaaaagcctgtgggaggtacaataatagaaaaggccattatgttgttctttctaagtggttgttgagggaaagcatttcattagattttctatttttcatttacagtttctaacattctaaaatatttgtaaatttttagtgatttag

SEQ ID NO: 61493 - DNA, 601 bp, Human
gcaagagttaccatagcaacagcattatattaggggcattttcaagattgtttcagagtgtctcatgttttgctgcatgatttgtaaaaattgagatgtaagagtaaaccgtgtgtctagaatcattttttggaaagtaagggaggaggttggaggtttaggcagcccatttgagggaaattaaggatgataatataagtgagctagcactcacttatattaaaaaggaaaacacgtttgaaatatttcagtatattttttctatcattgattttagaaacaaaggaatttagctagtagtcagtctccatattttaagaattcacatttcattacatggctaaatttgaaggcaattcctacaagtgttttgttggaattgggattggaggaggcacaaacgtgttttaaatggtttttgtgtgtccttgaggtttcttggctttggcaaagaaaagcctgtgggaggtacaataatagaaaaggccattatgttgttctttctaagtggttgttgagggaaagcatttcattagattttctatttttcatttacagtttctaacattctaaaatatttgtaaatttttagtgatttagt

SEQ ID NO: 61494 - DNA, 601 bp, Human
gtttaaaaagtctctactattttattgcttagaaattgagagaggatctgtggtgtttaaaagaaatagttgaccgggcacagtagctcacacctgtaatcccagcactttgggaggctgaggcaggtggatcaccaggtcaggagttcgagaccagcctggccatcatggtgaaaccccatctctactaaaaatacaaaaatgagttgagtgtggtggcaggcgcctgtaatcccagctactcgggaggctgaggcaggagaatcatttgaacctgggaggcggaggttgcagtgagccragattacaccattgcactccagcctgggcgacagggcaagactccgtctaagaaaaaaagaaatggttgaaaattttttatacaggagtttgtctaattgaagagaaatttgaagaccaattgcttgaaagttgaatttttaattttcattttaatttacatactttatattatacataattttacatgagaaagctatggtgaaaagtataaacatcagaaaatgtcatatctaggtatttacagcaaaaagaaaagaaagagaaaaaaatgagcaggcaaatgtacttacagaccttg

SEQ ID NO: 61495 - DNA, 601 bp, Human
aagcaagtcaccaaaccctacattaatggggcaagaaagtatacttctgccatggaaacagggatgggctgaaagggagagaagagttttaaaatgtaatctaatctactgtgatacagaaaacaatttaaactgatttgtctaaagtggcaaaggacttaaaacagttaattttgtagaataaacataactaataaacatgaaaaattttccactttggtaataaaaacagaaatataaattaaaataatatttaatcaaagaagtgatgatgcctatcactggcaagggtacggagagwtgaaaactcattctgttggtagagtataaatttgtaagcaatttgggaattctctcgaatcttaaaatcattcataccttttgacctagtaagtacctttccacaactttttcctaaatagagaattgggcaaaaatgaatgtatctttgtaacattatatagtaaaaaactgaaataatctaacaaatgttcagcaataggagaatagcttacttacagtaactgcatagtatatgaaatattatacagtggcttgttaaaagtcacacagtggacctgcaaatagtagatgaagaata

SEQ ID NO: 61496 - DNA, 601 bp, Human
taagcaatttgggaattctctcgaatcttaaaatcattcataccttttgacctagtaagtacctttccacaactttttcctaaatagagaattgggcaaaaatgaatgtatctttgtaacattatatagtaaaaaactgaaataatctaacaaatgttcagcaataggagaatagcttacttacagtaactgcatagtatatgaaatattatacagtggcttgttaaaagtcacacagtggacctgcaaatagtagatgaagaataatgactgtgtgtgtgtgtgtctgttttcacagatrgtcttgctctgtcacccaggctggagtgcagtgagtagcttggtcatatctcactgtagcctcaaactcctaggctcatgggatcctcccacctcagcctcctgagtagctgggactacagggtcgtgctaccatgcccagctaatttttattattgtttttagatacagggtctcactactgttgcccaggctagtctcaaactcagtcttccaaagctgggattgcaggcctgagcctgctgacacacttaaattaagagcaatgtggactcggccaaaatacgaaaataatttctct

SEQ ID NO: 61497 - DNA, 601 bp, Human
atacagggtctcactactgttgcccaggctagtctcaaactcagtcttccaaagctgggattgcaggcctgagcctgctgacacacttaaattaagagcaatgtggactcggccaaaatacgaaaataatttctctctgccagaaaatcgaaagtcattcttgaattggagggaaacaaaactaacatattaatgttgtttcaagtgatggcagaatcatttgacatgattaatttgcttagtgttgtatccttttttaggtcttaagaaatatcaagggggctgggcacggtggctcacrcctgtaatcctagcactttgggaggccaaggcaggcagattacctgaggttgggagttcaagaccagcctagccaacatggcaaaaccctgtctctactaaaaattataaaaaattagccaggtggagtggcatgcacctgtaattccagctactcgggaggccaaggcaggagaatcgcttgaacccaggaggcggaggttgcagtgagctgagatcacgccactgcactctagcctgggctacagagtgagacttcatctcaaaaaaaaaaaaaaaaatgtcaagggtagttagggta

SEQ ID NO: 61498 - DNA, 601 bp, Human
gtttgttaattttttaagaaagaatataagaatacttcctaagtatagcaaaatactatacacacatgtgcgtataatatgtcactctgtatcttagaccaatgactagaatcacgattaaaggtaaaaaaaatttttaagttgttggcctagactttctaaggcccctttagctctttacattctattagtctgatagagctatttgcaaatatgtcatgtgttggcagacattatgtcattttgaacctgataccaactccgaaagaaaggaaacaggtgttattctcattttgcttgygcaaggtcacatgacagtaagtagcaaaaccagaattttgactctagattcattcctttttttaactctaaaaagttatttcctacaaggcagcgtgctataatgttgtgatcctcaaattttggtgtgtatctgaattactttggatgcttgctttaaaatgcattatcttgggttttaccttcagtctaattgagtaggattagggcgatccaaaatttgcatttttaccatgtcttctgctaaaggtgattcactgaggacacattaagtgcatgcaaacaacagatgttgtaaaca

SEQ ID NO: 61499 - DNA, 601 bp, Human
actgtgtaaaatgtatagaatcctggccaggcatggtaactgacacctgtaatctcagcattttgggatgccaagttgggaggatcacttaaggcctggagttcgagactagcttgggcaacatagtgagacctcatctctaaaaaattattttttaattaggcaagtgtcgtggtacacacctgtatttctagctacttgggaggctgaggcaggaggatcacttgagcccaggagttcaaagttacagtgagttattattgtaccaatgtactcctgcgtgggcaacagattgagaccytgtgtctttaaaaaaaaaaaaaaaaggattatagtatccttatatttcttttaaagtggttatagttgttagcatttcatttagttaaataaatgaaattgtgtcttttccaggagagaaggcagaaacacatagtttatctgctccagaattgttatttggttatagaacaaaaggagtggggaaaagcagaaatagatattttttaatgtaaaaacaccaaacttctatttaactcatgaattaaagaggaaaccagccagttgtcactactggttcaaaggagaggcaatatatttt

SEQ ID NO: 61500 - DNA, 601 bp, Human
ggtggaggagtagagggtaagatggaatctgttggacctccgtcagacagaatttatttgtgtgcctatagacagaattattggcatttatccacaatttatacagaattataaaataactccaagaccagaaaaggcacaaactccatagaaacataacctagaaaggtatggtgtaaacaatgcataattttccattttagtgcatagtaattatttttgcttattccaaagtcttaacttttccttacagcaataacctactacaagaatgtttccaaggctgttgatcaaatgtgtracagaaagggatttttaaaaataagcctagacacacatacataagaaagatattggaagaggttctgatgatctgatctgggaaggggtatctgatacagcagaagaaaagttgctaaactctgtcaagaaaggaagtcctaaatggtgtcattgatgcttttataatcactgaagaggtaactttgttattgaggagccagtaaataaggatctatatggataataaattgaatataaatagtttaataatcaaattactttcttgattacatcagtcacatccagttttattcaacaa

SEQ ID NO: 61501 - DNA, 601 bp, Human
aggaagtcctaaatggtgtcattgatgcttttataatcactgaagaggtaactttgttattgaggagccagtaaataaggatctatatggataataaattgaatataaatagtttaataatcaaattactttcttgattacatcagtcacatccagttttattcaacaaacatttacaaaacatcttcaatgtatcaggcactactagatgctaggcatacatagatgaacaaaacatatcttgcctttaaaacctcctcttggagctcacggtttggtaagggaaatagactaattacartagaacatggaagtgcaataatactatattatcagtattgtatagggtataaggtggtttcaaagaggaagtggttaactcagtgaaggttttgaggaacagtcaagttctgtggtttttttttaattaaacattttgttttgagataattgtagaatcacatgcatggcaagaagtaatgcagagagatcccatataccctttgcatagtttccccagtggtaacactttacaaacatagtataatatcacagccagaatattgacattcatacagtcaagatacagaacatttccatc

SEQ ID NO: 61502 - DNA, 601 bp, Human
tttttttttttttttttgtattttgttgtattttgttcgtttttcttgaaatcagtgggaattatctgtggtgatattacacacaatttttttaatgtctcataagtgtaatacagttaaaacagctataggaatcattaggcatgcagaaagcagcaacttttaaacatcattgtgacactcattgaattaaaagcagctgtgttttgttgtaaaggaaaaaaatgatgtctacaaaatgttagaacaatgccgttaaaggttgtatctaaaaggcaaggaaagtttaataggggttttkctttatctatttttagctctcaggaacttatcctcatataagtctgttgcttaactttttcacattcaacttattaacaaaagaccatgagattggcagaggaagcaaaaggaaagctttatttcctgtaaaggattacaatctgcaggtcaggaaactaagcttccagccaaaaccaaatacataggcttcagttacaaaggggagaggttggaatttatccccagtggggttagctccgcatacatatttagcaggttataggagaatttatgaatatttatgagggaaaccaaatgt

SEQ ID NO: 61503 - DNA, 601 bp, Human
atcattttccttcagctaccttctccctacatgcttatttaatctaaacccctttttactgtattttccccagtctaaagtaacaaggtgtccttcctcctgtgcactgctctcatttccccttgtcccaggatctagctctggcagttgtcccttgtttttcccaaatcttcaaactgtttgtcattactggctccttccttctagcctatgtacatgcttaagagtcccctactctaaaaagatttcccttacctcattaagccatctggtctagtcttttttccttttctctatcctrcatctcaaaacagtaatctatctattcttattcttactgtctccattcctataaccacaataactctatagtaattaacacatatttagaaaccttgaaatgtaaacaaacatagaattagaatttaaattttttaagagataaagagaagctctgtaacatttcagagagttctcatctctttgagtctttggtattaaaaaaaaaaactggaaataaactcaaccaagtgtagtcaaacacagtgtgattccccttatagatggaagacttatctctcattgtagcctgtccttttca

SEQ ID NO: 61504 - DNA, 601 bp, Human
tatagtaattaacacatatttagaaaccttgaaatgtaaacaaacatagaattagaatttaaattttttaagagataaagagaagctctgtaacatttcagagagttctcatctctttgagtctttggtattaaaaaaaaaaactggaaataaactcaaccaagtgtagtcaaacacagtgtgattccccttatagatggaagacttatctctcattgtagcctgtccttttcatagaaagagcttctaaattattttgatggttgcaaccactgtctgtgtgactccccagtctgtatcygaagctttttagttttttccagttgttttctgggcttcctccacctcgatgtttcgtaagtaccttaaagtcaacacgtcaaaaaataaactcattttttttcctaagcatgcttcaagccccatgttctctaacctagtttatggcaccatgccactcacccaggttaaaaactaggagttatttttgactgtatccttcatctcaccttcaaaatttaccaagtcctgccaattttagttcccaagtatttcttaatttttgccttacctctctgttccttaaacttatactcaattc

SEQ ID NO: 61505 - DNA, 601 bp, Human
actgatacatgcaacaacatggataaatctttaatatattatgttaagtgaaaacaaccaaactcaaaatgctatatactaagtggttccattttatgtgactgtctcaaaaaggcaaaactaccagaagagaacacagactggtggttgtccgtggggctacaatggagtgtgtgggaattctttggagttatggagatggtctgtaacttgattgtagtgatgggtacatgactctgcgtttgtcaaaatgagcaggatgtgactaaaaaaaaaaaaaagaaataacatgggcttgcargagagaaacaccagatccattgtaccactgtaagaattacactctaaggataagatttacatttaaaatctaggagaaataccagaaaattagcacattgcttttagtttcattattaattcctttttcatgtaacatttttactcctcttcacaatctccttttatgtaataatttacacttgattatttcttcagtaattagtaaagaaagaaagaaaatcagctttctgtaataagactccatatcacctatactcacttgagaaatactcattttgttatctcctactaaatgtat

SEQ ID NO: 61506 - DNA, 601 bp, Human
ttttactagcagacaaaacaatagcttattattaggaaaattaaatgagacaatatttgtaaaatacctggcacataccttacattcagtttttttaagtgttgtaaatataaataagttccttgcctttttatctctgtgtggatcttgttttgaaaatatgaggagtgaattttactaagttgccaaatttgctttattctttgtgaaccttagtagatgaattgtagtatcttttttaatgtagccatgatgtgaattattgaatgacacttctcagctagaccctatatctgcacayagaatgaaataaatacatgtcagaacacacgaactatacctagatagtaagtaaataattttttaggcattttaagttgataatttatgacataatgttgtagtataaatattcagctcaatttgtttttaatgaagaaaaatttttgtggaaatagtttaaatgtgaaaatgtgattatatcagagctgggctattcatgagaatcacatgtggaccatttaaagaaataccaatttctttccctaccactgcctttctaagagaagcagctaaacagtgatgtgctagtatatgttca

SEQ ID NO: 61507 - DNA, 601 bp, Human; identical to SEQ ID NO: 31167

SEQ ID NO: 61508 - DNA, 601 bp, Human; identical to SEQ ID NO: 31168

SEQ ID NO: 61509 - DNA, 601 bp, Human; identical to SEQ ID NO: 31169

SEQ ID NO: 61510 - DNA, 601 bp, Human; identical to SEQ ID NO: 31170

SEQ ID NO: 61511 - DNA, 601 bp, Human; identical to SEQ ID NO: 31171

SEQ ID NO: 61512 - DNA, 601 bp, Human; identical to SEQ ID NO: 31172

SEQ ID NO: 61513 - DNA, 601 bp, Human; identical to SEQ ID NO: 31173

SEQ ID NO: 61514 - DNA, 601 bp, Human; identical to SEQ ID NO: 31174

SEQ ID NO: 61515 - DNA, 601 bp, Human; identical to SEQ ID NO: 31175

SEQ ID NO: 61516 - DNA, 601 bp, Human; identical to SEQ ID NO: 31176

SEQ ID NO: 61517 - DNA, 601 bp, Human; identical to SEQ ID NO: 31177

SEQ ID NO: 61518 - DNA, 601 bp, Human; identical to SEQ ID NO: 31178

SEQ ID NO: 61519 - DNA, 601 bp, Human; identical to SEQ ID NO: 31179

SEQ ID NO: 61520 - DNA, 601 bp, Human; identical to SEQ ID NO: 31180

SEQ ID NO: 61521 - DNA, 601 bp, Human; identical to SEQ ID NO: 31181

SEQ ID NO: 61522 - DNA, 601 bp, Human
gcccggacggccatggccattcccggcatcccctatgagagacggcttctcatcatggcggaccctagagataaggcgcttcaggactaccgcaagaagttgcttgaacacaaggagatcgacggccgtcttaaggagtgtgagtgcacctttctttccatttaatcaagtgcctcgactcgcttctgcctctgacaaagcagaagcctttcgccgagcccggcaaccgagccttagagatgaccaggcctagggccagggacaaggcgctttgtcatccggccctgagcttgtggagcarcactccttcgggtgtagaaatggcccagtccagcccgggtgacagaacatcggcggccttgaggtgaaaatgaaaaagaagtagaggaggagtggggaagtgggccgaggatgtttcccaggttagggtgcaagaagggcagtgttggtggagtcccgggacttggagaggggaaggcgcttgagtcaagtaagctcaaacaagagatgagactcagggagtcggcttgttcttggagtcgaaagacggccgcggagcttaagagagaagtgttccagttgtcataataacccatatcgt

SEQ ID NO: 61523 - DNA, 601 bp, Human
tgcacctttctttccatttaatcaagtgcctcgactcgcttctgcctctgacaaagcagaagcctttcgccgagcccggcaaccgagccttagagatgaccaggcctagggccagggacaaggcgctttgtcatccggccctgagcttgtggagcagcactccttcgggtgtagaaatggcccagtccagcccgggtgacagaacatcggcggccttgaggtgaaaatgaaaaagaagtagaggaggagtggggaagtgggccgaggatgtttcccaggttagggtgcaagaagggcagtsttggtggagtcccgggacttggagaggggaaggcgcttgagtcaagtaagctcaaacaagagatgagactcagggagtcggcttgttcttggagtcgaaagacggccgcggagcttaagagagaagtgttccagttgtcataataacccatatcgtcttgtgtttcgtgttgtactgtatcaggcatacaaatttcccttacctcctgagtgcttaacttttttttccagtgcattttcattgaaaagcatgagtagtttaattaaatggaggaccataattacatgattctgtggagaa

SEQ ID NO: 61524 - DNA, 601 bp, Human
tctaattaagcacatctttatgagatcagctacaggtgcttgcttgagcaagttatttatatgctatctgtaggctaagagaaaatatatctttcaaaagaaaaatacataccttttcattctagatatttgccgagagaggtggatccactggtttataacatgtctcatgaggaccctgggaatgtttcttattctgagattggagggctatcagaacagatccgggaattaagagaggttggtactgtgtgccttgttctctgaacttagctaataaatactactagttttaggattmttaacaggagaaacaggatgaaaaagtactttttgtctaaatggtagttaagaatattatgtatttactattcttgctaagaagaatagcactgaatttctagctgtgaaaattactgtttttttttatttggagataatttggtgttagaaaaatcctgctctttttgtggcaaaggaacggagaaaaagctaaaaataattgatgtaatctgatatcctgtggttttgattatcataataagttacttgggtcagagcatatttggataatgtgtgtgatgagttttttccataacct

SEQ ID NO: 61525 - DNA, 601 bp, Human
aggctgtttgttatatggaccaccaggttggtattgaattatttctactccaccaataagataaatgaattaaggaattaaaaaaaaaaagacaatttttttatttttatttttttgagacacggtctcactctgttgcccaggctgtagtgcagtggcacaatctgggctaactgcaacctctgccttccgggctcaagtgattctcccacctcagtctcccacgtagctgggactgcaggcgtgcatcaccatgtctggttaatttttgtatgttttgtagagaagcaattttgccatrttgctcaggctatctcaaactcctggactcaagcgatctgcccaccttagcctcccaaaatgttgggattacaagcataaaccactgcgcctggccataaggtggaaatttgatgtgggcagttccaacttctcctctcttcagagtgagaatgagataggatatttatgtctactgttctttgaggcatgcttagtgcatttgtgcctcacagtacatttatcttaacaggccatgtgattctagtgcaacagtcctcaaattgtggttcacagacccagaggtgctttcatggactct

SEQ ID NO: 61526 - DNA, 601 bp, Human
taaatgtaaaagaacctttttccctctcttaatctgtaattgtgacttgtatgaagtagataccacaatgaatcagatgttagtttaaccaattttaataaataacctttcatggccgggtgtggtggctcatgcctgtaatcccagcactttgagaggccaaggtgggcagatcaccaggtcaggagatcgagaccatctggccaacatggtgaaaccctgtctctactaaaaatacaaaaattagctggatgtggtggcacatgcctgtaatcccagctactgaggaggctgaggcacragaatcgcttgaacccaggagacgtaggttgcagtgagccgagatcacaccactgcactccagcctggcgacagagcgagactccgtctcaataaataacctttcactttaacaaaatgagaaatgttacaccaaaatcaagtctaactttgtcagcataattcttgctctttaattttcatcttaatgttttaagccacagactgttatgttctgttttcttaaatgatggttgtagaggaaaagagtaatgcatataaatttccaaatctactatcttaggtggtcgtcggttttctg

SEQ ID NO: 61527 - DNA, 601 bp, Human
ctggaggaaaggcagagtacatagatgcttatgatgacaggttcttagatagtgcaggaacttgtggaagtgtttttttctgaatgcttctgttttctcagtgaagtagaatgcacgttcagaatgaagatagggaagtgttcttagagatttgaggacaaaggagaaggtataaagtcattatctatggaagtgagggattggactagggtgcaggccagtaaaacatggcttgtgaaccaaattctgcctgccctgtgtttttggaaacacacaaagttttgttgtaacccaagcatgstcatttatctgttgtctatggctgctttcctactggaatagctgagttgaatagttacaacagaaaccatatggcttgcaaagcatacagtatttactctctggccctttacataaaaagtttgctgacctccagactagggaaatctagtataatttccaggcagccttaaaaactctttagaagttaatggtccagaataatgacaaatagctgattgttgaatttcactatcttcattgcccctgttagagagttttgagctggaaagaccgaactgaacaaaggatgtcaatgtat

SEQ ID NO: 61528 - DNA, 601 bp, Human
acatggcttgtgaaccaaattctgcctgccctgtgtttttggaaacacacaaagttttgttgtaacccaagcatgctcatttatctgttgtctatggctgctttcctactggaatagctgagttgaatagttacaacagaaaccatatggcttgcaaagcatacagtatttactctctggccctttacataaaaagtttgctgacctccagactagggaaatctagtataatttccaggcagccttaaaaactctttagaagttaatggtccagaataatgacaaatagctgattgttgamtttcactatcttcattgcccctgttagagagttttgagctggaaagaccgaactgaacaaaggatgtcaatgtataggtttcttccacaaatactgagctcttgctagatgccagatactgtgctagccttgggaattcttgctctcaggaagcttacaatgaacttaaacctgattaaagacaattcatgaatatatgtgtgatttcaaatagagaacgacatgccctatattgcctgaccaaacggtgcatcatcaaagttattcaaactgtagtagcctgtgctgtcttacttctct

SEQ ID NO: 61529 - DNA, 601 bp, Human
gattaaaattgtagttcttttttaactaggtgggacattcacatctggaaacatactgaaatttttatcttctttttagacttgaaggcttttttgttaacatttttcgtaagttaaaatacacttgattcaactacagttgcccttcctgttcaggtcctgacattatctcttttggattataatacatctctattttattttttcttttgagacggagtctcactctggcccaggctggagtgcagtggcatgatcactgctccctgtagcccagacctgatcatttctcctttatctyccagtagctgggactataggcgtgcgccaccacacccagctaatttttgtattttttgtagagacgggtttcaccatgttgtccaggctggtctcaaattcctgggcccaagtaatccacccacctgggcctcccaaaatgctgggattacaggcacaagctaccaggcctggccaggcatctcttgtgcagatttacttattcactaaagtgatttggaaaatagccatgtgtgcaaggtttacaaaaataacttacctagtttcactgtagctttctaaacaagttttgaaactttgt

SEQ ID NO: 61530 - DNA, 601 bp, Human
aagttaaaatacacttgattcaactacagttgcccttcctgttcaggtcctgacattatctcttttggattataatacatctctattttattttttcttttgagacggagtctcactctggcccaggctggagtgcagtggcatgatcactgctccctgtagcccagacctgatcatttctcctttatctcccagtagctgggactataggcgtgcgccaccacacccagctaatttttgtattttttgtagagacgggtttcaccatgttgtccaggctggtctcaaattcctgggcccragtaatccacccacctgggcctcccaaaatgctgggattacaggcacaagctaccaggcctggccaggcatctcttgtgcagatttacttattcactaaagtgatttggaaaatagccatgtgtgcaaggtttacaaaaataacttacctagtttcactgtagctttctaaacaagttttgaaactttgttattttttaaaaatcagtcatttccattcacccggtttctaggacaacatagattgtttccttatgtagaaatctagaaaggaagtaatccttgaaatcttctatattaa

SEQ ID NO: 61531 - DNA, 601 bp, Human; identical to SEQ ID NO: 19029

SEQ ID NO: 61532 - DNA, 601 bp, Human; identical to SEQ ID NO: 19030

SEQ ID NO: 61533 - DNA, 601 bp, Human; identical to SEQ ID NO: 19031

SEQ ID NO: 61534 - DNA, 601 bp, Human; identical to SEQ ID NO: 19032

SEQ ID NO: 61535 - DNA, 601 bp, Human; identical to SEQ ID NO: 19033

SEQ ID NO: 61536 - DNA, 601 bp, Human; identical to SEQ ID NO: 19034

SEQ ID NO: 61537 - DNA, 601 bp, Human; identical to SEQ ID NO: 19035

SEQ ID NO: 61538 - DNA, 601 bp, Human; identical to SEQ ID NO: 19036

SEQ ID NO: 61539 - DNA, 601 bp, Human; identical to SEQ ID NO: 19037

SEQ ID NO: 61540 - DNA, 601 bp, Human; identical to SEQ ID NO: 19038

SEQ ID NO: 61541 - DNA, 601 bp, Human; identical to SEQ ID NO: 19039

SEQ ID NO: 61542 - DNA, 601 bp, Human; identical to SEQ ID NO: 19040

SEQ ID NO: 61543 - DNA, 601 bp, Human; identical to SEQ ID NO: 19041

SEQ ID NO: 61544 - DNA, 601 bp, Human; identical to SEQ ID NO: 19042

SEQ ID NO: 61545 - DNA, 601 bp, Human; identical to SEQ ID NO: 19043

SEQ ID NO: 61546 - DNA, 601 bp, Human; identical to SEQ ID NO: 19044

SEQ ID NO: 61547 - DNA, 601 bp, Human; identical to SEQ ID NO: 19045

SEQ ID NO: 61548 - DNA, 601 bp, Human; identical to SEQ ID NO: 19046

SEQ ID NO: 61549 - DNA, 601 bp, Human; identical to SEQ ID NO: 19047

SEQ ID NO: 61550 - DNA, 601 bp, Human; identical to SEQ ID NO: 19048

SEQ ID NO: 61551 - DNA, 601 bp, Human; identical to SEQ ID NO: 19049

SEQ ID NO: 61552 - DNA, 601 bp, Human; identical to SEQ ID NO: 19050

SEQ ID NO: 61553 - DNA, 601 bp, Human; identical to SEQ ID NO: 19051

SEQ ID NO: 61554 - DNA, 601 bp, Human; identical to SEQ ID NO: 19052

SEQ ID NO: 61555 - DNA, 601 bp, Human; identical to SEQ ID NO: 19053

SEQ ID NO: 61556 - DNA, 601 bp, Human; identical to SEQ ID NO: 19054

SEQ ID NO: 61557 - DNA, 601 bp, Human; identical to SEQ ID NO: 19055

SEQ ID NO: 61558 - DNA, 601 bp, Human; identical to SEQ ID NO: 19056

SEQ ID NO: 61559 - DNA, 601 bp, Human
cccttctatgctgcattagaaggagaggttattaaaatgtaataaatcattttccagtccctttgggagaaaactttttatggagccaattgcaacaagtttctgacagcttattctcgttagttaaaaaaaaaaatccaagaaatcactattaatgagaccatgtttcctacctatgactggaaaacacaactacccagtatgaaatgtttttgagttctctattcaatacacacagattttatactcttgtcacttggatatagtgtgatttttatgatttgggacctttttttccctmagacactagttctgtccatgattaccatgggaatatcttcaggcagagctcaggtaacaatatgagactgcatctttgcatcagggcctctgagaaatatatcaaaataaggacatctatatttgttttatttgattttgatttccttgaaagcagaatcatttaccagatgaaacctttatgctagagtgcttctatttaccaaatagacttaaggtttctagtgtaggatttaggagaactcagctcgctggcattcccagctgtctcatggctcctggctcttttggtcaaggccac

SEQ ID NO: 61560 - DNA, 601 bp, Human
acttgccctgagctgtttggtagctaatttgcaaaaattaatgactaatcaagacattatgatcactttaaagttcaataattgtgagattattcaatgtggcaatgaaattcatgattgagaagaaatatttgaagtttttaaatttcccataattatggcacttagcattggtaaataaatgatgaaaaatgaagctaccaaactttaatatggatttccttttaattgaggcacttgaacaaatcattccaaatgtttagccttgtcccatgcagtacagattagaatgaaatctacrtggtgaagatccgaggttaaatactaagaagggagttctcagtctctccagtaccatttttatacagtatttctctactctcttccttcttcctaaatattaccaaaattaaaggccaaaaactttttaatgacattctgttctgtgagcaaatgcctcatctctaagaaaaagattaatttcacactcttttaatataaactatcacagtgctgcaggaggtaatacatttaaatatgtatgtgctaatgagtctgtgcttttctcattcacagagcatttaatttgtgccaaacaaag

SEQ ID NO: 61561 - DNA, 601 bp, Human
cagatgatggtgaataggacaactgaggtacagtattgtggttataccaaaatttaccttgtctttatttttagtttttgcccaattggaataaatgctcactaattcatactaatgattagaagtttgattaatgggaaattaatttgaaaaccttccccataatgaaggcaaactgataattcaaagatatttagtgtaacatatatttgaagcattatttttatcagtaaaactatttaaataagttattagagaatgaaatgaaactctttcttaacatatattttaatgagtgagmtttactattaacttattgtcaagaagagatatgattttatttccttaatgagaattcttaggttagagttttaaggaagtgaaaatttgggaggtttctctgccactgagttttgtctttttatctaattgctgttgccctttttttttctgtatgctctttttctttaccacatttatataataaatgatgttattgagcatatcaagagcagaccaattgctttttcttgtaagtcttaaaatacttgtcatggaattgtatattttccacattccaaagtaagtcacatcaatcaat

SEQ ID NO: 61562 - DNA, 601 bp, Human
gcatggaacctaggtcagagacaacggaaagcccaactgcttggtgaacttgttcacaactggaaccgtacaaattgatatcttaataactaatttcaatacctttaatttcttagatgctttttggtgattatttaagatacatttttgaaagcagtattggctctaaacattgtgaaagcagaagtttgggtggatttttactgagttataaatatttgcttgaagacaatagagtaaaaagaagagaaaccccttcgtctaatcctgtagaaatgtgaactctgcctcctacttccaygttaatcagggaagcgttcctctgaagggctgataccagttttgtgctgatccaagattgacagcttggttatcattatgaatgatcagtgaggctgtatcagacaataagtttatttttgcaaatgatattactatatttaaatactttgaaaatgatccacccaccctcaatatgtttttctgaaactaaattgtaacatcagtaatagacacacactcagggtatgtctgtgtgacaggaaatatcaagataaacatgaaataaatttagtcaattatttcctaaaatatgaaaatt

SEQ ID NO: 61563 - DNA, 601 bp, Human
tagatttggttaatcatagacttcagcaaaacttcaaatgtgcctataatacaaaaatgttaatatgtggtataaaagtctatgttaatatgtggtgtaaaaagcctatgaaagatgataaatagaatatgtctcttatggtattttacttcactttgtttaattctgagacttcatgttttcatagtcccagcagtaaagatcaaatctagtttccttgcaaatctgggggctagcaaacacttttgtttaataaactttatcatctgtaagcttccagaatctataccagtcccagackataaattatggtttttaatgacctcaggaaaccttgctttcttaatctcacttctctaaaacttttggtccagagtggctacatcacaacacgtgggagttctggagaggtttgcgttctgtcaaatctttgctgtggtgtccagtgtctttgcatcagagttttatatggtttctactttttgcttagtaggcatgcctttttccttaccatactgtgagtatacagaatttggaacagtatgcgttatgttgcatggtttgcttacttattctttctatttaaaggaatgagttttgc

SEQ ID NO: 61564 - DNA, 601 bp, Human
gtcccagactataaattatggtttttaatgacctcaggaaaccttgctttcttaatctcacttctctaaaacttttggtccagagtggctacatcacaacacgtgggagttctggagaggtttgcgttctgtcaaatctttgctgtggtgtccagtgtctttgcatcagagttttatatggtttctactttttgcttagtaggcatgcctttttccttaccatactgtgagtatacagaatttggaacagtatgcgttatgttgcatggtttgcttacttattctttctatttaaaggaakgagttttgcacattactacattactaacatcattactaacattaccaatgtattacattacaaacatactttactaacataatttcttcctatatactgcctttatgagattaccactggaaagaaagcattttggaaatgcaaaaaaatttttatcttggccaatgtcttaaggatgcacattgcttttattaatgctttttggagtattaactcattattaagatagttgactttgttcttattaatcaacagtatttacttaataaaagtactctaatttgtgtggcttacatatat

SEQ ID NO: 61565 - DNA, 601 bp, Human
caacagtatttacttaataaaagtactctaatttgtgtggcttacatatatttgggtatacaattaaaaagtctaactccaaatagacagtgtatcttcataaaaagagtactaagaaatgaagagaaatggattcttatactagttctgtcatagtgcagcctttagatacagcaaataaattaaatttcattcaaggatttaaaaagaataaaataggttttctaactgtatacattgtataaacattccattcatttattccttaaacaaataactattgagttcctacttggtgctrtgaaccctgaagatacgacagttaacaagacagagtaggtttctagactcatagagatgcaagtcagtagttcaaggaattaagttaacagtcttcttgtaaaagtttaataataggttcttaaaaaacaaaaaaacaaaaaacaaacaaaacccttgatttgtagcattacctttgctggtttccatggtgtaaatacttctacagtggtcagtttagagctagcaacttggtatcactaaatgtagaattgggaagaggtgtgcaaaaagtggctctccttatttcatatgagctggt

SEQ ID NO: 61566 - DNA, 601 bp, Human
aaatgaagagaaatggattcttatactagttctgtcatagtgcagcctttagatacagcaaataaattaaatttcattcaaggatttaaaaagaataaaataggttttctaactgtatacattgtataaacattccattcatttattccttaaacaaataactattgagttcctacttggtgctgtgaaccctgaagatacgacagttaacaagacagagtaggtttctagactcatagagatgcaagtcagtagttcaaggaattaagttaacagtcttcttgtaaaagtttaataatargttcttaaaaaacaaaaaaacaaaaaacaaacaaaacccttgatttgtagcattacctttgctggtttccatggtgtaaatacttctacagtggtcagtttagagctagcaacttggtatcactaaatgtagaattgggaagaggtgtgcaaaaagtggctctccttatttcatatgagctggttccagcacaccccaggattagctacaatattgaatggttgcactgaacatttttatttttattatactttaagttctggggtgcatatgcagaacatacaggtttgttacacaggt

SEQ ID NO: 61567 - DNA, 601 bp, Human
atgctgctatgaagaactgcccgagattgggtaatttataaaggaaagaagtttaattgactcacagttctgcagggctggggaggcatcaggaaacttacaatcatggcagaagcagaaacaaacacatccttcttcaaatggtggcaggagagagaaataagtgcccagtgaagggggcagccccttataaaaccatcagatctcatgagaactaactcactgtcacaaaaatagcatgagggtaaccaccccgttattcaattacctcccactgggtccctcccatgacacatagggwttacgggaaatagaattcaagatgagatttaggtggtgacgcctaaatcaaaacattgataaactatatcaatgtttaatttggttttgactatatttttagagaatataataaagcttctacatatgaaaatttttttttttttgagacggagttttcactcttgtcacccaggctggagtgcaatagtgcgatctcggctcaccgcaacccccacctcactggttcaagcaattctcctacctcagcctcccaagtagctggaattacaggcatgtgcctggttaattttgtattttt

SEQ ID NO: 61568 - DNA, 601 bp, Human
agtaacaataatggttttcaattgtcatatgcatatgttgttctaggcaccctgctaagtactctacaaatatcatcttattttatcttcctaacaacttatgaagtgtgtattattttcttgttgagaatatatggaggtcttcatttgagaaatgagactaccaaagggagaaattagtttcagcagaattatgtaacttgacctaggacacagaactttgtaatcagcagagcctacccatgtattcacacaaacttcagaatacattgttgaaagaatgacctaagcagagagggggaagatatgaaaagataaagaaactacataagtggcatccctccaatgttgattgatctacctttatgaaaattatccacatcatggtgtatagtacatccgtgtgatgaactgattctagagaaaaaaaaaaaaacaacaacagagaaaacacaaggggtctctggaagggggaaaaacccataacctgcaactacaaacttaagaatttaagtaaaaagattttagaatacaaaagcttgaaaagaatttttttggggcattaactttataatgtgctttgcagaaaatattcaaaatc

SEQ ID NO: 61569 - DNA, 601 bp, Human
gtaacaataatggttttcaattgtcatatgcatatgttgttctaggcaccctgctaagtactctacaaatatcatcttattttatcttcctaacaacttatgaagtgtgtattattttcttgttgagaatatatggaggtcttcatttgagaaatgagactaccaaagggagaaattagtttcagcagaattatgtaacttgacctaggacacagaactttgtaatcagcagagcctacccatgtattcacacaaacttcagaatacattgttgaaagaatgacctaagcagagagggggwagatatgaaaagataaagaaactacataagtggcatccctccaatgttgattgatctacctttatgaaaattatccacatcatggtgtatagtacatccgtgtgatgaactgattctagagaaaaaaaaaaaaacaacaacagagaaaacacaaggggtctctggaagggggaaaaacccataacctgcaactacaaacttaagaatttaagtaaaaagattttagaatacaaaagcttgaaaagaatttttttggggcattaactttataatgtgctttgcagaaaatattcaaaatct

SEQ ID NO: 61570 - DNA, 601 bp, Human
tgcaatagatgaaatatagatttttttgaagtgaacttgggcctaattctttaattcttttggcaggatgggttgacaccacttcactgtgctgcacgaagtgggcatgaccaagtggtggaacttctgttggaacggggtgcccccttgctggcaaggactaaggtgagtcattatgagtaagatggggtcctaagaaatctttaagttacttgatgtattatctctattcttttttaaattgaaacatcaggcaagcattttctagttctttaataattgtgtgctaggaataggaatrtgtatcaaaccacttaaaattattaaaataaacagatatatgaattaagatgtattaaatgtgtgccttcaagtttttgtctatatttttacctgttattcttactgcagatggaaatctgaatacatctgtattttaaatataaatgagaatatctcttagatgctgagtctagatttttatgattctctcagatgactatgaaacatatataaaattatcttttaaagcagaacaattagcaacacaaaatgaatctttttgctcatccaatctttatctcttaggcaatactaataa

SEQ ID NO: 61571 - DNA, 601 bp, Human
aatatctcttagatgctgagtctagatttttatgattctctcagatgactatgaaacatatataaaattatcttttaaagcagaacaattagcaacacaaaatgaatctttttgctcatccaatctttatctcttaggcaatactaataaaaagtaattactcaacagtggcattggttgattatgttgaagattagtagaggtgatttggaaagtacaagttgcaataggccacctacaaagaactattaagcaagcatattttctttatgacatactacatctagccctttttcctccygttttatcaatatgctcaaatatgggagaagcacttttccatatacatgagcaccacactgtgagttggtttgctgaagatttttcattatcaaatgtattttaaatgcttttattattgtatagttctctattatccaaccctacattgggttatcagaaaatattttgagacacgaattggagatactcatacagagctgattaatgtgatatgcagcaaccttggatccttaaatacaacacaaagttagacaaagggcagttgttgtattttctccctattccattccacctcata

SEQ ID NO: 61572 - DNA, 601 bp, Human
agctgctgattgtgaagtgaaacaactcaagagtatcctggatgttcggataaatttactagtttttcatggacttgaaaaaataaaataaacattcgttttatccttataaagatggagaagaaaaatacaaaaatcagctgggtgtggtggcaggcacctgtagtcccagctactggggaggctgaggcaagagaatcgcttgaaccctggaggtggaggttgtggtgagccgagatgttgccattgcactccagcctgagcaacaagagtgaaactttgtctcaaaaaaaaaaaaaaagatacaaatctatattttccagactaaataattatgccttttcataggtttcttaaatccttggatatattgctgaatttcacaaaaagggacaactttattctttaccatccagagcggtgggttaatttatgatttgacgatctttgttccctggcagcgtggtgagacggcactacacatggcagcccgagccgggcaggtggaagtggtccgatgcctcctgagaaatggtgcccttgttgatgccagagccagggtaggtactggtgccctgaggttctcttctatcgcagcgca

SEQ ID NO: 61573 - DNA, 601 bp, Human
tcctccccttgcctgattgccctggctagaacttccaatactatgttgaataggagtggtgagagagggcattcttgtcttgtgcagcttttcaaagggaatactttcagcttttgcccattcagtatgatattggctgtgggtttgtcataaatggctcttactattttgagatatgttccatcaatacctagtttattgagagtttttagcatgaaggggtgttgaattttatcagttttttctacatctattgagattatcgtgtagtttttgtcattggttctgtttatgtgatggrttacatttattgatttgcatatgttgaaccagtcctgcatcccagggatgaagctgacttgatcgtggtggataagctttttgatgtgctgctggattcagtttgccagtattttactgaggattttcgcattgatgttcatcagggatattgtcctgaaattttctttttttgttgtgtctctgccaggttttggtatcaggatgattctggcctcataaaatgagttatggaggagtctctctttttctgttgtttggaacagtttcagaaggaatggtaccagctcctctttgtacc

SEQ ID NO: 61574 - DNA, 601 bp, Human
gtggataagctttttgatgtgctgctggattcagtttgccagtattttactgaggattttcgcattgatgttcatcagggatattgtcctgaaattttctttttttgttgtgtctctgccaggttttggtatcaggatgattctggcctcataaaatgagttatggaggagtctctctttttctgttgtttggaacagtttcagaaggaatggtaccagctcctctttgtacctttggtagaattcagctgtgaatccgtctggtcctgggctttttttggttggtaggctaattactgcytcaattttagaacttgttattggtctattcagggattcgacttctgcctggtttagtcttgggagggtgtatgtgtccaggaatttatccatttcttctagattttctagtttattggtgtagaggcatttatcgtattctctgatggtagtttgaatttctgtggggtcagtggtgatactcaagcctctgtaatggcggacgcccctccccctaccacgctggagcctcccagattaacttcagactgctgtgctggcagcgagaatttcaagccagtggatcttagcttgcttggct

SEQ ID NO: 61575 - DNA, 601 bp, Human
ttcagaaggaatggtaccagctcctctttgtacctttggtagaattcagctgtgaatccgtctggtcctgggctttttttggttggtaggctaattactgcctcaattttagaacttgttattggtctattcagggattcgacttctgcctggtttagtcttgggagggtgtatgtgtccaggaatttatccatttcttctagattttctagtttattggtgtagaggcatttatcgtattctctgatggtagtttgaatttctgtggggtcagtggtgatactcaagcctctgtaatggyggacgcccctccccctaccacgctggagcctcccagattaacttcagactgctgtgctggcagcgagaatttcaagccagtggatcttagcttgcttggctcccctggggtgggatccactgagctagaccacttggcttcctggcttcagccccctttccaggggagtgaaccgttctgtctcactggcgttccaggcgccacggtggtatgaaaaaaaactcctgtagctagctcaatgtctgcccaaatggcatcccagttttgtgcttgaaacccagggccctggtgatgtaggca

SEQ ID NO: 61576 - DNA, 601 bp, Human
atgtaggcacccgagggaacctcctggtctgcaggttgcaaagaccatgggaaatgcgtagtatctgggccagagtgcaccattcctcatggcacggtccctcacggcttcccttgcctaggggagggagttccctgaccccttgtgctttccaggtgaagtgaagccccaccctgctttggcttgccctccatgggctgcacccactgtctaaccaatcccagtgagatgagccagatacctcagttggaaatgcataaatcacctgccatctgtgttgatctcgctgggatctgcagaygggagctgttcctattcagccatcttgccagcctccggccacttccaagtctttatcagtaaaatatgagggttggactcagaaactcaaaactcctttctagactttcttaacattctttgattcaatgaatttaatagacattttcttgtaacaggttccacagatcttcatgcagaatccagtgatacacgggtagccttaacattactcttgttgtcttggttttcatctgcctttctgtgcattgtccacatagtgtaatttatgttctttggtaatcatcattgatctattata

SEQ ID NO: 61577 - DNA, 601 bp, Human
attcaagattgtgctgattaacctgtggtgacagagttaagataagaaaaagatttctcctctgattccgcatctttctcctaactctttctgctaacgtcattatctcccacttcaaatgtaaagagagcccctcttcctcccatccgaacaaaccactggtttctaattagtcacattctttccctgagcttatgactatgatcaggataaaagatcaagcttgggctcatgcgcattcatgcggcccatttatgaggtgggataagaagaccagcagcccttctagaaccacatggartatgggatgtccgtttcccccaaatgagggatggctgtcccagaagaagggtgcagggggtattgggcagaaaaatgagcacatatctgctattttacctcttgatttctcaccgcacgcatgcgtgcacatgcacgcacagacacacacacacacacacacacacacttttggaaacttcctctctaaacctaataacattgctcgagaattcaccctctcccgaagaagagatagtaaaaaattgtgccaagctactacattgagctccaaggttgagattgctgcgtagttcacaat

SEQ ID NO: 61578 - DNA, 601 bp, Human
gtcaatgattgccacttctcagctatggattaaagagtcatcattgctccaactatccctcttactcatggaaaatctattttagagtgtgtcacttgcaatacccacccacctttatcaaattttgcaggacagagatctgagaagggaaccccagaaacaacaaatgttcatcatagctattctcaagttccttggtttttaaattgttgtttgttttgctaaccatttatttttataaataaaaatatgttcattttatttataaataaaaaatgtttattctcccaattcctctatwtttttcctctgtatttcagagaaattttatcttctaatgtgttgtcagtctcctttcctactgagagtcactttgttccgacaggtctgttagtggccatcttattgtagtatctgtttccaaagaatgtataggcagagaaatgtctttagaatccaatgccctgaattcaagttctgttttaatagctgagtaaccttggacaatctttgagaacttgtttaatttttcttaatattgacctggaaaatggtctaataatacattttatgctttccttttaactctgttagaaagatg

SEQ ID NO: 61579 - DNA, 601 bp, Human
ctctatttttttcctctgtatttcagagaaattttatcttctaatgtgttgtcagtctcctttcctactgagagtcactttgttccgacaggtctgttagtggccatcttattgtagtatctgtttccaaagaatgtataggcagagaaatgtctttagaatccaatgccctgaattcaagttctgttttaatagctgagtaaccttggacaatctttgagaacttgtttaatttttcttaatattgacctggaaaatggtctaataatacattttatgctttccttttaactctgttagraagatgggtcacatatgcattgtacatgaagaaaggttttcaattgcaaatgttcacaaaatttcaattctagtctaaaataatcatattactgttatttatttacttcttactaccttggaattcatgcagtgctattttatctcttcctatagctccttttcttttttcttataactttaagatactgcatgtttttggatagatctttcttcctctatatacttttctccattcattcttagccctgaaagtcagcccagttttcccttcctcacttttattatgacatgcccttgg

SEQ ID NO: 61580 - DNA, 601 bp, Human
tccaatgccctgaattcaagttctgttttaatagctgagtaaccttggacaatctttgagaacttgtttaatttttcttaatattgacctggaaaatggtctaataatacattttatgctttccttttaactctgttagaaagatgggtcacatatgcattgtacatgaagaaaggttttcaattgcaaatgttcacaaaatttcaattctagtctaaaataatcatattactgttatttatttacttcttactaccttggaattcatgcagtgctattttatctcttcctatagctcctyttcttttttcttataactttaagatactgcatgtttttggatagatctttcttcctctatatacttttctccattcattcttagccctgaaagtcagcccagttttcccttcctcacttttattatgacatgcccttgggcagatagtaaagatatacctctttttatcactaaagttacactcaattttctttttacaagagaatggtttggcctggttctctaaacactgaaaacattatttccaactacacttcagagtcaggtgattttcctgagcctcctggaacatgtccttcc

SEQ ID NO: 61581 - DNA, 601 bp, Human
cataatatattcttaagaaaaagataaatgaaatccctaaatatattgaactggtaatactaatgaggaagagggtactgcattagattggcagtactatatttgctgtgagttatagtaccagatcgaagctcaatttacttgtacattttcgcaaccctactattagccaccacttatttgacattctcattcccatattagtttccaactttaccaactacacttttgcctgggtatttacagtgtttaaagagagctgaagctggaaaatcacacttctttagttgttattgacatygagcaaagaattttacttatgttccaagtttcatgacagggcagagtaatttttcccatgctttatacatgctgtttgacattcataatttggagatgacttagaataaaacatgaatatactcagctaattagagcaaaattaattgagccagtgcaagtgaatttgtcatggggcaaaataattcccacaaatgtaacagtgattcagattaatgaaaggacaatttcaattctctcataatcagtaggtataagtacttcatccagggagagggaaagttgcaaatttaaactgaga

SEQ ID NO: 61582 - DNA, 601 bp, Human
aatgtaacagtgattcagattaatgaaaggacaatttcaattctctcataatcagtaggtataagtacttcatccagggagagggaaagttgcaaatttaaactgagatagtgatgtggcatctgtcctcttgtaagtaggagcagcccactagctgttatggcttatctggttgcctgttatgacttacctggttgcctatggctgtaaaaggtattttgatataagaaattgacaattattgaagttctgaactctgaaaagttggaaggattttaaaagttcttaaaaaaaaaaaaaactaagcaacaaatgtagtaataacctgagagatttggtgattgtcttatcagaggagggtgtaaatcatcaaaattaagatacataaaatacagaaatagataataaaacgtagtcttttgtctgtcaaagatatttaggatttaaaaaatataactatatccatggtaaattagggcgataaaatagaataaaatgttaaacagtgttttttttttttttttttttttgagacggagtctcgctctgtcgcccaggctggagtacagtggtgcgatcttggctcactgcaacctctgcc

SEQ ID NO: 61583 - DNA, 601 bp, Human
gccactgcacccggccaaacagcattttaagagttcagctgactagggctgaacagtggttgattcatcattattaaagacatttaagagggtaaatgaaatcttggtgagattaacataaaggaagaaggcagatgtgtgactcaagagatgccttctaactttggttttgttattctacagtagattttatgtatttttgtctaataatcatttccaaacttataagagttggatcactattctagcaagactttaaagataaggagtttatgttttcttcctcatgatgcagttagcytcaaagaactctgtttcatcctgagtatcaccctaatcattgtgtgcattgagtggagggaggagagctctaaccacaaatgctggtttatatggacaatgcaagaaggaataaatacttcctacgtttgtcccacacttggaaaaaaccagaagattcgctctcttccaaggatttattaataccaaatgttcaaaaaagaagcaaaaagaaaaacgtcatctcatttaaaaataatttgtctggagacaccgaaagggcaatattgcttcttgggggatattctgtgtttatgatggg

SEQ ID NO: 61584 - DNA, 601 bp, Human
ttgagtggagggaggagagctctaaccacaaatgctggtttatatggacaatgcaagaaggaataaatacttcctacgtttgtcccacacttggaaaaaaccagaagattcgctctcttccaaggatttattaataccaaatgttcaaaaaagaagcaaaaagaaaaacgtcatctcatttaaaaataatttgtctggagacaccgaaagggcaatattgcttcttgggggatattctgtgtttatgatgggggcttaaatggttccaggataagccatggcttagagcacctaacccagscatatttgctatgtgttttacaggccctgatcggtgttagaattcccccactcccactgtagtgccagaagagcatgtggttaaactgtctggccaagaggatggatttgacatcatggtgtaggaactgtgccatcctcgagatcttagtccagagacttatctgtatttataacacactgctaattacagagtaaggccattggttaggcacggaagacactgaatgtacacatatcaacatgtgtaggagagcagccctctaaaaaaagctctaaagcttcagtgtgtttaaaagtc

SEQ ID NO: 61585 - DNA, 601 bp, Human
tatactctcattctttccgacttcaaacttctatttgtttctttgtctttttttttaatgttttacctgtgttaactgtagcatggatccctctaagtccctagattcagaggtggtgggaggatgcctttttggtgtatatctagcaccaaattccgaaacagctccaactaagacttgtacttacggacagggcatttcccaccattctagttggccccttattacactgaaaatatatatgaatgtcgtataatgcataaagtcctcattgcgtctttcgttcattaattaagcacasctattttgagaacacatcagggtttatttaaaaaatattgattgtaatgggaaaatatttatgctatattagacaatataataaaaaaactgccaccatttatttgccaaacactatgccgagcactttacaggcaatatctcataataaccccatgagactggtattctaatgatctccgttttgcagatgagaaggtgagatttaagtaggttaattttccaaagtcatatgaataataagtgttagagcttgtacctgtgtttgacctcaggcagactgactttagagccggtgctc

SEQ ID NO: 61586 - DNA, 601 bp, Human
ccgttttgcagatgagaaggtgagatttaagtaggttaattttccaaagtcatatgaataataagtgttagagcttgtacctgtgtttgacctcaggcagactgactttagagccggtgctcttaaccactaggtcctttgtgccccaaagcaatagagggagatttattccacttctgttatacaaatatatacatatatactcatatgcctatttaaattttatacatattataaataaaaaataggatatatacataaaatatgttctgtataatatatattttatatataaatataytatatatatcataaatatataactttgtacacatacatacatatacatctacatatatttatatctttttgatgccaataaacagtttataataaagtacttgaactgtcaaaagagggtgccaaatgttcataattatccacactgttcttactcctcttttttctacaacctcatcaattcagcacatattttatgtctttctttacactagattataagctactagaggagtgttcatatcatattcatttgcatatctatgaggtgtttaataacatatgtgagttcccaataaat

SEQ ID NO: 61587 - DNA, 601 bp, Human
ttttatgtctttctttacactagattataagctactagaggagtgttcatatcatattcatttgcatatctatgaggtgtttaataacatatgtgagttcccaataaatttggatgaaagaatgaagattgagcaactatggaataaaaatatacctgctcacttaacataccagcattttttttttcattagctttccaggctgaccattctcaacatagatacaaaagacttcattagtactcatgagtactttcgttgaactcttacaatgtgcaaagaaaggattataggtactcartgggaggtaaaattgtaaaacgtgtgttctctttccacaagggactctcaatctacttgtaagagaagacctagattataaaataatgtgtatagttttcctaaggagataaacatagccttgatttctagcctctaccttgtatggtccttaatcttaggcatgcacgtaccgagttcagaagatgacataaagcatttgtctactccagagtccacagtaggatgggtattctgggaatgcctctctagtgtctttcacttatctgccccagcctgtcaatgaacatgagcccttcat

SEQ ID NO: 61588 - DNA, 601 bp, Human
tgttcaccattgtattcccacacctagcacactgctcggcatattctaggcactcagtaatatttgttgaaccagtttaaagtacaatccaaacagaagcatattagttggagtattatagtaagataatagaaataattccatttgattctttatgttataaccatatgtgaagtgtagccttggttccagatagcacacacaattcaagagcaatattgacaaactagaatcagctcagaacaggtcatccttatagggagagatctagaaatggcacttccatcaggaatggttgaargaatggagaaaattagcctggaaaacagaaaactaaaggtggatatgaaaatcatccccagtatttaaaggatggtcatgtagaagaggaacctggcttatcctatgttgcttttcaggagagaagcaatattataaggagagaatttttagttctggagctttgatgtctatatctgtcttacagtagaatggggtgccttgtgacttttattgtagagattcggttattgttgaatggaaacgtgatgagtaagagtttggattaactgtaaactcacttttaactcttctattgatt

SEQ ID NO: 61589 - DNA, 601 bp, Human
cccacacctagcacactgctcggcatattctaggcactcagtaatatttgttgaaccagtttaaagtacaatccaaacagaagcatattagttggagtattatagtaagataatagaaataattccatttgattctttatgttataaccatatgtgaagtgtagccttggttccagatagcacacacaattcaagagcaatattgacaaactagaatcagctcagaacaggtcatccttatagggagagatctagaaatggcacttccatcaggaatggttgaaggaatggagaaaattarcctggaaaacagaaaactaaaggtggatatgaaaatcatccccagtatttaaaggatggtcatgtagaagaggaacctggcttatcctatgttgcttttcaggagagaagcaatattataaggagagaatttttagttctggagctttgatgtctatatctgtcttacagtagaatggggtgccttgtgacttttattgtagagattcggttattgttgaatggaaacgtgatgagtaagagtttggattaactgtaaactcacttttaactcttctattgattagagatttttatttcc

SEQ ID NO: 61590 - DNA, 601 bp, Human
acatcagtcattttagcctttctccagggactggcctctatagacctccgcattaattataatacaatggcagtcaaagatataatggaaaaatattcaaatataaaaatatatatttttacaagtatatgtcttttgatacatctatccatccatctacataaagacctatagatccatctatctaactttctatcttacacttatatatatgctgctatagccagctgctgagaaacacagaattggaaactgtatttattaagttggtctgtcatttgatgtcttgatgctttttgtratacattatatgagcttagtgaaaattacgtttcttagctccttccataaatatacaaatactctatgttttctacatttcattgttagttggtacttttaaagtatcagtgataagttggtcttaatgacatttgtaaataggttatgtagcatgcatccttcaggaagagctatgaaacaggcagattgccttgaatacttctgcagtcctagtctattttcttgtcactcagaagtgttcctgtacatcccctgcccttacgtacttctctggcctttataaaaagtccccacaaat

SEQ ID NO: 61591 - DNA, 601 bp, Human
acattatatgagcttagtgaaaattacgtttcttagctccttccataaatatacaaatactctatgttttctacatttcattgttagttggtacttttaaagtatcagtgataagttggtcttaatgacatttgtaaataggttatgtagcatgcatccttcaggaagagctatgaaacaggcagattgccttgaatacttctgcagtcctagtctattttcttgtcactcagaagtgttcctgtacatcccctgcccttacgtacttctctggcctttataaaaagtccccacaaatccytttttaaagcacgatgagagcaaattatagggttagtcttccaaaggatagttgcatttttataagaacgaacacgataaagccttatagtgaaattccgtgtatcagatggacaatcattacagtctagggcatgggcgtccttgtgactgttgacgtcatgtcattcaggtggtcatttaccctgttggagaaaatgtgatcatgaagcatagaatattttatttagtattagtgtatgaagggggcatgtgtttactctattaataacaaataaatcttcatttgaaaatcagccaa

SEQ ID NO: 61592 - DNA, 601 bp, Human
tcagttagcaaacatttaaggagtattttttagttgcacactcagcaatgaagaaaaacattcaattttgaatcacaaagtaattttgttatctttataacaatgatttcagtattacatgtgagtggtgtcctaaacacatagtatgtttatcactagagtaaaactttagtaagtttacacagatatatctgaataataatacaatatacaaaatttacataaaacatataaccttgccttttggttagaattataagataatgcaactataaaaatatctcagataagcagcaaaacygataaaataatttcccattgcttttgaagaaaacatatattcttttctttttaaggccaactcaataatttcatagtctccaaatgattatttcacattaggaactataatatagaagtgatattataatcattgtccaaacaccatctatcataaaataaaaccaaaaaagatccgtcgttgggtccaccagtgtgtcttaggaaataaattactttttttgaaaagaacttcaacactttctattttcttgatttattagaaaagttttttttttttttccagaaacctttcaaacag

SEQ ID NO: 61593 - DNA, 601 bp, Human
tagaattataagataatgcaactataaaaatatctcagataagcagcaaaactgataaaataatttcccattgcttttgaagaaaacatatattcttttctttttaaggccaactcaataatttcatagtctccaaatgattatttcacattaggaactataatatagaagtgatattataatcattgtccaaacaccatctatcataaaataaaaccaaaaaagatccgtcgttgggtccaccagtgtgtcttaggaaataaattactttttttgaaaagaacttcaacactttctattktcttgatttattagaaaagttttttttttttttccagaaacctttcaaacagtgtttttcctctattctcacacctaccacacaacaatcatcaacacagaagacttctgtgaccaaatgcggagaggttttccccacataccaagcagcacacaccagctggtgtcctccaattcagttctaacactgtctatctggagagagtgttagatcccttcagttgagggctcagtccccaagactgccctctgcacagacaccaatcacaagtctgggcctctgaacttctgacctactggc

SEQ ID NO: 61594 - DNA, 601 bp, Human
cctcctctcacgttgtagaatggttttctctctctaggtttcacttacatttttgaaataaggtcagtgtcctttttgatttccagaagtagcaccatggctggagatcatgaattttgaagaacatggcttagctttctcagcctaagtgctaatgcaggagagtgggcctgaaaagttgtggtcaacagggctggtcaattttaatcagatgtgaactggggaagaggtgctgactcagagcccaggtagccacctcagtctatagctgcaggatgtccaggaagagcataaatatacyaggcatttgaacaatagtgaggggagagaaatatacagtataaatatactgtaggctagaatgtaagctccataaagacagaaacttttgttcactgctgtattcaagtgcctagaatatgaacacttcatgacatatgaaacatactcaagaaaacacccgtaaacatgtaaggctaccagagtgtgacattggctgaataagccactttcccccatcttttctccatgcctttctttttttattattaattcataactgtaccttaattggatattcaaataattacttgatgtatat

SEQ ID NO: 61595 - DNA, 601 bp, Human
ccttaattggatattcaaataattacttgatgtatatataccaaacatgttgcataaagctgagcagttgatggtgctgtataaataatgaggttactttaaggtaatgtttagaggaacctcctgaaaagtataccctctttgggtgctggagaaagtttttctgaactcatttcctgtaactgtccattttttacactgatgtgatattttgttgataaaatatagatgattattatgcttataaaataggtgtaatagttggttgatcagctatttaaataaataagttgatacagcrggacatccagatggatttgaaatacatgccatttgaaagcttattggctgtgctattttaaagtctcacatcataatataagaacccattatagaaaatagaaaatgtaatttgcctgatgtgttgattgacttagaggacatgtcttagaggaaacaccattaatttagagagtttgccttgaatatcagaagatatagtttctgggaagaggctatgagttttccaggatattttcaatattttcaatattttttcataatattatagatgatgcaatgtattttcttcttcaactgt

SEQ ID NO: 61596 - DNA, 601 bp, Human
ttacactgatgtgatattttgttgataaaatatagatgattattatgcttataaaataggtgtaatagttggttgatcagctatttaaataaataagttgatacagcgggacatccagatggatttgaaatacatgccatttgaaagcttattggctgtgctattttaaagtctcacatcataatataagaacccattatagaaaatagaaaatgtaatttgcctgatgtgttgattgacttagaggacatgtcttagaggaaacaccattaatttagagagtttgccttgaatatcagaagatatagtttctgggaagaggctatgagttttccaggatattttcaatattttcaatattttttcataatattatagatgatgcaatgtattttcttcttcaactgtatccctttggttccattctttctgtagagtggactcacatccttacaccttgcagcccaggaagataaagtgaatgttgctgatattctcaccaagcatggagctgatcaggatgctcatacaaaggtaaagcaaatcactctcagtattgtgacaggttctggctgggatgattcccagtagcccccattcg

SEQ ID NO: 61597 - DNA, 601 bp, Human
ggagctgatcaggatgctcatacaaaggtaaagcaaatcactctcagtattgtgacaggttctggctgggatgattcccagtagcccccattcgggtcaccccatgtccagggtcttccctcctcaagagtccattctgaaatataaactaatcataaccctctcctatgcacaaatctatggtggctccccattttttgctagaatcaagtccagtggatagcatgaggtcaggaccctttgcaggaagactccaattttgcagccttaagtctatcctctctcttactgctttagctarttcacatgacttgctgcgttcctcttctatttgctcatctccatgcccttggtctggaaatggattttccctctctatgccataaaattcttacccattctttaagcctgctgtagctacatgtttcctgcatctcctatcagagtcattctgtctttgctgttttcagatattatttatgcctctctcttagttctttgcagattttgtcacccacatctgatctctcttgctgatatgaagttccctgtggtcaggggcacatatataatctgctaaataatatctttagtcaaatgg

SEQ ID NO: 61598 - DNA, 601 bp, Human
ggatagcatgaggtcaggaccctttgcaggaagactccaattttgcagccttaagtctatcctctctcttactgctttagctagttcacatgacttgctgcgttcctcttctatttgctcatctccatgcccttggtctggaaatggattttccctctctatgccataaaattcttacccattctttaagcctgctgtagctacatgtttcctgcatctcctatcagagtcattctgtctttgctgttttcagatattatttatgcctctctcttagttctttgcagattttgtcacccayatctgatctctcttgctgatatgaagttccctgtggtcaggggcacatatataatctgctaaataatatctttagtcaaatggaatcctataataactgatactctacccagtccttctcctctggggtattaaccactagagtagtaaagtttctactttatctatttttaactttttattattatttacagcttggttacacacctttaattgtggcctgtcactatggaaatgtgaaaatggtcaactttcttctgaagcagggagcaaatgttaacgcaaaaaccaaggtaaagta

SEQ ID NO: 61599 - DNA, 601 bp, Human
ttcaattcctataagcaaaaaggttcagccatctggatgcttcactagtttaccaaagctacaagtgtatttttttcttcctttttagttctaaagtgattttgacgaggtgatgtagttttgtaattatttgagaattttcattctaataactttgacatccatgaaggttagcttcgaactacttctattataaagttaaagtagctgacatcgatttaacaacttactgcaggatacaatagatgccggctagaacatcttgatgttctggcagatttcctttacattgtttcagtgscttggcccccctcccctgaccccttctcctctcatgaagaaatacagacagtcagcctagactgcgtgcctttcatttttaatgaactctgtcacattcagaacatcacatggacatgctcagtgaggcaataatgtataaggcctgggctggaagttctcaaggataatgcagagctgacttgatcccagcagtttccccagtggcatttgaaaggtcctattcagcaaagcaaggttggaacataacactttacttcgtgcactcaatgtggttcaaggtgaatagaagttcatattg

SEQ ID NO: 61600 - DNA, 601 bp, Human
ccaaagctacaagtgtatttttttcttcctttttagttctaaagtgattttgacgaggtgatgtagttttgtaattatttgagaattttcattctaataactttgacatccatgaaggttagcttcgaactacttctattataaagttaaagtagctgacatcgatttaacaacttactgcaggatacaatagatgccggctagaacatcttgatgttctggcagatttcctttacattgtttcagtggcttggcccccctcccctgaccccttctcctctcatgaagaaatacagacagkcagcctagactgcgtgcctttcatttttaatgaactctgtcacattcagaacatcacatggacatgctcagtgaggcaataatgtataaggcctgggctggaagttctcaaggataatgcagagctgacttgatcccagcagtttccccagtggcatttgaaaggtcctattcagcaaagcaaggttggaacataacactttacttcgtgcactcaatgtggttcaaggtgaatagaagttcatattgtaactgtggctattatgcatactataacttgcagctccaagttctttgatcc

SEQ ID NO: 61601 - DNA, 601 bp, Human
ctataacttgcagctccaagttctttgatccaaagaaatatttgtttgcacatttatttaagttcatatatcagaaatttctttttcttttttttttttttttttaagacagggtcttactctgttgcccaggctggaaagcaatggcacgatcagagctcactgcagtctagaacctgggctcaagtcattctcttgcctcaggactggctaggactataggtgcatgacaccatgcccggctaatttttaaaagtttttgtagagatgaggtttcactgtgttgcctaggctggtctcraactcctgggctcaagcgaaattctcccaccttggccaaccaaagtgctgggattacaagtgtgagccaccaagcctggcccagaaatttctgactgcagctatttgaatgggctcaagtaaattagtgtgagcacattcaggacttttcaaagccatcattcaagattctataaattaaaaatatacagaagttttataagtcagtctttatattctcttagaagcagaaacaaaatcatttctatacataagcatgtttatagctaatttaaaataaacttatttttaaactataaat

SEQ ID NO: 61602 - DNA, 601 bp, Human
atcctcactggggatttcaggtaaaggttagattaaatcagggctggggaacatttttgtggccacaatgtccactgatctattgagggcaagaacgttgctttggcattattaatttacatatatttatagataatttaggtttgtttatatattatagtgatatattattttattaatttacatgctaagttatttagcacatagtgtgtgattagtaaatgcttgttgaatgaattaacttggctgatactgaaaagatgaactaaattcaatggatttaatggatgtaaacacaacraaaaggaagaatttttacaaaaagaagtatcgcttagtgtattctcctcaaatgtccatggattatctgatttgaccgcagagtccctgtaatagccaaaggcttcttggagtccctgtaattgatttatattttcaggtttcctggggtcatcccattgtagggatttataaggagatgtaagacttccaacatgacagagttgaggatgtgccacacttagagacacttaggtaaccctgatacatgtgggcatgttcctatgggcagacagagtgcagtgaatttataaagaaatca

SEQ ID NO: 61603 - DNA, 601 bp, Human
gagtgcagtgaatttataaagaaatcatgtagcacccacatctatagtagacagaacaagcaaatatgtatgttgctcacagggcagcagtgacattggatgaaaggggtatgtacacttaaaagcttagagtatgaaagggccactcagaacttagagcccaggacaactgggtctgaaacatatagataaaattttatgagaagtgaagcaggtggattttaataaataatagccattgtctggtagccattggctgtcatagtcttctgcacaggatctgaacctcgcccgattgtgragaaattacttaactttcttattttcagtttcatcacgtctgaaatggggagaaaagctgttcttggaaaggaatataagatttagatttactttcaatgatttagaatccctaaagctaagccaaaggttaattattaggagagtcatgatgaacaagcagtggtttatatgaccctctgcaaccttcagttaaaaacaattttaactcttgtttcccagggaagaaatcacagataatgctgttttcttattttaaatctctcttctcagctcagatgtgagcagaagtcgactgcac

SEQ ID NO: 61604 - DNA, 601 bp, Human
gcctttagtggcaagattggccaagcacacctgttctgccattagaagtcatgttttctctcaactttttaccttttccctgctctgggaataatgtatgtttattttaccaagttatcactagatggcaagcttgtatctcttgctatcttgtacctactttgcttccattcatttcattaactgatttattccttcattatttattggatataaaatatgtgctaagttctgtgctaagtgctgaagaattatcagtggtgaaaacattactcctccccaccagcaacttcagtgtcaygagagtagagaatgagactcaggcttggtaagaaaatacattcatattttactcaacaaaactatggaacttatatgtctggtttcaaagagatctcaggtttgtagatattactcaggtgaatgacttcaaacaaagatctatatttaaaaagaagagcaaataagcattctctggtttgtctctaaatactgtaattgctgtctcagtgtccttgtcagaaatcagatacaagatcatctctctaccacatctatctctggaaaagatgggatgaaaattccttttagaaccccctct

SEQ ID NO: 61605 - DNA, 601 bp, Human
aggatctcacgctgttgcccaggctgaagtgtagtggtactatcacggttcactgcagctcaggtgatcctcccatcttagcttccagagtaacagggactactcgggagtagtaggtgggcaggtgccaccactcctggctaatttttgtattgttttgtagagacggggttttgccacgttgtccaggctcgtctcaaacgatccacctgccttggcctcccaaaatgctaggattacagtcctgagcccctgctgtgtattttcttaaaaagacatacttagtgcagaatctttttaracttttgacatgttttttcaacctgttataattgtctcaattacatctaattgggtattactttcagtgactcacctttgttaggacttcaaaaaacatctaccctagtttttctagaaaaaaaacagtatttacataatatttaatttagttattaaagttatattaatatgtatgattggtataagtatgtttagaaacaaaaacaagtttagcttgaactccactgatggaagctatggatgagggccttaaaaggtggcatcataaccaagatcactaagtatgctgtggtggctt

SEQ ID NO: 61606 - DNA, 601 bp, Human
atgctgtggtggcttagggattatgtgatataaatgcaattggtgaccaggaggattggctgagtgagggttggctaagtgaagatcagttaaacacacagtttcttttgcatagaacaaatcagatattgactactatttgtaaagcagaatgttaagaactcctactttattttctacatttttcatatcgtgattaacaatataaattcattattaaatctctcttccatctattatataccatttcttttgccatattatccgatttaattatatcccattaaacttgtacttagtrtcctactcattttaacttttaaagtagtttctaatcttgaccatagtatcttggattctgtagcagaaagagatgtccatgatcatttcactatagccttgttctctatgtacgattcagaggtagttgcataaaaccatgtttatgtttaaataatcaagttttcaaaggacattttgtttaaaaggaaaatatgtattcatttcttgttacattatacatatgtaggactacttattttccatccattcaacaaatatttaatgatggccttctaaaggtcaaataccttctcatgta

SEQ ID NO: 61607 - DNA, 601 bp, Human
ttgtaaagcagaatgttaagaactcctactttattttctacatttttcatatcgtgattaacaatataaattcattattaaatctctcttccatctattatataccatttcttttgccatattatccgatttaattatatcccattaaacttgtacttagtgtcctactcattttaacttttaaagtagtttctaatcttgaccatagtatcttggattctgtagcagaaagagatgtccatgatcatttcactatagccttgttctctatgtacgattcagaggtagttgcataaaaccrtgtttatgtttaaataatcaagttttcaaaggacattttgtttaaaaggaaaatatgtattcatttcttgttacattatacatatgtaggactacttattttccatccattcaacaaatatttaatgatggccttctaaaggtcaaataccttctcatgtataaatgatattatatttaccacattgcatatagaggccatttttaatatctatacagaaaaatatccatgaccaatatgatcacagtgtattactttttctgttgccacatatatttgctgataattctgatagcattc

SEQ ID NO: 61608 - DNA, 601 bp, Human
taaaaagtatctccagtaattattttcaaacagagaatcatctccttattgaaatgtttactacgaaggacaaatactctaaaacatttctgcaaaaattaactttctaatacagtctaatatagtagacatcctttcacatttttaaatattcccaaaaagttgaataaaggtcagccgcggtagctcacatctgtaataccagcactttgggaggccgaggtaggtggatcacctgacgtcaagtgttcgagaccagccaggccaacatggtgaagccccatctctactacaaatacamaaatgagccaggcgtgctggtgcacacctgtaatcccagctatttgggaggctgaggcaggagaatggcttgaacctggaaggcggaggttgcagtgagctgagatcgtgccattgcactccagcctgggcaacaagagtgaaacgacatctcaaaaaaaaaaaaaaaaaagttgaataagatttcatagtagggtagtctctatgttatattttaaatgcaaatcattttcctgcaatttatatactttccctaatacaggaaaatgaatctcaaattgagctgtgcaataaacccacc

SEQ ID NO: 61609 - DNA, 601 bp, Human
aaaacatttctgcaaaaattaactttctaatacagtctaatatagtagacatcctttcacatttttaaatattcccaaaaagttgaataaaggtcagccgcggtagctcacatctgtaataccagcactttgggaggccgaggtaggtggatcacctgacgtcaagtgttcgagaccagccaggccaacatggtgaagccccatctctactacaaatacacaaatgagccaggcgtgctggtgcacacctgtaatcccagctatttgggaggctgaggcaggagaatggcttgaacctggraggcggaggttgcagtgagctgagatcgtgccattgcactccagcctgggcaacaagagtgaaacgacatctcaaaaaaaaaaaaaaaaaagttgaataagatttcatagtagggtagtctctatgttatattttaaatgcaaatcattttcctgcaatttatatactttccctaatacaggaaaatgaatctcaaattgagctgtgcaataaacccacctaaggaacctttaaaaaataccctggtccccattatagctgggcccgatccctatggattttgatttaattggtctatga

SEQ ID NO: 61610 - DNA, 601 bp, Human
ggtcagccgcggtagctcacatctgtaataccagcactttgggaggccgaggtaggtggatcacctgacgtcaagtgttcgagaccagccaggccaacatggtgaagccccatctctactacaaatacacaaatgagccaggcgtgctggtgcacacctgtaatcccagctatttgggaggctgaggcaggagaatggcttgaacctggaaggcggaggttgcagtgagctgagatcgtgccattgcactccagcctgggcaacaagagtgaaacgacatctcaaaaaaaaaaaaaaaaaagttgaataagatttcatagtagggtagtctctatgttatattttaaatgcaaatcattttcctgcaatttatatactttccctaatacaggaaaatgaatctcaaattgagctgtgcaataaacccacctaaggaacctttaaaaaataccctggtccccattatagctgggcccgatccctatggattttgatttaattggtctatgatgggacccaagcaacaatattttttaaatgtttctaataattgtaatatgtagctatagttgaataccactaatacagaatatgggctata

SEQ ID NO: 61611 - DNA, 601 bp, Human
attttgatttaattggtctatgatgggacccaagcaacaatattttttaaatgtttctaataattgtaatatgtagctatagttgaataccactaatacagaatatgggctataatttattggtgttaaatttctaaattaaaatttataatattaaaataataatcaaattgtatattataatagtctttttgagtttgttcattcaacaaatatttatcaaccactactattctccagatttttggatggatacttttgtttttcctgcagcatttagtttgctttcagtgaataagaytctgaataaaactatttaaatatcactagaaatatgcaggcaagctgaatttacaacccttgcctccaactgtgccttcatgtgagtagcaggagactttctttactttctctgtttcttcctgtcttttaactaaaattccacccaaagacaatccatttcatcattatggattttaaatttattttttgcataatttagtattaacaagtttttgatatatatttgaaaagctcctgctatgtttcaggtgctgtggaaacaatcttcctcttaaatgactcacactctcatgtgggc

SEQ ID NO: 61612 - DNA, 601 bp, Human
tatttatggtatacaacatgatgttttgatacacacacacacacacacacacacacacacacacattgtgaaatggctaaatcaagcttattaacatatctattacctccacatacatatccttttttttgtgatgagcgcacttaaaatctactctcagcaattttcaagtatatactacattgttattaactgtagtctccatgttttacaataaatctcttgaatttatttctcctgtccaactaaaattttgtatcttttaaccaacatctcccaaatgctcctcccccttccttcyccaacacctggtcaccaccaggtgtctattctgtgcttctgtgagttttttagattccacatataagtgagattatgcagtatttgtctctatgtctggcttatttctattattctgaaaaatcactggtatgtcttgtgtctaaaatagtgccaagcatgcagtagacattcagaattttccttgagtgcaagaatgattataaaaagtccagaggctcttcacttttaagatgcatttaatactgagttacaataatcataataaattatggtagctaatatttatggagtgccaaca

SEQ ID NO: 61613 - DNA, 601 bp, Human
atatttagtataattttgtgttctatcttaatacttgccaactagttctcagcattcctatatgcatatcatattttgttttgtgggatcatctttattatctttacttgtatgttgaacagctcttaaacagtttggtgaccactttattgatggggaggcacttagtgattcaggtacccttagaggatatttttggagtgaaagcttttctttgcttttgatttttcttaactggatagaacaacttgtttaaatctgtgtgcctaatactaatctgtttcttttgaaatagcatgtrtaatatgagtggaattgtatatgtgtgcatttgagtgtgtggattttattaacttagaagcctaaagtcatgaattgtttgtactgttaatgattttgcaactattattgagaactgctaacataattatataatctaatgaacattatataaatatttttccacaactattatcttttcttagaatataaatttagagaaaagtaattcttttgttagttgacattgagctagtgtgaacatgacaataactaagttagaccacttgaaattaatgcagtttatatcactcccttggtt

SEQ ID NO: 61614 - DNA, 601 bp, Human
taatctgtttcttttgaaatagcatgtgtaatatgagtggaattgtatatgtgtgcatttgagtgtgtggattttattaacttagaagcctaaagtcatgaattgtttgtactgttaatgattttgcaactattattgagaactgctaacataattatataatctaatgaacattatataaatatttttccacaactattatcttttcttagaatataaatttagagaaaagtaattcttttgttagttgacattgagctagtgtgaacatgacaataactaagttagaccacttgaaatkaatgcagtttatatcactcccttggttgatgatatattttaggtgtgattaaaaatatattaatagttatgtgatttttaatatagctaagaatagaaataaagtaacatttaaaaattatttagggtgaattttgcatataaggaaaaatgagtaatgtaagatattttatctagtaagaggtttccaaagtacacgtggtaccactttaagcaactctattacatgaaaatttaaatttataaatcagataaattgaatagtgattatttaatttaaaaatagccctttatttacaaa

SEQ ID NO: 61615 - DNA, 601 bp, Human
aaatagccaaaacttaatgatatttctttccccgaggaaaattcaagttgaataattttcatgtaaaggatctatttgagtattgataagtaactttttcatggaaaaaattagtgtgaaggaaattagctggttgacattgccaatgccaacactttaatgttttgtgaggttaatatgtttttatgaaacctgctatcatccacgtggacacaatgcagccacatgtatttgaaaattattagctaatccctgttttctctacagtctattgttttattagtagtaatagtgtattgayacccaaaaagagtattcaaactcttgtcattaagaatggcactatgtttaatactaatagcttttaaggagaaatattaaggatgtttctttaggttcttcaagataaaatcataaggtaagactttacattgagatgtccttacattgagatatcctatcaggctaatttgctgtatacacattaaagtaatccataatatccactcatgaatccaattaacaaataatgaatatgatgttattgtgtttcggaaagctctataactgatgccacagtggtcaaaggtgagcatgaggc

SEQ ID NO: 61616 - DNA, 601 bp, Human
gcacagccatgatataaataacatccttatggaggaatatggcagcgaaatgcaaggaaaagacagaaatgggaattcagtctaacagaattatagcatccagatttaaccaaagatgtgaaggtaatcgtctaagtctttgtaggatcgtgagttgatccctgtcttcgctgacttggcttcccagccataaatgatgaggtggggctcagagattttggcatctgtataaccaaaatgcccataggaatgtgactcatgtatgccttattctcatggattcttgagtgggtggcttgtscatatatctctgctagtactctggaatgatgtatactagtaatcaagagaactccagactggctgaatgttgggatgaaatatagaggcgcctcctcctttgaaacactcacttctgttgtgaacacttaacacttagtggggctcttcatctcaggttttagccctttttccatgtctcagcaggaataatgcttgcttgagagggagtgggttccgtaacgtttcagagaatctccttgtcagcatcatgaggggttgtcaggaaggggagccattccaccttttttttttttttttt

SEQ ID NO: 61617 - DNA, 601 bp, Human
tgacttggcttcccagccataaatgatgaggtggggctcagagattttggcatctgtataaccaaaatgcccataggaatgtgactcatgtatgccttattctcatggattcttgagtgggtggcttgtccatatatctctgctagtactctggaatgatgtatactagtaatcaagagaactccagactggctgaatgttgggatgaaatatagaggcgcctcctcctttgaaacactcacttctgttgtgaacacttaacacttagtggggctcttcatctcaggttttagccctttttccatgtctcagcaggaataatgcttgcttgagagggagtgggttccgtaacgtttcagagaatctccttgtcagcatcatgaggggttgtcaggaaggggagccattccacctttttttttttttttttttttgtgatggagtctcactctgtcgcccaggctggagtgcagtggtgtgatcttagctcactgcaacctccatctcccgggttctcctgcctttagctcccagagtagctgtgactacaggtgtatgccaccatgctaatttttgtatttttagtagagactggttttca

SEQ ID NO: 61618 - DNA, 601 bp, Human
aatgatgtatactagtaatcaagagaactccagactggctgaatgttgggatgaaatatagaggcgcctcctcctttgaaacactcacttctgttgtgaacacttaacacttagtggggctcttcatctcaggttttagccctttttccatgtctcagcaggaataatgcttgcttgagagggagtgggttccgtaacgtttcagagaatctccttgtcagcatcatgaggggttgtcaggaaggggagccattccacctttttttttttttttttttttgtgatggagtctcactctgtygcccaggctggagtgcagtggtgtgatcttagctcactgcaacctccatctcccgggttctcctgcctttagctcccagagtagctgtgactacaggtgtatgccaccatgctaatttttgtatttttagtagagactggttttcaccattttggccaggctgctctcgaactcctgacctcagggaattcaccttacttggcctgccaaagtgctgggattacaggcgtgagtcaccacgcccggccgccgttccactttaagttattcccatgctattgtcacccgtgtcctacaggg

SEQ ID NO: 61619 - DNA, 601 bp, Human
aaaactaaaggttgcttttagtttggttttgttttcacattgaataagtaagttgaaaaaaagaaagtgtataatgattctcttaaagctgtctgagttgtacaaaattctttccaagtctaatggcactctattcaaacaaataagagctaaagcttttaatctgaatattattttaaatcatcttttctccccccttggcttgggcaaggaagtagtcgtgctatttgctcatgtagggaattttcaaagagaagcacattgacaaggggagaggtaaagaagatgagttctgctgtgsacatgctaaatctgagatgcttatagaaaatttaggtggagaagtccagaaggcaattggaatatagatgcaaaattcatgagagaggtctgggaccaatacagatctgtgtattgttagtggacctctaagtccatgtgataatatgtgaaataagaagaaaaggcagatggaaaatatcaacatttaagagaagtagagacagggaagaaagactcaaaaatatagggggaagaccaggagagatttgtgtcagagaaattaaggagaatagttttacaaagaagaaatcacttctca

SEQ ID NO: 61620 - DNA, 601 bp, Human
aaaaattcactttaagtagcactgaacctagcagcagccttaggcagatagcatcataacaaaaccatcaaaatgcacaaaataagggagaatgtaaaggacattcacttaggaactcagcgtaatcagaggtggtttttttgtttgtttgtttgcttgtttgttttttgtttttttgagacagggtcttactctgttgcccaggctgtagtgcagtggtgcgatcatggctcactgtagcctcgacttcctgggctcaagcgattctcccacttcagcctcccaagtagctgggaatacrggtgcatgacaccatgacctgctaatttgaaaaaaatttttagtagagatgaggtctaggtgttactcaggctggtttcaaacttctgagctcaagcaatcctcctgcctcggcctcccaaagtgctgggattacaggtgtgaaccactgtacctggccaatcagaagttttaaatttttgtcttgtcaccagagtcataaaattttgatatatttgattaaaaatatattcttcaaatgtctttctattttctaataagattctattcacacgagagaggaaggctgggttcctgtggt

SEQ ID NO: 61621 - DNA, 601 bp, Human
gaactcagcgtaatcagaggtggtttttttgtttgtttgtttgcttgtttgttttttgtttttttgagacagggtcttactctgttgcccaggctgtagtgcagtggtgcgatcatggctcactgtagcctcgacttcctgggctcaagcgattctcccacttcagcctcccaagtagctgggaatacaggtgcatgacaccatgacctgctaatttgaaaaaaatttttagtagagatgaggtctaggtgttactcaggctggtttcaaacttctgagctcaagcaatcctcctgcctcrgcctcccaaagtgctgggattacaggtgtgaaccactgtacctggccaatcagaagttttaaatttttgtcttgtcaccagagtcataaaattttgatatatttgattaaaaatatattcttcaaatgtctttctattttctaataagattctattcacacgagagaggaaggctgggttcctgtggttgatttgcatgttctacctgatcaaatgctgtgtcttgctccttcagatgtagagtcattccagccagactcttcttttatctttacctttctcaccttttctttcttcacc

SEQ ID NO: 61622 - DNA, 601 bp, Human
tgtggttgatttgcatgttctacctgatcaaatgctgtgtcttgctccttcagatgtagagtcattccagccagactcttcttttatctttacctttctcaccttttctttcttcacccttataaaccttcctcaccctaccaaggtgtaacaagagggaaagataaatgggagaaataagaaaatttgaaatgtaggacccattttattaaggagttttgtggatttttaaggaccaagaagttaaagcttattttgagttgtatttattccctgtgaccatcttggctgctgagagacmgcggtgagaactggcaaattaggagaagcaagatgaaatgcaaaagcaaacagactctgaggagggacaggatgctcgaacctaagtagtattcagaatttggtgctagaattttggggagtaggggtggggtagaagactgggggaaagaaagagtatataagcagacttttttttttttagatgagtctcactctgtcacccaggctggagtgcagtggtgcaatctcggctcactgcaaccttcatctcctgggttcaagcaattctcctgcctcagcctcccaagtagctgggact

SEQ ID NO: 61623 - DNA, 601 bp, Human
gtggttgatttgcatgttctacctgatcaaatgctgtgtcttgctccttcagatgtagagtcattccagccagactcttcttttatctttacctttctcaccttttctttcttcacccttataaaccttcctcaccctaccaaggtgtaacaagagggaaagataaatgggagaaataagaaaatttgaaatgtaggacccattttattaaggagttttgtggatttttaaggaccaagaagttaaagcttattttgagttgtatttattccctgtgaccatcttggctgctgagagacascggtgagaactggcaaattaggagaagcaagatgaaatgcaaaagcaaacagactctgaggagggacaggatgctcgaacctaagtagtattcagaatttggtgctagaattttggggagtaggggtggggtagaagactgggggaaagaaagagtatataagcagacttttttttttttagatgagtctcactctgtcacccaggctggagtgcagtggtgcaatctcggctcactgcaaccttcatctcctgggttcaagcaattctcctgcctcagcctcccaagtagctgggacta

SEQ ID NO: 61624 - DNA, 601 bp, Human
aaccttcatctcctgggttcaagcaattctcctgcctcagcctcccaagtagctgggactacaggcatgtgccaccacgcccagctaatttttgtatttttagtagagacagggtttcactatattggtcaggctggtcttgaactcctgacctcaggtgatccacctgcctcagcctcccaaagggttgggattacaggcatgagccactgcagccagccaacttttagtttttaaataatctttttggctttttgcaagggatccataatatgcagcttgcactgtgcttgtattatgwgacagattctgtattaaaccatccccttcaccttttcatgaataagaatagatgtagtctcctgaaatgttaataaaactcatatttttttctgaaagtaatgtaggcttaatcctaaagcagactatgcctgtgttttgataaatctataattagaattcatcttagaagttttttctcctagaagtaaacaacaagggatatccaaacttaatattaaaagaattaaaattcaagtgattacttcttcttggtaagtactaagaaaatgaatcaaatgttgtttctctaagttttagc

SEQ ID NO: 61625 - DNA, 601 bp, Human
tctgtgaataaagtatgttgtgaggctgaattaaaaagaaatacattcagaacaaaactgcctggaactgactttttcatgaaaaagaatccgaacagaatcccacgagagcctggatacaagaaacaatcggagcaaaatctgagggagcccagtgttaataggcaaatctgggaggtttatataatattctgagatatatgatcagtgctactttttgttattattaactagtacaactggcacttgttatttttttatgcaagttaggtaatgacattctgtggttcctcattgaaaktatgactgataagttgggccatgaatatggatgtcatagctgggtgcagtggctgggtgctgagacctgtagtctcagctacttgggaggctgagttggaggatcccttgagccccagaattcaagtccaggctgggcaacatagcaagacactgtctcttgagacagaaaaaaaaaaaaagaaaagaaaagaaagtttgtccacgtagtgtaatgtgttctgctaatcaataatctcaggtttatagttttaaagttggcactattgtaagctattttatgaatatccagcatagagtc

SEQ ID NO: 61626 - DNA, 601 bp, Human
ctgcctggaactgactttttcatgaaaaagaatccgaacagaatcccacgagagcctggatacaagaaacaatcggagcaaaatctgagggagcccagtgttaataggcaaatctgggaggtttatataatattctgagatatatgatcagtgctactttttgttattattaactagtacaactggcacttgttatttttttatgcaagttaggtaatgacattctgtggttcctcattgaaattatgactgataagttgggccatgaatatggatgtcatagctgggtgcagtggctggrtgctgagacctgtagtctcagctacttgggaggctgagttggaggatcccttgagccccagaattcaagtccaggctgggcaacatagcaagacactgtctcttgagacagaaaaaaaaaaaaagaaaagaaaagaaagtttgtccacgtagtgtaatgtgttctgctaatcaataatctcaggtttatagttttaaagttggcactattgtaagctattttatgaatatccagcatagagtctaagaaataaataccttaaagtctaagtgaataattagcaaaaacaaacttttcttg

SEQ ID NO: 61627 - DNA, 601 bp, Human
cctggaactgactttttcatgaaaaagaatccgaacagaatcccacgagagcctggatacaagaaacaatcggagcaaaatctgagggagcccagtgttaataggcaaatctgggaggtttatataatattctgagatatatgatcagtgctactttttgttattattaactagtacaactggcacttgttatttttttatgcaagttaggtaatgacattctgtggttcctcattgaaattatgactgataagttgggccatgaatatggatgtcatagctgggtgcagtggctgggtgctgagacctgtagtctcagctacttgggaggctgagttggaggatcccttgagccccagaattcaagtccaggctgggcaacatagcaagacactgtctcttgagacagaaaaaaaaaaaaagaaaagaaaagaaagtttgtccacgtagtgtaatgtgttctgctaatcaataatctcaggtttatagttttaaagttggcactattgtaagctattttatgaatatccagcatagagtctaagaaataaataccttaaagtctaagtgaataattagcaaaaacaaacttttcttgggc

SEQ ID NO: 61628 - DNA, 601 bp, Human
tataatattctgagatatatgatcagtgctactttttgttattattaactagtacaactggcacttgttatttttttatgcaagttaggtaatgacattctgtggttcctcattgaaattatgactgataagttgggccatgaatatggatgtcatagctgggtgcagtggctgggtgctgagacctgtagtctcagctacttgggaggctgagttggaggatcccttgagccccagaattcaagtccaggctgggcaacatagcaagacactgtctcttgagacagaaaaaaaaaaaaaraaaagaaaagaaagtttgtccacgtagtgtaatgtgttctgctaatcaataatctcaggtttatagttttaaagttggcactattgtaagctattttatgaatatccagcatagagtctaagaaataaataccttaaagtctaagtgaataattagcaaaaacaaacttttcttgggctttttccttgagcaccaatgcccccttccactatctttttttttttctttagcaagataggcttgttaacttcatagtctaatgggatgggagagggcataagctagtggtacacatagagt

SEQ ID NO: 61629 - DNA, 601 bp, Human
ttggaatagtccatctttatttcatttaagtagattatacgacatcatttttaaaaaagcagttagaaatgatacacattgattaaacaaccaattagtatttcagaaggcagtaagtaagtagaggaggctagaatacaacccatagaaaggtagagacactcctatatatggttttgattattcattgttgctccctctctctgtccaacttttctcactctctgtgtacatatcctaatatctttctctctctaatcaattttttgtgattatatatcactttgtctccttctttctyttcttatccctctgtatttctttcctgttggggttttaggaaagacaaaaaacaccaacacctctctattcctctcagtacaaaaccaattgagagatagactcaggtatcaactaaatggatatcaaaatttcacttgtatgactgatataccgattgcaaagtgcgactttactttcatagcccaatgggctctttaataccacattcctgaaatagacagacttgtctacttagccatagtcactccttgagagtggcaattgagacctgattgattctttcaaagtttagaccttt

SEQ ID NO: 61630 - DNA, 601 bp, Human
atcaaaatttcacttgtatgactgatataccgattgcaaagtgcgactttactttcatagcccaatgggctctttaataccacattcctgaaatagacagacttgtctacttagccatagtcactccttgagagtggcaattgagacctgattgattctttcaaagtttagacctttgcaatctggcagccacgtcacaaggttttatttgaggtaccattatttaccattcagtttgttctcattcaagctaaattttcattttccctttgagaccggtgtttctgctattccagaagayggttgagcccatagaacagctgtattagaaacagaagaggttggctcctctactattttcccttccttagccaaattcaaaacaaaataaaggtgaatagaatttaagagttgctgatctagcccgggcatagtggctcacgcctgtaatcccagcactttgggaggccaaggtgggcggatcacgaggtcaggagatcgagaccatcctggctaacacggtgaaaccctgtctctactaaaaatacaaaaaaattagccaggcgtggtggcaggcgcctgtagtcccagctactcggga

SEQ ID NO: 61631 - DNA, 601 bp, Human
atctgttctgctcaatacacacagcaaatacctggcaaaagaaagactaacatttgctgtttattttaaagtgttgtcttcagattcacaatgactctaatcaacagttatttctagcatcctagtcatgatcataacaacataatcttgggcaagaattttaattttacaattcttcttcatttcataagtgcataaggaattagaagatgtaagacacaactcttagcagtagctagctttgtaagtcttcttaaatattgttattaaaggtctttagtttttgtagtgttttaattayagtcaaatgccaacaattaaatgtcaattcattaaaatgtcctacacagtcatacattaactggaggtctgtaaggttgtcttttaaagaacttcttttcataaaaacatgttgaaggcaattttgttgtttacctaaaatttctccaaaaataaagtctattttaaaaatcatcttgaaggtattctctcaaataacgggatatttgaaatgcaaggaagtcaaggctctcacttgacaatattaatgtttatctaatatgtacggcagttaagttagttattcatgtatttcacaaca

SEQ ID NO: 61632 - DNA, 601 bp, Human
ataaaaacatgttgaaggcaattttgttgtttacctaaaatttctccaaaaataaagtctattttaaaaatcatcttgaaggtattctctcaaataacgggatatttgaaatgcaaggaagtcaaggctctcacttgacaatattaatgtttatctaatatgtacggcagttaagttagttattcatgtatttcacaacagcctagggttttttttagatacgtgaaggtaaattcttttagatgaggaaagttttttcataataagtagcaaaacaagtgtttagtaaggttggatttcyggtccattaagcatgtatacttttgtatgtcattagggttgaaaacacaagagaatcttgtgaaagcttatggagggttttacggaagagcagactcataggtagaagaagagtgaaaggtagaactataatgtgggattagacattatgaccactgaggaagacagcaatctccaaagcaggaaatgaagtattgacaaaagcaccaagactttgtttgcatagcttttttttgcgatactctagtaggtaattgatattacctaccccgctttatagtttatgctactgtttgttgtt

SEQ ID NO: 61633 - DNA, 601 bp, Human
ttagagtctatttagtataagtctcccattttatggataagaaaactgaaatctaaagatgttaagtgacttacctgaggttacaacattaattcaagatagagatataactagacccagggaagagcatggtacttgctgcattctcctgtgctgtgtgataatagtatttttatatcttatttaagtaaacttcataaactaataaaaacttcatcatcattttaaactacttagcatagttccaggttcattgtaggtactcaataaaggttagtttctccatttatttttcaagtgrtatattgtattgtgtttaagatatttaaaatatgtaaaatcccgtaagtgtagagaaaggaagatgatgggaacaagcatttattgaattccgtatgctttacccacacaagatttctcactgtaaccttaagtggtaacaggattatttttcattgccaggtgaggcttcaatcttaaagatcatagatgacaggcagagccatcaatccatattactgcctcctctaaacatatttaattatatgtttttacttaagttattttcatctccaaatgtttatggggattatcttgtccc

SEQ ID NO: 61634 - DNA, 601 bp, Human
tgcttgagcctaggagttcaaaaccagcctgagcaacatagggagaccccatctctgaaaacaaacaaacaaacattagccaggtgcaatgatgctgcctgtattcccagctacttgggaggctaacatgggaggatcacttgagccccgaaggtcaaggttacggtgtgctatgatagcaccactacactccagcctgggtaatagagtaagaccctctctcaaggaaaaaaaaattgttttttctctgaattatgcatactggcacctgaatttttccaatttgctttggatttttgtrcaatacttaaatattactttccaggtttacaatgacacagagatacttataggtaaatttatctgcttgcagcttcaggctttaaagtgctattattttgattttcccatctttggtctttcttcatataattttaacttctattaaaatggtttattttgttaaattcaaacttctggtttttgcttactctcattttctactagtcctctatcaaaggaaatcaatgtattaggtctctctatatacattagagcaggaataagcctgtaggagaatatttaacattcaggagagtcg

SEQ ID NO: 61635 - DNA, 601 bp, Human
atctttggtctttcttcatataattttaacttctattaaaatggtttattttgttaaattcaaacttctggtttttgcttactctcattttctactagtcctctatcaaaggaaatcaatgtattaggtctctctatatacattagagcaggaataagcctgtaggagaatatttaacattcaggagagtcgttcccaactgctttcctacatctgaatatagtgattcgaatgaattctgactgctctgattgtccagagactaaagaattaaatttcctcctatgttagccttagacayaaatatatacagctcctcacgtcttgcccttttcactaggttgtacattcgcttattcaacagttatttattgactgcctgctaagtgctccatccacactgtgccaggctctagaggacacaggaagaaatatggagaacatgttcactgttattatggcacttttatggctcctatgtgtggacttagtcatttctcagtgaccaggaaagtaagcagttccaagtaatgacgaaaccatcatgtgacatctggggcttacaccatgtactttgtggcagcagctgctatgtctttac

SEQ ID NO: 61636 - DNA, 601 bp, Human
taattttaacttctattaaaatggtttattttgttaaattcaaacttctggtttttgcttactctcattttctactagtcctctatcaaaggaaatcaatgtattaggtctctctatatacattagagcaggaataagcctgtaggagaatatttaacattcaggagagtcgttcccaactgctttcctacatctgaatatagtgattcgaatgaattctgactgctctgattgtccagagactaaagaattaaatttcctcctatgttagccttagacacaaatatatacagctcctcaygtcttgcccttttcactaggttgtacattcgcttattcaacagttatttattgactgcctgctaagtgctccatccacactgtgccaggctctagaggacacaggaagaaatatggagaacatgttcactgttattatggcacttttatggctcctatgtgtggacttagtcatttctcagtgaccaggaaagtaagcagttccaagtaatgacgaaaccatcatgtgacatctggggcttacaccatgtactttgtggcagcagctgctatgtctttactttctgtatcctcagttctt

SEQ ID NO: 61637 - DNA, 601 bp, Human
aagtgttaccagtattttcattcttttgagcaacaaatagttcatttaaaagtcaaataaaaaaaattttaaagaattcatactggaagactagtaataagaaaagtggcaaatattttctcattatgttttggtaaagaccagaaacatcaacacttcagtactgaactgttgattgtacttcccagtttttactccttcctgaaaactttaagcgggctaggtatgaatggaaggtctagcctggcccctgcatgtgggaaggcctgtgctgcctcttgtggtctcatcctgcatgacrtgcttcagacaggcactctgggctccttcgcacccatttttattactagcaacaggatttctgtttaatagcatgtttaatgagttctgtgttccgctttgaagaagatgctaagatatttttcttcatttatctaaaaataacataaatgttttgtgtttatatcccataacttactttgataaaatacctttcaaatgttttaaatgtcgtggaggcaatatctaggtgggacaaatccagttggttctgtgctgagcagattataagcagagacatgatacacctgtatgttgcttt

SEQ ID NO: 61638 - DNA, 601 bp, Human
atgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggtaagggtttctgataaacctcccacttagtcatcgatgagcttgtgtcctctacatgaaatcactaggatggaatggaaaaaggtacgtcaaaccattttgaaagaggatcagcaccaatgamatttttaaaattggaagtagcacctcaatgcttgactccacttacacgcctcttattttaaggcattaatgagttaaacattcaggttgaataccacttcttctttttggatgttaataatagctgccagacccccaatgtgaataaccagtattttagccgatggtaggtattattttctcatctgagaattaagtggtaaagtcacaaagaaaaaattctgctctgttccaagcataaatgtaaattctcatacagttatgaaacagaatcattatctttactttggaaagcaatgtt

SEQ ID NO: 61639 - DNA, 601 bp, Human
ggaagtagcacctcaatgcttgactccacttacacgcctcttattttaaggcattaatgagttaaacattcaggttgaataccacttcttctttttggatgttaataatagctgccagacccccaatgtgaataaccagtattttagccgatggtaggtattattttctcatctgagaattaagtggtaaagtcacaaagaaaaaattctgctctgttccaagcataaatgtaaattctcatacagttatgaaacagaatcattatctttactttggaaagcaatgttgcctttacagaawacctacaaatttaatcaatgtgatttttttttcagctatcaaaattgctaccttgagccttatcattacattggctatttagtcacagtttatattaagacaaatacatcaagactagcttccaccgtgctcgttttggcaattttgagcagaatttagcatttcttctttcttctgtttgtttgtacggctgctgttatattaagtggcatttcattgtgccaagaaatgaatagctacagctgaaattaacaaaaggatgaagttttggagggggacaagtttcaaaatattttgaaa

SEQ ID NO: 61640 - DNA, 601 bp, Human
gggctcaattagggccacactgtgtacacatgcctattgtttccttgaatgaagaaaatataagcaaaaaccacgagtgcatggctctttagttcacaagtagtcaactttctgacatctcctcatttacgacacatcaaattatgcaatgtgtgagccattttcctcttaaaccatttcgtcattttgcaccttgtcgaaaatgttttaggagattggcagacatcatagatatgcatgtacatttcttttggttaaatgtgttctacttacatttatcaaaggagaagttccagaatgycacatgcactcacagggaaacattatttggcttaaggtagcagcatgtacctgaggattggtgcccctgaggtggagtgctactgtgtgaccatctgctagccagtgggctccaggggatggcccactatgtccctgtccccagcaaaagaagaattccaggtcactttgcaacagagtcgaggtgcttgtcttgctgttagttagctcctgtccacactgaatgttctgcattgctatgtcaggcctgtgatcgtggagatccctcactttgcggcccttcgaggaaaggaaagggaac

SEQ ID NO: 61641 - DNA, 601 bp, Human
cttctacttcttggaaccattccttttgctgacatttaggtttaggatattttcctctgagatatttacctatcaatgacactgccagtgagcattggtatcttgcccttggatggggacccactctttaactttatttatttaaaaatgagctttttacatgggtattaatagaaagttaatagattaattaatctattactagaaagttaatagattaattaatctattactagaaagttaatagattaattaatctattactagaaagttaatagattaattaatctattactagaargttaatagattaattaatctattactagaaagttaatagattaattaatctattactagaaagttaatagattaattaatctattactagaaagttaatagattaattaatctattactagaaagttaatagattaattaatctattactagaaagttaatagattaattaatctattactagaaagttaatagattaattaatctattactagaaagttaaagatttgtgtatgtctggaaattttaaaaataaatataggctagtatttgccagtgcatcagtcttcaatcatgtgga

SEQ ID NO: 61642 - DNA, 601 bp, Human
ctagaaagttaatagattaattaatctattactagaaagttaatagattaattaatctattactagaaagttaaagatttgtgtatgtctggaaattttaaaaataaatataggctagtatttgccagtgcatcagtcttcaatcatgtggaatcagatcctgggactttttacttttactatctagctatgcccaataatcaagaaaaacgtagttgctgttcctgcctctataatgaattgtaaatgatttctaaaaatgaacaactttccatcacctcttaaaattcagtgatctatrtagtgcacattttctaaatttaaactagtttgattttttttgtattgccctgaatatctacactaatgcaatttataaagaacccatgatcccatcctcttgatgttaaatgttatttttggaaatttaatggcatcaggggaatattgaaaccctgaattcctaatcactgattttttaatatccacagtgagtacctcagacacaacccttccactggagtaaactcataaacatgactcttactcttccaagatagattttattcctgcattattcccctgaaaacccaaagggcta

SEQ ID NO: 61643 - DNA, 601 bp, Human
ggcacttctgttcattattaaccgagcgaatgagttggctagaatgctgttagaaggaaatctttgctatgtgaatgaaggtgggtcatttcttgtcttagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgygtaggcctgcaggtatgcccatgttagatgcaaatgatcctaacaggattgtattctaatgattaaaaattagctttgtcaaggactgttacctttgttttataatcacaccaaaaaggaaggtagcattaatggtaaagctaaagtcaaaatccatatttattggttactaatctatttaaaaattcaacttatatttggacaattaaccaaaattaatctccagctacaaatgttttcttcttgtaaaaaaaaaaaaagaaattagcttttaaatgagaaataaattgttaaagaatc

SEQ ID NO: 61644 - DNA, 601 bp, Human
aggccgtcttcccagagggggcactcaccaagcggatccgtgtaggcctgcaggtatgcccatgttagatgcaaatgatcctaacaggattgtattctaatgattaaaaattagctttgtcaaggactgttacctttgttttataatcacaccaaaaaggaaggtagcattaatggtaaagctaaagtcaaaatccatatttattggttactaatctatttaaaaattcaacttatatttggacaattaaccaaaattaatctccagctacaaatgttttcttcttgtaaaaaaaaaaaaagaaattagcttttaaatgagaaataaattgttaaagaatcagattattcctagtaagcaagagctgccatcagagatcgtggatcttacaaaattttatgagtgcttagtaataatactgaacttatgattgccatatttgaagcccaccaaacttatttgtaagataaaaaaatactttggggaagaaatttgaaattaagtataatgattcattctttattttaaaatatatacacaaatatatatgtgtgtgtttttactttgaaaaggctcaacctatgcacagtgagctggttaa

SEQ ID NO: 61645 - DNA, 601 bp, Human
aaccctgtgaggaaactttaaccccgtgttgctgagaaggaaaccatggttgaaagaagttctataacttgcactataaatatttggtggtgttgggattcaaaaccacacccatatgtctccaaagttcaggcttcaagccttcattgaagagatcactaaatctgctgggaaaaaaaatactgtcttgagtaattatacccaatagttcaaaccaaactgttatgttatggaattggttatgtctttatcattgatctattgaactaactttagaaaaacaacttaaaggttttcagtkattaactgatttttggtcttttcaattgtggttgtgtagtcgctttcagacagctaccaaactctccaaagacactcccagaacgttggtagtctcttcataacaatgccatcacaaatagtgagaggcaaaaaaattcacatgaataatctgttctagggctaaataatttaactgataatttctctatcaataattacatggtgttggtattcagtaaatattagtactattattagtaggaacagtaatcatccctggatgtttttgtattgttagaattattattttcatttctct

SEQ ID NO: 61646 - DNA, 601 bp, Human
cattttttggctaaacttttattgcacatcgagaggaacttttttgaaaacaatttcataaaatatgaagtttaagaacaaaagaatatttagattgttcacttttttttttttttttttttttttgagacggagtcttgctctgtcgcccaggctggagtgcagtggcacaatctcggctcactgcaagctccacctcctgggttcacgccattctcctgcctcagcctccctagtagctgggactacaggtgcccaccactatgcccggctaattttttgtatttttagtagagatggrgtttcaccgtgttagccaggatggtcttgatctcctgaccttgtgacccgcccacctcagcctcccaaagtgctgggattacaggcatgagtcaccgcgcccggccgattgttcactgttttaacaaactgttcagctccttaggtggtcaaaggatatttaaaaataatcagctgtatacaattcaaaattatcttcagagccttgcaattataataaaagcttcagaatgtcaggaagagaacagaaggcttaataaacacttattcaaataactaccctaaaacttagtttcttgag

SEQ ID NO: 61647 - DNA, 601 bp, Human
tcttgagtggtagtctgctgtttgttttcagtgtgtcattttttagcatgtagattttagtcattttgttttcaatgtgccattttgaggggtgggatttggcttgtgaacacagaaccacaaagactttattttagaatctagagtctggagttttgcctgatttttttcaacaatcatattatttcaggtggaaccacccctgcccagtgggaagatattacaggaactacgccattaacatttgtcaatgaatgtgtttcctttacaacaaacgtgtctgccaggtatcgttatatakcacagaaaagcccactatgatatgttaccctccaaaaaaactgccctttgttttattttgtttctttattgtttaaaagttattttttcattggattttaaatatggtctgcctttgcttttatattttaaactagatctgtcagcaagtggaatagtgataatacagtaacaaagtattaccaatccgattaaaatctaaggaaaaggagcgattgtctgctttgcctgtatgattctgacttagtcagtagcagctgctgctttttccacttccaaagtccttaggaatgataatttc

SEQ ID NO: 61648 - DNA, 601 bp, Human
catgtagattttagtcattttgttttcaatgtgccattttgaggggtgggatttggcttgtgaacacagaaccacaaagactttattttagaatctagagtctggagttttgcctgatttttttcaacaatcatattatttcaggtggaaccacccctgcccagtgggaagatattacaggaactacgccattaacatttgtcaatgaatgtgtttcctttacaacaaacgtgtctgccaggtatcgttatatagcacagaaaagcccactatgatatgttaccctccaaaaaaactgccytttgttttattttgtttctttattgtttaaaagttattttttcattggattttaaatatggtctgcctttgcttttatattttaaactagatctgtcagcaagtggaatagtgataatacagtaacaaagtattaccaatccgattaaaatctaaggaaaaggagcgattgtctgctttgcctgtatgattctgacttagtcagtagcagctgctgctttttccacttccaaagtccttaggaatgataatttcctgttgtcagcaaaatagcctgaactacttttccaacagaatgata

SEQ ID NO: 61649 - DNA, 601 bp, Human
ggagttttgcctgatttttttcaacaatcatattatttcaggtggaaccacccctgcccagtgggaagatattacaggaactacgccattaacatttgtcaatgaatgtgtttcctttacaacaaacgtgtctgccaggtatcgttatatagcacagaaaagcccactatgatatgttaccctccaaaaaaactgccctttgttttattttgtttctttattgtttaaaagttattttttcattggattttaaatatggtctgcctttgcttttatattttaaactagatctgtcagcaartggaatagtgataatacagtaacaaagtattaccaatccgattaaaatctaaggaaaaggagcgattgtctgctttgcctgtatgattctgacttagtcagtagcagctgctgctttttccacttccaaagtccttaggaatgataatttcctgttgtcagcaaaatagcctgaactacttttccaacagaatgataacagcacaaatctcaccgtggtttgtctaaaaggcttagaggcttcagtggctcttatatacatttcttatttatgtattacatatctttaaaacgatgaagc

SEQ ID NO: 61650 - DNA, 601 bp, Human
tcataagatttagtaacgttaccatagtgaacaaaaaattgccagtcaatgtcacagacttagttgaggctggaaatcataaagtcattatagccaataatttcttctatgaattatattcagcaatacttaggagttctggagcaggttttttaaaatggttgggttgattccactttggtgattagagttccatggaaaagaataacgaggggaggaaaagctgggtagattttgttgaaaagagtttcaggaaatgaaatgacagctagggaggggggatcaaggaaaatagaaaacyatgcagtgagatccttgtcttatgtctgctattgagttcactccactaaaggattccaaaacactaaatatatagttcagaaaactgaatattcagaagagtttccaaaaaagaaaattagaaatacagtatttaatagttgatcttaaacctgatatctttctctcttctcttcactcccttctgctttcccttctttcctcctacctttccttttgttcctgtcttgctatttctttcctttggccttctctcattatctccctctctcacttccttttttccaagaagcatttgttg

SEQ ID NO: 61651 - DNA, 601 bp, Human
cgaggggaggaaaagctgggtagattttgttgaaaagagtttcaggaaatgaaatgacagctagggaggggggatcaaggaaaatagaaaactatgcagtgagatccttgtcttatgtctgctattgagttcactccactaaaggattccaaaacactaaatatatagttcagaaaactgaatattcagaagagtttccaaaaaagaaaattagaaatacagtatttaatagttgatcttaaacctgatatctttctctcttctcttcactcccttctgctttcccttctttcctcctacstttccttttgttcctgtcttgctatttctttcctttggccttctctcattatctccctctctcacttccttttttccaagaagcatttgttgactactttgatcatattgaaggaactgattttatttttcacatggtatactttgaactttagataactgactttatttattttaataggttctggctgatagattgtcgacagatccaggaatccgttacttttgcatcacaagtatacagagaaattatctgcgtaccttatatggccaaatttgtagtgtttgccaaatcacatga

SEQ ID NO: 61652 - DNA, 601 bp, Human
ggaggccgaggtgggtggatcatctgaggtcaccagttcgagaccaacctggccaacatggcaaaaccctatctctactaaaaatacaaaattagctgggcgtggtggcagatgcctgtaatcccagctactcaggaggcagaggcaggagaattgcttgaacccgggaggcggaggttgcagtgagccaagatcgcaccactgcactccagcctgggcaacagagtgagactccgtctcaaaaaaaaaaaaaaattacccaagcataagtttaaatttaggatttaaatgtattttgggkttgtggaataatgggatacactttttggaatgagaacattaaatgtcaccatgcattaaagattcccattactagtaagaagaaagagtgctggacatgctgtgtcacagatagacagaatgtcagttgtcaatttaaagatggttgtatgtgtattataagaatttgaagttccaagtagtactaccacttctttgtgtaaacaacaagtataattgcagctactttattgttatttctctctgttttcactcaggtgttagaaggaaaacccatctacgttgattgtttcggcaactt

SEQ ID NO: 61653 - DNA, 601 bp, Human
atcttcttttctgcctgtcttctataaactgttagtaataaaaaaagagtatgttgactgtatgcttgcctgttgatgcttgttgaaagggtatttatttactctttccttttcttctaaatactctctactcttccttctctcttttttccatcttgcatggcatcttggggcggaaaggaatcagagtcagatcaagaacaggaggaagaggtaattttatgacagtgtcacttgttatcggctgtgtcattgctgtaaccactaataagagcacatagttaacctgtgttcttagacrgggtaggcggttcttcttagtaattaaaggggcacaattttacttaacctctctaagcctctgttttctcatcttgtggagcaacttaagggaatagtaaagtttccctgtaaattgttgccatgtcgctatgcaatactatatttttccaccaactgctaagagctaaaccattatctcaggggttcttagtcagaagacatctagtggttgaaactctttttgtactaagacattattaatgtcttaatttttaattaaatgtcttagtacattaaaaatgtactaagacattatttg

SEQ ID NO: 61654 - DNA, 601 bp, Human
agctgattccttagactatatcataatgcagaactatgctaataataataatttcttataaagtgggatctttactaagtgttgcacacgcctcatcaatgtcgatctctcacaaacacctatgaggtgtttgttattaaatactacattattgatgaagaaagcaagtcttagagaggttaccttgaataaatagctgtatgaattaaacctgcttcaatatttaaagcaaatgtgtgtttgtctccgttataaagatctgaaaatgcccaaatattataatagaaatgaaaaacataaytggaaaacttaaaataatatgtttctaagatagacagatgcatatgttattagttatatgtaaatgttttcaaatatactagttttctttttttaaatgttattccaatgcattcaaaataaaaaatataataaatacccttatacccaccagcttaaaatgtaagcccttatcagttcagaagatgccccggattcgttttttttctgataccttgcaatggagcagggtgagagaggtgactatagaagcactgtcctgccgcacatagccatatacacaatcaacttaagactgaag

SEQ ID NO: 61655 - DNA, 601 bp, Human
tcataatgcagaactatgctaataataataatttcttataaagtgggatctttactaagtgttgcacacgcctcatcaatgtcgatctctcacaaacacctatgaggtgtttgttattaaatactacattattgatgaagaaagcaagtcttagagaggttaccttgaataaatagctgtatgaattaaacctgcttcaatatttaaagcaaatgtgtgtttgtctccgttataaagatctgaaaatgcccaaatattataatagaaatgaaaaacataattggaaaacttaaaataataagtttctaagatagacagatgcatatgttattagttatatgtaaatgttttcaaatatactagttttctttttttaaatgttattccaatgcattcaaaataaaaaatataataaatacccttatacccaccagcttaaaatgtaagcccttatcagttcagaagatgccccggattcgttttttttctgataccttgcaatggagcagggtgagagaggtgactatagaagcactgtcctgccgcacatagccatatacacaatcaacttaagactgaagtcattctttccctcaactgc

SEQ ID NO: 61656 - DNA, 601 bp, Human
aggagctttttgtgcacaccaggggctatgagccaaggcagtatttgtaaccattcaatttatgtatgttttctttcagatcgatatgacatcagaaaaaagtaagaatttaaagaaaattgagtttgtttgaaagctggctaccataaaaagaagcatgaattaaaatgcaagctagttgctattactaaccactatagtaattacatttttatattatccttattaatcattaatatatttataaaagcagcttggccagttaaattacaaatatacctaatttgcgagctaattagcrgtaaaatgcaatgattattcatctaagcattcactttcttttgacattcttgttaaccctggtattgctgttatgcttgtttagaaacccaccctaccgttttgtccatttgttagcaaaacactgtcatctcatcattttttaagcactgacatgacagtatcactttttatgtaatgcaatagtgacttctgtagagagctcattatttttgtaggatacacctgcaaaagtgatactgtctaatagttcttagctgaagctaaccccatccaatgcctgccccctcccccatcactc

SEQ ID NO: 61657 - DNA, 601 bp, Human
acccaccctaccgttttgtccatttgttagcaaaacactgtcatctcatcattttttaagcactgacatgacagtatcactttttatgtaatgcaatagtgacttctgtagagagctcattatttttgtaggatacacctgcaaaagtgatactgtctaatagttcttagctgaagctaaccccatccaatgcctgccccctcccccatcactcttttgcactttttactgtggtgaagtgtaaccaatgtctttagagctgaggtctaacagacttctgtgaaaactttctgaaaaaaaaccacaaaacaaaaataaacaaaagtgaagagccaagaatgcaaaattaaaaccccctggataaaattactaatcacaacagcatgttattatagggttaattttaaataatgatgcaaatcccaaacctgatctagtagagagagaactggttttgacagaccttaaaagagctatcttagaactcatttcaggtttgtaatatccaattaagattttagtttgttggactatttctagtgactctctggcttcttgtgtggaaactccagttgaattttacagatttctgcttttgtgc

SEQ ID NO: 61658 - DNA, 601 bp, Human
aaccatgtttaatatgctcatgtggccctacacaatgatctgagggcttttttaaagtcctaggacaatgtaatttactactaagttatggaagttgctttgaatgaggcttaccctcatgttaaagcattattcagatctagaatgtttgagattctggatgttttcattggtttatataattgaacaaatttgtattggtataaattattttaataaatttatatgtgtaaattcacatactgtatcttctcaacaaatacagattctcccaagagaaggcacttttgtttatatgacrtatcacattgccctcactgattcctttttttaagtgattttactttattctcccactttcttcttcagaactactccatttatttaaatggcctcttactttgctctcctgatacaaactagtaagaattaaaaattaattcatccatatggctcagttgttaaaaaaaaaagaaaaaaaaatgttaccatgttgctatgatgccatggattttcctgaaggatttctaggtgttttgagtgtttcagaagttttaaatacagactcaagtttgcttttgatttaaagataatcattaaa

SEQ ID NO: 61659 - DNA, 601 bp, Human
aatgtttgagattctggatgttttcattggtttatataattgaacaaatttgtattggtataaattattttaataaatttatatgtgtaaattcacatactgtatcttctcaacaaatacagattctcccaagagaaggcacttttgtttatatgacatatcacattgccctcactgattcctttttttaagtgattttactttattctcccactttcttcttcagaactactccatttatttaaatggcctcttactttgctctcctgatacaaactagtaagaattaaaaattaattcrtccatatggctcagttgttaaaaaaaaaagaaaaaaaaatgttaccatgttgctatgatgccatggattttcctgaaggatttctaggtgttttgagtgtttcagaagttttaaatacagactcaagtttgcttttgatttaaagataatcattaaataatcttcatctaggtataaactaatctctaaagaagtgctctgtggaagggactcttacctgaagtctttttatcagtacattttagaagagtttactgagttttcttccttaaccttaatgggtgtaagcccccacaacct

SEQ ID NO: 61660 - DNA, 601 bp, Human
gtttatataattgaacaaatttgtattggtataaattattttaataaatttatatgtgtaaattcacatactgtatcttctcaacaaatacagattctcccaagagaaggcacttttgtttatatgacatatcacattgccctcactgattcctttttttaagtgattttactttattctcccactttcttcttcagaactactccatttatttaaatggcctcttactttgctctcctgatacaaactagtaagaattaaaaattaattcatccatatggctcagttgttaaaaaaaaaagaaaaaaaaatgttaccatgttgctatgatgccatggattttcctgaaggatttctaggtgttttgagtgtttcagaagttttaaatacagactcaagtttgcttttgatttaaagataatcattaaataatcttcatctaggtataaactaatctctaaagaagtgctctgtggaagggactcttacctgaagtctttttatcagtacattttagaagagtttactgagttttcttccttaaccttaatgggtgtaagcccccacaacctaagcctcaatataccaccttcagcagctt

SEQ ID NO: 61661 - DNA, 601 bp, Human
gaacaaatttgtattggtataaattattttaataaatttatatgtgtaaattcacatactgtatcttctcaacaaatacagattctcccaagagaaggcacttttgtttatatgacatatcacattgccctcactgattcctttttttaagtgattttactttattctcccactttcttcttcagaactactccatttatttaaatggcctcttactttgctctcctgatacaaactagtaagaattaaaaattaattcatccatatggctcagttgttaaaaaaaaaagaaaaaaaaatrttaccatgttgctatgatgccatggattttcctgaaggatttctaggtgttttgagtgtttcagaagttttaaatacagactcaagtttgcttttgatttaaagataatcattaaataatcttcatctaggtataaactaatctctaaagaagtgctctgtggaagggactcttacctgaagtctttttatcagtacattttagaagagtttactgagttttcttccttaaccttaatgggtgtaagcccccacaacctaagcctcaatataccaccttcagcagcttatgcatggactc

SEQ ID NO: 61662 - DNA, 601 bp, Human
ttattctgagcttgctactactggctttctcctagaggaaatcaactttctgcaatttctaatgctttttttcttattttttcctcatggttggttttcttttttttttcaacattgatctgtaacatctgaacaatcttgagatacctctgtgtaatttcactgcgttctttgttttgatatgtagtgtttttttgtgtgtgtatgtgcgtcttgttttagctttgttgtatgtgtggatgtgctacaagtgagaaaaattaagcaagttatttcctgctcatttttccttttcagttgktttttttttcgttagccttgctttgctcttgtaccctgaggccttgtggatctaccattcccagcccattttgttgcccctcccaccaccaccaccacaggaaaagacgctgtgtcgtttcagtcctgattacatttgccaatatcttttttgatttccattttactttcaatgtttttcattcacatcaaagatgatgagacagaatctacagaaacatctgtcctgaaaagtcacctggttaatgaagttcctgtcctagcaagtccggacttgctctctgaagtttctgagatgaaa

SEQ ID NO: 61663 - DNA, 601 bp, Human
agagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccytcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaa

SEQ ID NO: 61664 - DNA, 601 bp, Human
aactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactsccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagt

SEQ ID NO: 61665 - DNA, 601 bp, Human
tttatttgatgatttgtgtctcattttctttaagctttctgtagtggctaatgtgtttgtgtaagccctttgtgttttgtgctttctctgtatactcttgtctaagaaaacaatctcaagattgagtaatgagaatgcttatggaaaacataaacataataaccgggcaacagtgatcttgccttttttagcctctgcacgtaataaggccatgcgagctttgagttttgttgttctgaagtcccaagcttagactcaaattaagcacttttgcacataaatatattgtattttgtttcayagtatgaagacattgcttttcttcttatcttcgcatactttaaaataatttgtacttacaattttgtaatcattaggaagccatttgcttgagaagatttcacataacatgaaattctaattgttgtggatctgtttttgattcagaaaggttggatttcagataccattggtaaatactttaagcaaacaaacctaaggtaaaaatatgcttttcatttatgtggtagatgaatggagaatgtactctcattagatgcagcagacaacaaaaactcaaactttgcacagtttaagttga

SEQ ID NO: 61666 - DNA, 601 bp, Human
tttcatttatgtggtagatgaatggagaatgtactctcattagatgcagcagacaacaaaaactcaaactttgcacagtttaagttgactgtgaggggatgatggctctttgacttataaaaaaggaaaccatagatggctttgaaaagtagcctgtgttcttccaatatctctacaatgaagactgtcattcttaaattgaggttatacaaactttcctataccatggtctaaaatgctgcctatcaatcagtgggagttaaacatgaatgggaaaattatagtttataggagtgagtartatataagcttaatagcaagaaggcagaaactttgcccaaaagacatatatgcatacagatacaatatacacataaaaatgcatatgcttttatcctcgtttctccaaggtcaccaggaccaaatgttgtttctggccacactaatcaggatggcctgatcagctcatgatcaacatctcttgtgaatctctgatgtgattcctttcagacatgacctggaaatgatctatccctccacaagcaataataggaggtcctagccaattgctctacttctgcatcccatttatgatttctct

SEQ ID NO: 61667 - DNA, 601 bp, Human
aatgctgcctatcaatcagtgggagttaaacatgaatgggaaaattatagtttataggagtgagtagtatataagcttaatagcaagaaggcagaaactttgcccaaaagacatatatgcatacagatacaatatacacataaaaatgcatatgcttttatcctcgtttctccaaggtcaccaggaccaaatgttgtttctggccacactaatcaggatggcctgatcagctcatgatcaacatctcttgtgaatctctgatgtgattcctttcagacatgacctggaaatgatctatccctccacaagcaataataggaggtcctagccaattgctctacttctgcatcccatttatgatttctctggtgtttcatgaacaagatggtggtcttcttggtgggcagtattctctccaataatttaaaagtcataagattactagaaatcagcaacttatataattatgtctagaactagtcttgattaaagagatatggaagcagatggttttcatgattcatattagatctattccccattccaccccagaaatcagacacacaatatgatctgaaatgtagtatctagtttgtgcttt

SEQ ID NO: 61668 - DNA, 601 bp, Human
gatgcatcagtcaggtgtcattcacagcataaaaggtaccccccactttcttgagaaagaatacatgaaaagaagaataaactaagaactagaaaacctgggctctgcatcagctaatggtatagcccagggcaggccttttatcatctctgaaatttagaataatagaactttctatttgaagatttagagaatataccaacattcaggaacctctgttggcagttgtggatatctaaatttgggggagattattatgtttcaaaatcatttttagatgtaatttttatcaaatttaatrtgagatttaaccagggctccttcttttagataccttatgtcaaaaatcttcatagtaaacaacactaaaaattgctttgggtaagtgttaaaacacacatgaatgagatatttcactaatatttttgagaaatgagagtgtttaagtatagaaattttatgttaataatttattaaggaaaagtgaattctaaaatcaatatactttatttacacattatgaattgtatgttttaaaaactatacattttcatctacttgtgacttaacctattaaagcaagattctcagtctggctttt

SEQ ID NO: 61669 - DNA, 601 bp, Human
ctaatactttctcatgcttttagaaaaaatatacagtgcctatatttatgcctgttatttaaaagtaagaaaagttttactgaataatattcctcataagtagtctgttaacatatacacatgtatttcattcttttaagtgggtatttaattccactatatggaggttccataattttattaatggcttttgttgatgggctttaggtggtttcccagtaacggcagtaaatattcttgtgcattggtatatttttgtgagtatatctatagggcatattcttagaagtagaattgctgsggaaaagatacgtatatttttaattttgaaagatattgtcaaattgccttcaaaagaggtcaccctatttacccacacacgcatacacacaccccataatgtataagcatccatatgtaatggttttttgtttgttattttgtttttgttttgttttgttttacagagacaggatcatgctctgctgcctaggccagagtgtagtggcacaatcatagctcactgtaacctcaaactcccaggctcaagtgatcctcctgccccagcctcctgagtagctaggacctcaggcaaacacta

SEQ ID NO: 61670 - DNA, 601 bp, Human
tataagagtcacttctaatatgtagaaattaaggaactcaaatactcaccacaatataaagaacacatcatttacaaaatcacaaagcaaaatgtagagactgaaaccttgaagttaatgtgtttacaaagtagtattttatcttctagaattagcaagagaactggatttcactgaggagcaaattcatcaaattcgaattgaaaatcccaactctcttcaagaccagagtcatgcactgttgaagtactggctagagagggatgggaaacatgctacaggtaagtggggaactatatgyatattgggctaaagttggacatgtcttgctcaacaaccgcatcttgcaaattcagtagaatagtaaagaagcaaatgccattaatctgcagtacagtgggtccttgagtaatatcattttgttcagtgtcatttccttataacattgatgagaaaaaagaatcaattcccagcaaggccactgtctgtgtatagtttgtgtatcctccccatgtctgtgtagctttttccccagtattccagtttcctcccacatcccaaagatgtgcacatcagtttcactggtgtttctacattatcc

SEQ ID NO: 61671 - DNA, 601 bp, Human
tatcctccccatgtctgtgtagctttttccccagtattccagtttcctcccacatcccaaagatgtgcacatcagtttcactggtgtttctacattatcccattctgagtgagtgtgggtgtgtgtgagtgccccctgcaatgggatggcatcatctcccagcttggttcccatgcaaagtgctctgagctgctgggttaagttccagccacttgagaccctgaactgaataaggggattgggaaaagaatgaatgaattgatacaaattgttgtcaaatgaaaatgtatagagtccatgrtaattacacaaatgcatgaaataaatgatgccttaggaaagtactcagcgagcccaccatatttgttattgtttgtttatgaatggcatggtgggaggaggtgctccttacaattttcactttgcaaagatttattccttgattgaaccccaccaccactatgaccgccatcacgcattggttcctcaaaaattgaataattatcttacttatgtttattagtctttcttaaatgtatgtgtaactcactttcacttcagtgtttaatattaaaagtgtttggggttttatttagaagtt

SEQ ID NO: 61672 - DNA, 601 bp, Human
gaacaagctactgtcacttctgaagtatgcatgttgcttaaaaactcttgcacgatatgcgtatgaaccgcattaaataacagccctcacttctaacagtaatgttactcaaaccctaatatttttaaaatattgataagtggacacaattgctttacttagcattgtttcactggtagtgcattaccttctgtttctgcttcctttactcataaataacatccagtctacatttatcattccttgtctttacattcttctaagtagaattgtcagatttagcaaataaaaacagaagggygcccagttaaatttaagtttcaggtggtcagcaaatacatttttagcataagcatatcccttgtaatatttggggcatatttatactaaagaagtatttgctttttatctgaaattcaggtatggtgggtgtcctgtatgttatctgacaattctacttttagggcttttgcccatgctgtaccactttttttatgcatatctcttttgtctgttggcttatttttacaaagacttttaattaggctttgattgtttttttctgtacagatatcaaaaatttagtaaggcagttgagtga

SEQ ID NO: 61673 - DNA, 601 bp, Human
ttttttttttttaactttactggctgtttctccttcctgtggcaggttacttctcatggatgtgaatgatgatgtatcttaactgttgagcaagagcctcatagcttgtcctcatctcccacctctgtctctatcgcactggtcctgcacgcctggcctccttgccatttctggagcaccctctgcattctcctgtttcagggccctggtattttctgctccctccaccctagcatgttctttcctcagatcaacatatacctttttctctcactttatttaggtcactgctcaaatatcrcctcctaagcagagcctttcctgacaagtctatttaaaatactagccccatttatcctctacctttatcctggtttacttttctcccaatatttatcataaatatatatctgcagaaatgcaagttcagtggggacggaagctttttatatcttatatcttgttcactgctatatatccagcatctaagcagcacttattacatagttggtgctcaatatatatctgttgaataaatgagtcaatagatgaatgccagtcactcctctgctaaacatctttcaatgactcctcatttccc

SEQ ID NO: 61674 - DNA, 601 bp, Human
gtgggagtaaagagaagccttccgaagagcttctggctgaaggaagctgcaggcctaatttggctcagaatttaagttccggcctttatggaagccaaggagaaagagttgtttaattgacactgattgtccagaaaagaaaacaaattgtgagaaaggccaacatatccctaaacctgaagtctgagaatagggtgtcatgagattgtatcaaaacatttcgcttgtcatttggtgagttttgtggtcattgacatgagaagaggatgaaatgagtaatgaaattatctcttcttccacygagccacccttgccccatcaacctgtaggttttaaagaaaatataaggaagaaggagaaggaccaaggaaaagatgggaagaagaggagaggataacagagagacattttaggcatttaatatctatggagtgatagattgcactgaataccaaaagaaggcacagaaaaggccaataatcttatttagcagttgaggttatcaaagttacattggagtaactccagactatatcaatgaaaaaagtttccatgtcaacagatgcctctattattaaataaaacagtttttcagaggtac

SEQ ID NO: 61675 - DNA, 601 bp, Human
agagttaaacaaaataattgaaattttggggggcaaataaagtgaaacagcatgtgtttgggcttaagacacacatttgtttttgttcactgtaagaatgagatctgctgctaggaattatctgaaatcacaactaaaattaggaaagatccaggcagatgagaactgtgtcctgattttggcagttttcttaaataataaattcatgccatgaatgaatttttattccaagtttgcttttgcatagaattattcatctctcaaattcttggcttgaatgagtactactaaaaatgtttcwtacatgttatctaggctaaaagttaccaaatttaacctaagaatccataggcttagtgaagttagacttgaaacaattatctggataatacatatgtttaatctatactaaaggaatatgtttgtataagtcactctgaatttcacataatttatacaggcctgttcgacttattcttgatgagtatcaggcatttctcttaagcttcccatgtggacccttatttctcataaccctaacttgggcatccaattttaatcacttttcttgccaaccatatttctaggcagtagattcctg

SEQ ID NO: 61676 - DNA, 601 bp, Human
ataattgaaattttggggggcaaataaagtgaaacagcatgtgtttgggcttaagacacacatttgtttttgttcactgtaagaatgagatctgctgctaggaattatctgaaatcacaactaaaattaggaaagatccaggcagatgagaactgtgtcctgattttggcagttttcttaaataataaattcatgccatgaatgaatttttattccaagtttgcttttgcatagaattattcatctctcaaattcttggcttgaatgagtactactaaaaatgtttcttacatgttatctrggctaaaagttaccaaatttaacctaagaatccataggcttagtgaagttagacttgaaacaattatctggataatacatatgtttaatctatactaaaggaatatgtttgtataagtcactctgaatttcacataatttatacaggcctgttcgacttattcttgatgagtatcaggcatttctcttaagcttcccatgtggacccttatttctcataaccctaacttgggcatccaattttaatcacttttcttgccaaccatatttctaggcagtagattcctgattatatttaaaa

SEQ ID NO: 61677 - DNA, 601 bp, Human
tgtttttgttcactgtaagaatgagatctgctgctaggaattatctgaaatcacaactaaaattaggaaagatccaggcagatgagaactgtgtcctgattttggcagttttcttaaataataaattcatgccatgaatgaatttttattccaagtttgcttttgcatagaattattcatctctcaaattcttggcttgaatgagtactactaaaaatgtttcttacatgttatctaggctaaaagttaccaaatttaacctaagaatccataggcttagtgaagttagacttgaaacaaytatctggataatacatatgtttaatctatactaaaggaatatgtttgtataagtcactctgaatttcacataatttatacaggcctgttcgacttattcttgatgagtatcaggcatttctcttaagcttcccatgtggacccttatttctcataaccctaacttgggcatccaattttaatcacttttcttgccaaccatatttctaggcagtagattcctgattatatttaaaatataatttggtttagaatttacaggtcttcctttagcagagacaaatgtaaacatataacttga

SEQ ID NO: 61678 - DNA, 601 bp, Human
tggcttttggccagagccctaaaatactattgaccactttatctcaacttctccatagaattattctaatattattcatagtctacctttttttgatgccagggagatgcactattggttagataatagctacaggaaactttgacttcctgcaaaaagttctgctagaaacaggggatattcctatacctttgggtgaataattccaagcctaagcaccagtgtcagtggctcataagtgtttactgaactgcttagggtctatgtttacagtcaggctttttttttaggagtttaagtraaagaagtcacatgagcaagctgctttttattttggagagattttgacagatgggttctccaacagctctcagaattccagaattttttttcattcattgaacaacaacaacaaaaaaccaaaacactctatttttgttgatgtctgagaccagcacgtatttgttttcacctctaccaacttgtccatcaaagcctccatgaataaaagtttcacaatacaatgtaagctaaagaagaaaccagtagtgaagtcattccttagcatgttaaacaaagcaatgcttccatgcttccacca

SEQ ID NO: 61679 - DNA, 601 bp, Human
tctaatattattcatagtctacctttttttgatgccagggagatgcactattggttagataatagctacaggaaactttgacttcctgcaaaaagttctgctagaaacaggggatattcctatacctttgggtgaataattccaagcctaagcaccagtgtcagtggctcataagtgtttactgaactgcttagggtctatgtttacagtcaggctttttttttaggagtttaagtaaaagaagtcacatgagcaagctgctttttattttggagagattttgacagatgggttctccaayagctctcagaattccagaattttttttcattcattgaacaacaacaacaaaaaaccaaaacactctatttttgttgatgtctgagaccagcacgtatttgttttcacctctaccaacttgtccatcaaagcctccatgaataaaagtttcacaatacaatgtaagctaaagaagaaaccagtagtgaagtcattccttagcatgttaaacaaagcaatgcttccatgcttccaccaggagctaacagaggaattaggggagctggaggccagctcagatgaggaggcgatggtaactacc

SEQ ID NO: 61680 - DNA, 601 bp, Human
cccacctcacctctcgcttttctatttttgttgaagttttatctaactttggtcagattctcctaagcatgttattacccacttgagtttttcactagttgacaggattttgtatctcagcaatgcttctcaacatcgcctttgattttctaacattcctcacattataagcacttgggagtagttcctcagaattggtgccaaacaccacagtgacccttttctctcaactgtttagggagacgatatgcctgaaatacccccagaaacagtcacagaagaagaatacattgatgagcayggacacaccgtggtaaagaaggtattgtctagtatatcctaacagggttgattacaaacttcctgtttaaaatttatcaattccatggtactgtcacacaaaaataagatacacaaatgaaatacatttcaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggtg

SEQ ID NO: 61681 - DNA, 601 bp, Human; identical to SEQ ID NO: 61559

SEQ ID NO: 61682 - DNA, 601 bp, Human; identical to SEQ ID NO: 61560

SEQ ID NO: 61683 - DNA, 601 bp, Human; identical to SEQ ID NO: 61561

SEQ ID NO: 61684 - DNA, 601 bp, Human; identical to SEQ ID NO: 61562

SEQ ID NO: 61685 - DNA, 601 bp, Human; identical to SEQ ID NO: 61563

SEQ ID NO: 61686 - DNA, 601 bp, Human; identical to SEQ ID NO: 61564

SEQ ID NO: 61687 - DNA, 601 bp, Human; identical to SEQ ID NO: 61565

SEQ ID NO: 61688 - DNA, 601 bp, Human; identical to SEQ ID NO: 61566

SEQ ID NO: 61689 - DNA, 601 bp, Human; identical to SEQ ID NO: 61567

SEQ ID NO: 61690 - DNA, 601 bp, Human; identical to SEQ ID NO: 61568

SEQ ID NO: 61691 - DNA, 601 bp, Human; identical to SEQ ID NO: 61569

SEQ ID NO: 61692 - DNA, 601 bp, Human; identical to SEQ ID NO: 61570

SEQ ID NO: 61693 - DNA, 601 bp, Human; identical to SEQ ID NO: 61571

SEQ ID NO: 61694 - DNA, 601 bp, Human; identical to SEQ ID NO: 61572

SEQ ID NO: 61695 - DNA, 601 bp, Human; identical to SEQ ID NO: 61573

SEQ ID NO: 61696 - DNA, 601 bp, Human; identical to SEQ ID NO: 61574

SEQ ID NO: 61697 - DNA, 601 bp, Human; identical to SEQ ID NO: 61575

SEQ ID NO: 61698 - DNA, 601 bp, Human; identical to SEQ ID NO: 61576

SEQ ID NO: 61699 - DNA, 601 bp, Human; identical to SEQ ID NO: 61577

SEQ ID NO: 61700 - DNA, 601 bp, Human; identical to SEQ ID NO: 61578

SEQ ID NO: 61701 - DNA, 601 bp, Human; identical to SEQ ID NO: 61579

SEQ ID NO: 61702 - DNA, 601 bp, Human; identical to SEQ ID NO: 61580

SEQ ID NO: 61703 - DNA, 601 bp, Human; identical to SEQ ID NO: 61581

SEQ ID NO: 61704 - DNA, 601 bp, Human; identical to SEQ ID NO: 61582

SEQ ID NO: 61705 - DNA, 601 bp, Human; identical to SEQ ID NO: 61583

SEQ ID NO: 61706 - DNA, 601 bp, Human; identical to SEQ ID NO: 61584

SEQ ID NO: 61707 - DNA, 601 bp, Human; identical to SEQ ID NO: 61585

SEQ ID NO: 61708 - DNA, 601 bp, Human; identical to SEQ ID NO: 61586

SEQ ID NO: 61709 - DNA, 601 bp, Human; identical to SEQ ID NO: 61587

SEQ ID NO: 61710 - DNA, 601 bp, Human; identical to SEQ ID NO: 61588

SEQ ID NO: 61711 - DNA, 601 bp, Human; identical to SEQ ID NO: 61589

SEQ ID NO: 61712 - DNA, 601 bp, Human; identical to SEQ ID NO: 61590

SEQ ID NO: 61713 - DNA, 601 bp, Human; identical to SEQ ID NO: 61591

SEQ ID NO: 61714 - DNA, 601 bp, Human; identical to SEQ ID NO: 61592

SEQ ID NO: 61715 - DNA, 601 bp, Human; identical to SEQ ID NO: 61593

SEQ ID NO: 61716 - DNA, 601 bp, Human; identical to SEQ ID NO: 61594

SEQ ID NO: 61717 - DNA, 601 bp, Human; identical to SEQ ID NO: 61595

SEQ ID NO: 61718 - DNA, 601 bp, Human; identical to SEQ ID NO: 61596

SEQ ID NO: 61719 - DNA, 601 bp, Human; identical to SEQ ID NO: 61597

SEQ ID NO: 61720 - DNA, 601 bp, Human; identical to SEQ ID NO: 61598

SEQ ID NO: 61721 - DNA, 601 bp, Human; identical to SEQ ID NO: 61599

SEQ ID NO: 61722 - DNA, 601 bp, Human; identical to SEQ ID NO: 61600

SEQ ID NO: 61723 - DNA, 601 bp, Human; identical to SEQ ID NO: 61601

SEQ ID NO: 61724 - DNA, 601 bp, Human; identical to SEQ ID NO: 61602

SEQ ID NO: 61725 - DNA, 601 bp, Human; identical to SEQ ID NO: 61603

SEQ ID NO: 61726 - DNA, 601 bp, Human; identical to SEQ ID NO: 61604

SEQ ID NO: 61727 - DNA, 601 bp, Human; identical to SEQ ID NO: 61605

SEQ ID NO: 61728 - DNA, 601 bp, Human; identical to SEQ ID NO: 61606

SEQ ID NO: 61729 - DNA, 601 bp, Human; identical to SEQ ID NO: 61607

SEQ ID NO: 61730 - DNA, 601 bp, Human; identical to SEQ ID NO: 61608

SEQ ID NO: 61731 - DNA, 601 bp, Human; identical to SEQ ID NO: 61609

SEQ ID NO: 61732 - DNA, 601 bp, Human; identical to SEQ ID NO: 61610

SEQ ID NO: 61733 - DNA, 601 bp, Human; identical to SEQ ID NO: 61611

SEQ ID NO: 61734 - DNA, 601 bp, Human; identical to SEQ ID NO: 61612

SEQ ID NO: 61735 - DNA, 601 bp, Human; identical to SEQ ID NO: 61613

SEQ ID NO: 61736 - DNA, 601 bp, Human; identical to SEQ ID NO: 61614

SEQ ID NO: 61737 - DNA, 601 bp, Human; identical to SEQ ID NO: 61615

SEQ ID NO: 61738 - DNA, 601 bp, Human; identical to SEQ ID NO: 61616

SEQ ID NO: 61739 - DNA, 601 bp, Human; identical to SEQ ID NO: 61617

SEQ ID NO: 61740 - DNA, 601 bp, Human; identical to SEQ ID NO: 61618

SEQ ID NO: 61741 - DNA, 601 bp, Human; identical to SEQ ID NO: 61619

SEQ ID NO: 61742 - DNA, 601 bp, Human; identical to SEQ ID NO: 61620

SEQ ID NO: 61743 - DNA, 601 bp, Human; identical to SEQ ID NO: 61621

SEQ ID NO: 61744 - DNA, 601 bp, Human; identical to SEQ ID NO: 61622

SEQ ID NO: 61745 - DNA, 601 bp, Human; identical to SEQ ID NO: 61623

SEQ ID NO: 61746 - DNA, 601 bp, Human; identical to SEQ ID NO: 61624

SEQ ID NO: 61747 - DNA, 601 bp, Human; identical to SEQ ID NO: 61625

SEQ ID NO: 61748 - DNA, 601 bp, Human; identical to SEQ ID NO: 61626

SEQ ID NO: 61749 - DNA, 601 bp, Human; identical to SEQ ID NO: 61627

SEQ ID NO: 61750 - DNA, 601 bp, Human; identical to SEQ ID NO: 61628

SEQ ID NO: 61751 - DNA, 601 bp, Human; identical to SEQ ID NO: 61629

SEQ ID NO: 61752 - DNA, 601 bp, Human; identical to SEQ ID NO: 61630

SEQ ID NO: 61753 - DNA, 601 bp, Human; identical to SEQ ID NO: 61631

SEQ ID NO: 61754 - DNA, 601 bp, Human; identical to SEQ ID NO: 61632

SEQ ID NO: 61755 - DNA, 601 bp, Human; identical to SEQ ID NO: 61633

SEQ ID NO: 61756 - DNA, 601 bp, Human; identical to SEQ ID NO: 61634

SEQ ID NO: 61757 - DNA, 601 bp, Human; identical to SEQ ID NO: 61635

SEQ ID NO: 61758 - DNA, 601 bp, Human; identical to SEQ ID NO: 61636

SEQ ID NO: 61759 - DNA, 601 bp, Human; identical to SEQ ID NO: 61637

SEQ ID NO: 61760 - DNA, 601 bp, Human; identical to SEQ ID NO: 61638

SEQ ID NO: 61761 - DNA, 601 bp, Human; identical to SEQ ID NO: 61639

SEQ ID NO: 61762 - DNA, 601 bp, Human; identical to SEQ ID NO: 61640

SEQ ID NO: 61763 - DNA, 601 bp, Human; identical to SEQ ID NO: 61641

SEQ ID NO: 61764 - DNA, 601 bp, Human; identical to SEQ ID NO: 61642

SEQ ID NO: 61765 - DNA, 601 bp, Human; identical to SEQ ID NO: 61643

SEQ ID NO: 61766 - DNA, 601 bp, Human; identical to SEQ ID NO: 61644

SEQ ID NO: 61767 - DNA, 601 bp, Human; identical to SEQ ID NO: 61645

SEQ ID NO: 61768 - DNA, 601 bp, Human; identical to SEQ ID NO: 61646

SEQ ID NO: 61769 - DNA, 601 bp, Human; identical to SEQ ID NO: 61647

SEQ ID NO: 61770 - DNA, 601 bp, Human; identical to SEQ ID NO: 61648

SEQ ID NO: 61771 - DNA, 601 bp, Human; identical to SEQ ID NO: 61649

SEQ ID NO: 61772 - DNA, 601 bp, Human; identical to SEQ ID NO: 61650

SEQ ID NO: 61773 - DNA, 601 bp, Human; identical to SEQ ID NO: 61651

SEQ ID NO: 61774 - DNA, 601 bp, Human; identical to SEQ ID NO: 61652

SEQ ID NO: 61775 - DNA, 601 bp, Human; identical to SEQ ID NO: 61653

SEQ ID NO: 61776 - DNA, 601 bp, Human; identical to SEQ ID NO: 61654

SEQ ID NO: 61777 - DNA, 601 bp, Human; identical to SEQ ID NO: 61655

SEQ ID NO: 61778 - DNA, 601 bp, Human; identical to SEQ ID NO: 61656

SEQ ID NO: 61779 - DNA, 601 bp, Human; identical to SEQ ID NO: 61657

SEQ ID NO: 61780 - DNA, 601 bp, Human; identical to SEQ ID NO: 61658

SEQ ID NO: 61781 - DNA, 601 bp, Human; identical to SEQ ID NO: 61659

SEQ ID NO: 61782 - DNA, 601 bp, Human; identical to SEQ ID NO: 61660

SEQ ID NO: 61783 - DNA, 601 bp, Human; identical to SEQ ID NO: 61661

SEQ ID NO: 61784 - DNA, 601 bp, Human; identical to SEQ ID NO: 61662

SEQ ID NO: 61785 - DNA, 601 bp, Human; identical to SEQ ID NO: 61663

SEQ ID NO: 61786 - DNA, 601 bp, Human; identical to SEQ ID NO: 61664

SEQ ID NO: 61787 - DNA, 601 bp, Human; identical to SEQ ID NO: 61665

SEQ ID NO: 61788 - DNA, 601 bp, Human; identical to SEQ ID NO: 61666

SEQ ID NO: 61789 - DNA, 601 bp, Human; identical to SEQ ID NO: 61667

SEQ ID NO: 61790 - DNA, 601 bp, Human; identical to SEQ ID NO: 61668

SEQ ID NO: 61791 - DNA, 601 bp, Human; identical to SEQ ID NO: 61669

SEQ ID NO: 61792 - DNA, 601 bp, Human; identical to SEQ ID NO: 61670

SEQ ID NO: 61793 - DNA, 601 bp, Human; identical to SEQ ID NO: 61671

SEQ ID NO: 61794 - DNA, 601 bp, Human; identical to SEQ ID NO: 61672

SEQ ID NO: 61795 - DNA, 601 bp, Human; identical to SEQ ID NO: 61673

SEQ ID NO: 61796 - DNA, 601 bp, Human; identical to SEQ ID NO: 61674

SEQ ID NO: 61797 - DNA, 601 bp, Human; identical to SEQ ID NO: 61675

SEQ ID NO: 61798 - DNA, 601 bp, Human; identical to SEQ ID NO: 61676

SEQ ID NO: 61799 - DNA, 601 bp, Human; identical to SEQ ID NO: 61677

SEQ ID NO: 61800 - DNA, 601 bp, Human; identical to SEQ ID NO: 61678

SEQ ID NO: 61801 - DNA, 601 bp, Human; identical to SEQ ID NO: 61679

SEQ ID NO: 61802 - DNA, 601 bp, Human; identical to SEQ ID NO: 61680

SEQ ID NO: 61803 - DNA, 601 bp, Human
gaggtgatatttaagctttagataggaaaggataagaagttgtttgggaaagggatttccaaggtgctgggtagggaagcatttcagagctaggcatggatcagcttggttggggcatggcagtggagaggtgtggaggaatgggagtgggtgtgtgggaaggcaggcagacctcaggtcatgaagggccataggcggcagggccaggagcacagacattttggcaatagggagctacagacgggtctattgttgtagtggaaaggtcattgtggtggcaggaggagagaggatctgcaawgccatttgtgaagaagcctttggaacagccccagtgagagtctgataagggcctgaaagaaagcagtggaactgagcatggttgacaggagccagggcctgaccagtgcagtctaggagtggaggagggaagttgaagacctcgtgcatcatgagttccatcaagttgatatgccaacaaaagaaaatcctggtagaattcccagtgcagacatgtttcacgtttcctcctgatttatctcataccttatattttaaaaccttatcctttagtggctcaaagctcatgtcttagaaactt

SEQ ID NO: 61804 - DNA, 601 bp, Human
caggaagtgtttatgggaaggagttccaacggcaccctcttgagctggccgttgatactgacctccttatgtttgcacagatggaactactgttttaagagactttgttttatttggtttgccagtgtgctagtcagggtgagtggaaaccttgcaatgatgattatttctctattttcagtgaattttgagcaagaggcagttggtgacatataaggtgggcataggacagaatcaaaagacaaaacacagtgaaagctgcagcaaggcaaagctgagcacaagcaaggccatctgtgamagcccgtcgcctaaccgtttagcaatgtttcacccttcttgctttttgaaaagtcatgttggttgagcttggtagctcatgcctgtaatcctagcactttgggaggctgaggtgggtgggttgcatgagtccaggagttatagaccagcctgggcaatatggtaaaaccccgtttctaccaaaaatacaaaaattagcctggggtggtggtgtgcatctgtagtcctagacacttagggggctgaggcgggaggatcgcctgagcctgggaagttgaggctgcagtgagtccaagattgc

SEQ ID NO: 61805 - DNA, 601 bp, Human
gctagctttgtgactaggctcttgcgacaccccggcttgggtttctttatggataatacaggggagacaggcctgcttttagtgtcacgactctggctgggtaagagttgcatggtcattttggatagataattgaaccctgagcctgacaacccctcatgcttctgccccagggcctggcttgtcaccttaatccacaaactccggccctgctttggttgatctgctcagtgtccatgtcagcttgtcaaattagagaggcagtgtgatacacagggacagataaattttagagtccagygaattgggctgagatcctggttttaccacttactagatgtgtggcaaattgtgcaaattggcaaattgtgttttaacttttttgtatctcattttcctattagaatgtggtcttatgattggtacttctgggatagttgtgaagatgagaggtagtgcaggtaaaatgcctggtggtgcattagtcaataaatatctatgtggcagatcagaaatctgcttctgctgaaggggtcggtgctgttcgttttctgaattttctgacaagactggttaggtcctccaaggggatctgctccgg

SEQ ID NO: 61806 - DNA, 601 bp, Human
cagagcagcttcactgtgatttacctcctcctcctactttctgcacgaccagtttcctctctccagtgacaaaacagctgaagccaccagatctacagaaggaagggggctgaaggcccaggctgagggcagttaggaggactacgtgacagggtgtggacgtgcactgtgtgtgcgtgcgtgcgtttgtgtgcatgtgtgtttgtgtgtgtgcacgtgtgtgtgtgtgtgtgctgggagaaggacaaagcttcctccagtgctaaagccttcagcaattgtatgaaaagcatgtgttgcmaaacaatccagcatcaggcgtttgcagggctttaagtaaaagctgcccaagcacgggtgtgtttgttttttccctagctctgatacccttttgatctggtttccttttttctttgggctttatctggagacgtgtgaagaattggaggccgcgctggctgtgtgttttggcggtgctactctggttagccatgtgtgccggagctctggggacttctggggggtgagccacgtggcagctccttagggctccttcttagcgagtctcccagcagatctgccagagcagcaggtcggcagc

SEQ ID NO: 61807 - DNA, 601 bp, Human
cgctggctgtgtgttttggcggtgctactctggttagccatgtgtgccggagctctggggacttctggggggtgagccacgtggcagctccttagggctccttcttagcgagtctcccagcagatctgccagagcagcaggtcggcagcaggagcccaggtccagcgttgcaggggtggggaaaaccatttcctggctggagaaggctgctgctgggctgggtgggcaagtcctgacacattagcgatcagccaactgttttattaccaggtctcccatggagaaaacacttcgtaaatcraggagctgttacaaaagtcgaatggcagcatcattagtgcccagctttctggaaatgtggatttcctgacagttttctcaccttctcatcttatagatttcctgtcagcctggatcatagccatgacagcctccccgttccctgtcctctctgtgcatgcacctgtgcatgtgtgtataaagacagaattatttagacaaatggctttcagaagttccgtcacagatataccccatgttcgtttacagtgagtttcacccaacatttgagtctatttactgagaaatggttgggaaggag

SEQ ID NO: 61808 - DNA, 601 bp, Human
gtgccggagctctggggacttctggggggtgagccacgtggcagctccttagggctccttcttagcgagtctcccagcagatctgccagagcagcaggtcggcagcaggagcccaggtccagcgttgcaggggtggggaaaaccatttcctggctggagaaggctgctgctgggctgggtgggcaagtcctgacacattagcgatcagccaactgttttattaccaggtctcccatggagaaaacacttcgtaaatcgaggagctgttacaaaagtcgaatggcagcatcattagtgcccrgctttctggaaatgtggatttcctgacagttttctcaccttctcatcttatagatttcctgtcagcctggatcatagccatgacagcctccccgttccctgtcctctctgtgcatgcacctgtgcatgtgtgtataaagacagaattatttagacaaatggctttcagaagttccgtcacagatataccccatgttcgtttacagtgagtttcacccaacatttgagtctatttactgagaaatggttgggaaggagctgaagagccactgcaaatgattgtagatggatgtggtaactt

SEQ ID NO: 61809 - DNA, 601 bp, Human
gcaggtcggcagcaggagcccaggtccagcgttgcaggggtggggaaaaccatttcctggctggagaaggctgctgctgggctgggtgggcaagtcctgacacattagcgatcagccaactgttttattaccaggtctcccatggagaaaacacttcgtaaatcgaggagctgttacaaaagtcgaatggcagcatcattagtgcccagctttctggaaatgtggatttcctgacagttttctcaccttctcatcttatagatttcctgtcagcctggatcatagccatgacagcctcccygttccctgtcctctctgtgcatgcacctgtgcatgtgtgtataaagacagaattatttagacaaatggctttcagaagttccgtcacagatataccccatgttcgtttacagtgagtttcacccaacatttgagtctatttactgagaaatggttgggaaggagctgaagagccactgcaaatgattgtagatggatgtggtaactttttggggtgaaagatttagcagctcagatgataaggttagattaagatagcatttaaaatgacatctgcaaagagaggcagttttaattaaga

SEQ ID NO: 61810 - DNA, 601 bp, Human
aagaacacaaaatgaatttattattggatatcagtcatatttaactgtcagttttctacgtttaacttagttgtaacaaagctaaaaattctgcagacgttttctgggttatttctgcttgcttccactgtccagccactctttgctcagggaagatcagctcattcccctgtaagccaggaacttggacctgataaatgtctgctcagttcaagttgggtttggggctgacaccgttgcctttcagcaatcctagggcagaggctgcacagagtaagatgcccacatgcttgaggtgtgrtttatgtgttcttatgctagacttagtttgtatgccaggatgcagttacttgtagaatggtctacaaaatctcagtaaatttggaccaacaaaaaagaaaaagaaaaaagaaatatgcctctttgtggcctgactttctttctttaaaaattgggtaataatagaacctatgaactggtcatcagtgaagaatactttttctggttttaccctgtgctaggagtgaacagtgtcatgtttcagactatgtgtaaaagtccaaggtgaaccagtcccctggaaagtttgggtttttctagt

SEQ ID NO: 61811 - DNA, 601 bp, Human
aaaagaaaaagaaaaaagaaatatgcctctttgtggcctgactttctttctttaaaaattgggtaataatagaacctatgaactggtcatcagtgaagaatactttttctggttttaccctgtgctaggagtgaacagtgtcatgtttcagactatgtgtaaaagtccaaggtgaaccagtcccctggaaagtttgggtttttctagttcatatttgtcctagtggaatagaggcaattaagtgtttggcttcaaagaccatgttctctgcataggtcataagctgaaacagtgttcagcrttagaaatgagaacttggttgggtgcagtggctcacgcctgtaatcctgggactttgggaggcccaggtgggtggatcgcttgagcccaggagtttgagaccagcctgggcaacatggcgataccccctctctataaaaaataacaaaaattagctgggtgtggtggcgggtgcctgtagtcccagctactcaggaggctgaggtgggatgatctccccaactcaggaagtcaaggctgcagtgagctgtgatgatgccgctgcactccagcctgggtgacagagtgagacgctgtctta

SEQ ID NO: 61812 - DNA, 601 bp, Human
ttgtcttttattttcttatgattggtttcatgagcttatacagtctgaaggaattatcccaggagagatgtggcgtggtcctctttgtgtatcacatcagaaagcatttgatgtgtattccatttttggtgatgttaaattgacctcttggttgaggtatataatttatttctaatgctaataaaagatagctctctgcattatattttttggagggaaagagggccttccatagggatgctctgtcttaggatggaaaactggaaggttccctggtggaaaggtctcatagctaattgaygtgtcagaaccatggctggttaccacgtctgcagactttggcccgagtgcttcatccagtggtgactgatcatctcctgataagaagcccattcattaagggcttactctgtggtaggcattgtctgtcttactccttagagccctcctgtgaaggaggaggatcatattagctcaggcagagccactgggaagttggatgacttgcctgcaagtggcagagccacttccctggaagtctttctactgtggttcctgcatgcccttcccccagacagactcccacactcacccctgcacc

SEQ ID NO: 61813 - DNA, 601 bp, Human; identical to SEQ ID NO: 29108

SEQ ID NO: 61814 - DNA, 601 bp, Human; identical to SEQ ID NO: 29109

SEQ ID NO: 61815 - DNA, 601 bp, Human; identical to SEQ ID NO: 29110

SEQ ID NO: 61816 - DNA, 601 bp, Human; identical to SEQ ID NO: 29111

SEQ ID NO: 61817 - DNA, 601 bp, Human; identical to SEQ ID NO: 29112

SEQ ID NO: 61818 - DNA, 601 bp, Human; identical to SEQ ID NO: 29113

SEQ ID NO: 61819 - DNA, 601 bp, Human; identical to SEQ ID NO: 29114

SEQ ID NO: 61820 - DNA, 601 bp, Human; identical to SEQ ID NO: 29115

SEQ ID NO: 61821 - DNA, 601 bp, Human
cgcttgaggtcccctgcacagtggccagagcggcagggacagatcccaaagattcccggggggtgtggccttcaatggctcaggcgtcccctgctgtcccggctgcagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccaggtaccagggagttgcatggggcagtgcccgggccgtggcggggggcatgratttgttgcagggtctgcagtactgagaacagcgtagaaccagtggcgatgggaggaaggggaccggtagagcggggctgggtaagcctccatccagccgggctgagccctggtctccgcagagcctctgcccctcccgagacacccgctacctggtgttagcggtggaccgccctgcgggggcctggcgcggctccgggctggccttgaccctgcagccccgcggagagggtaggtccgcgtggagagggacggggagccgggtcgactgcccccgggcccccagcccctgagccagcc

SEQ ID NO: 61822 - DNA, 601 bp, Human
ggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggwggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatg

SEQ ID NO: 61823 - DNA, 601 bp, Human
cccagagagcagaccctctgtggctctgagtcccatgtggacatgttttgttctgtccacagccttctgttttgcattatttaattttctgggagtggggagagctgatgtcagtccagccagatgtggtgaagggcagcctttgattttagcttgtgcagaggcaggggtgagccgagtcccctcagcaccgtggacatcggggctggagcactctttgtgtaccctgacatgccccacgggcctggcctatggcaagggctctgttaccgtccccgtcttccagatgaggtcatgggtmgagggggtgccacagccgcagatggtggagttagactttgaactccagcgtctgagacaagatgtgtgcgcccggctgccccagcttagggcctgcagatgggcgggtctttgggtcttcagtgtagcccatttgcttttcttgtgcctgtgtctgccttgtgcctactgctggcgtggtggcgtgggcagtggacggctccctgcctcgggagtgaccggcggtgctgtcctggctgtgcctccctctgactcagaaccaccaggaaggtggtgtcgggggctccctgggaacccccac

SEQ ID NO: 61824 - DNA, 601 bp, Human
cagccttctgttttgcattatttaattttctgggagtggggagagctgatgtcagtccagccagatgtggtgaagggcagcctttgattttagcttgtgcagaggcaggggtgagccgagtcccctcagcaccgtggacatcggggctggagcactctttgtgtaccctgacatgccccacgggcctggcctatggcaagggctctgttaccgtccccgtcttccagatgaggtcatgggtagagggggtgccacagccgcagatggtggagttagactttgaactccagcgtctgagacragatgtgtgcgcccggctgccccagcttagggcctgcagatgggcgggtctttgggtcttcagtgtagcccatttgcttttcttgtgcctgtgtctgccttgtgcctactgctggcgtggtggcgtgggcagtggacggctccctgcctcgggagtgaccggcggtgctgtcctggctgtgcctccctctgactcagaaccaccaggaaggtggtgtcgggggctccctgggaacccccactgctcgaagcctggcccacagccccaggtggtgacacccgtgctcacgaaggcctcccg

SEQ ID NO: 61825 - DNA, 601 bp, Human
ggccccctcagggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacggtgagtcgggcctctgccctgccccgccacgcccgggcacctgggccggtgtttgtcaacaaagtcrggctgactggtcctgcacagctcagcgctcagccacgtttggcatgtcccgtgggcagccgggctggggcctcctcacccaggaagctattttgagcctgactgttttccccacacaggggccccgggagagggaggctccactaaaccccttcttttccctcctacagaaccctcacacggacgcctggaagagccacggcttggtggaggtggccagctactgcgaagaaagccggggcaacaaccagtgggtcccctacatctctcttcaggaacgctgaggcccttcccagcagca

SEQ ID NO: 61826 - DNA, 601 bp, Human
gagcgctttgcggtggacgagctcccgcgggtccctgttgcctcgatgtggcccctgcacgcgacggacctcgtgggccccgtttttcgcccctgagcgagtcggtctggatggcccgggacgcgccgggcgaggccgcgcacgtagacggcacccagggcttctccgcgggggccgccggggagctgggggtggcgcactccgacagcccggcagcgccctgggaagacccccgccgcttcccgggaagacgcgtcccgcttccgggggcgcgggtgccagctgcggttgtgggggagcycgcggggtctcggtcgagctttcccgactgcgtcccccgaggtgggcgtcgctcagccccggatcgggaggttgggccgcggtgctggcggtgccgcggtttgggggccgtgcaaaatggaggcaactttggggcctgtttaccctgcgcagcaaatggctgctggcgctgccggctgcgcgattgtgaaaatctcccccggggcgcgaggccgcgtctgcctggatgacgcaaccgggagggcccgggcctggagcgggggcgggggggcgggcggccgggagccggagcggggcgcgt

SEQ ID NO: 61827 - DNA, 601 bp, Human
tgccagctgcggttgtgggggagcccgcggggtctcggtcgagctttcccgactgcgtcccccgaggtgggcgtcgctcagccccggatcgggaggttgggccgcggtgctggcggtgccgcggtttgggggccgtgcaaaatggaggcaactttggggcctgtttaccctgcgcagcaaatggctgctggcgctgccggctgcgcgattgtgaaaatctcccccggggcgcgaggccgcgtctgcctggatgacgcaaccgggagggcccgggcctggagcgggggcgggggggcgggcrgccgggagccggagcggggcgcgtcctccatgaggtcaggctaggcccgcccggtcttcgcggggacaagcaagagtcccagattttggccgtagtgcagggtggaaaggggaagccgcgacagaactgaaaaggggaagcgctggctgtcttggtggccggggggtgaggctctgccccggcggggctgcgtgaggggaaggggccccccgccctgggaaggttgggctgtcctgggcggcgccgcccgaggagtcggggctcagtgaccgctgcccttgtaggtgcttggggcaggcg

SEQ ID NO: 61828 - DNA, 601 bp, Human
gcgcgattgtgaaaatctcccccggggcgcgaggccgcgtctgcctggatgacgcaaccgggagggcccgggcctggagcgggggcgggggggcgggcggccgggagccggagcggggcgcgtcctccatgaggtcaggctaggcccgcccggtcttcgcggggacaagcaagagtcccagattttggccgtagtgcagggtggaaaggggaagccgcgacagaactgaaaaggggaagcgctggctgtcttggtggccggggggtgaggctctgccccggcggggctgcgtgaggggaakgggccccccgccctgggaaggttgggctgtcctgggcggcgccgcccgaggagtcggggctcagtgaccgctgcccttgtaggtgcttggggcaggcgttggagctgccttcgggaagcctcgggggtgtgggaccgggtgggcccctgcctgggcggggcggggtcttctggccgaggcaggggtggggatgtgctgaaggccgcccgggcgccctggaggggtctccgcccggagcctggcgctgcctcgtgacctgcatcatcttcagttccagggtctccctccactgctgtagta

SEQ ID NO: 61829 - DNA, 601 bp, Human
cctgatgcccctcacccacccctgaagatcccaggtgggcgagggaatagtcagagggatcacaatctttcagctaacttattctactccgtgagtatggggccgggcctgctggggctgctctggggccacaggtacttcttgtgcaccttgctgcccgtacctgtgattgaatgtaatcgtgggaaccctgagtttcatcagagccggcgcacagtctcctgcagcccaggcgttgcctgagctcaacacggcctaggcccaagctttagcgctgccgggttcttggagtcctgtgggrtgagtcagggttctgaattgggctgcaccccctggacaggatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacaggtgaggggcaaggacaggcagggagtgctcacccaggggagcagggaccaggtgaggggcaaggacaggcggggagtgctcacccagg

SEQ ID NO: 61830 - DNA, 601 bp, Human
caaacgcattaactggcgaacagtgctgagtggcggcagcctctacatcgagatcccgggcggcgcgctgcccgaggggagcaaggacaggtgaggggcaaggacaggcagggagtgctcacccaggggagcagggaccaggtgaggggcaaggacaggcggggagtgctcacccaggggagcagggaccaggtgcgggttgctgcccaaggggtgcagggacagatgagggagggcactgccttcaggcagcacatatgggggccaccatcgctttgttggtggggacagggtccccccttttttttttttttgagatggagtcttgcttttgttgcccaggctggagtgcagtggcatgatcttggctcactgcaacctctgccttccgggttcaagcgattctcctgcctcagcctcccgagtagctgggcttacaggcgcctgccaccgatgcccagctaatttttgtgtttttagtagagacgaggtttcgctatgttggccaggctggtcttgaactcctgacctcgtgatccgcccacctcggcctcccaaagtgctgggattacaggcgtgagctaccgctcccggcctgggg

SEQ ID NO: 61831 - DNA, 601 bp, Human
ggggcaaggacaggcggggagtgctcacccaggggagcagggaccaggtgcgggttgctgcccaaggggtgcagggacagatgagggagggcactgccttcaggcagcacatatgggggccaccatcgctttgttggtggggacagggtccccccttttttttttttttgagatggagtcttgcttttgttgcccaggctggagtgcagtggcatgatcttggctcactgcaacctctgccttccgggttcaagcgattctcctgcctcagcctcccgagtagctgggcttacaggcgccygccaccgatgcccagctaatttttgtgtttttagtagagacgaggtttcgctatgttggccaggctggtcttgaactcctgacctcgtgatccgcccacctcggcctcccaaagtgctgggattacaggcgtgagctaccgctcccggcctggggtccctttttaaaaagtgcactccaaattcgtaccctgggattctaccctccaagggatgccaggcagtgtcagagcttttctgtcatggggcatgcacgtgggtgggtgcagcggtgctgctcaacactgtggtgtcaggacggc

SEQ ID NO: 61832 - DNA, 601 bp, Human
agacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggtgaggccctgctcggtggtaggtggggtcgggaggctgctggcagggccgcccsgagtcaccggagcctctggtggggccgcccggggtcactggagcctctggcggggccgccccatgtcactggcaggtgcgttgaatcatcagtccgtcgtggtgcgagtgccacttcccttcgaggaggttctgtggggagagtgggtttctggccctgtcaccttttcgggaaacagttctgttgggaggcaggtggcccagagcaggccaggccacgccgcaaggagcccgatgttaagttgtgaatgactttcatggcccatgtgcacgctgggcgaagccccggctttaacggcag

SEQ ID NO: 61833 - DNA, 601 bp, Human
cagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggtgaggccctgctcggtggtaggtggggtcgggaggctgctggcagggccgccccgagtcaccggagcctctggtgrggccgcccggggtcactggagcctctggcggggccgccccatgtcactggcaggtgcgttgaatcatcagtccgtcgtggtgcgagtgccacttcccttcgaggaggttctgtggggagagtgggtttctggccctgtcaccttttcgggaaacagttctgttgggaggcaggtggcccagagcaggccaggccacgccgcaaggagcccgatgttaagttgtgaatgactttcatggcccatgtgcacgctgggcgaagccccggctttaacggcaggtgcctgcccggcactcagctc

SEQ ID NO: 61834 - DNA, 601 bp, Human
cacacgtgcccacaaatgcacatgtgcacactaaagcacacgcacacaggcgcacacagccacaaccacgcatacacaggcacacaggctcatctgcacacacatgcctggcacagccccgtgacctgcagcctgcggggtatggcttttgggaacccagatggctatgtgggtcctgtccttgggcggcggttgcaggctgctgaatagtgcaggtccctgtaggcagatgagagtgacgtgggtgatgccagctttttttttttttttttttttgagacggagtctcgctcggtcaccyaggctggagtgcagtggcgcaatctcggctcactgcaagctccgcgtcccgggttcacgccattctcctgcctcagcctcccgagtagctgggactacaggcgcccgccaccacacccggctaatattttgtatttttagtagagatggggtttcactgtgttagccaggatggtcttgatctcctgaccttgtgatccacccacctcggcctcccaaagtgctgggattacaggcgtgagccactgcgcccggcctggtgacgccagcttttactgagttgcggtttgcgctctcttca

SEQ ID NO: 61835 - DNA, 601 bp, Human
gcccgccaccacacccggctaatattttgtatttttagtagagatggggtttcactgtgttagccaggatggtcttgatctcctgaccttgtgatccacccacctcggcctcccaaagtgctgggattacaggcgtgagccactgcgcccggcctggtgacgccagcttttactgagttgcggtttgcgctctcttcagcctggcattttgggcgctgtgtgcttcgcgggcagccgcacatcgtggtttctcaggggtgccgggaggccgtccatcggaggacacaccagcccttcttcrtctgctcccagcgcagggacgcttggctgtttctggatttgggcccttctgaatagaactaactgcccaaatagaactgaatagcactgggctcctcgagcactccacgtccccagcactcaggactgttggtggctttgatgttgagcctgttgtggactccggttgttgaatgttgttccgttgtctagaatgttctagaatgtgtcgttttttctgtttttaaggtttttatctttgatttaaaatattgactatgctctccttagatgaggctttctgtttttatcctgcttggga

SEQ ID NO: 61836 - DNA, 601 bp, Human
ggtttgcgctctcttcagcctggcattttgggcgctgtgtgcttcgcgggcagccgcacatcgtggtttctcaggggtgccgggaggccgtccatcggaggacacaccagcccttcttcatctgctcccagcgcagggacgcttggctgtttctggatttgggcccttctgaatagaactaactgcccaaatagaactgaatagcactgggctcctcgagcactccacgtccccagcactcaggactgttggtggctttgatgttgagcctgttgtggactccggttgttgaatgttgttccgttgtctagaatgttctagaatgtgtcgttttttctgtttttaaggtttttatctttgatttaaaatattgactatgctctccttagatgaggctttctgtttttatcctgcttgggatccactgacttcttggatctctgtgttggtactttttcaaattaactttggaaaaatgtgagccattatttcatgaaacgtttttccatctcagctttgctttgctttgttttgttttgtttttgagatggagtttcactcttgttgcccagcctggagtgcagtggcaccatctcggctc

SEQ ID NO: 61837 - DNA, 601 bp, Human
tgtttttaaggtttttatctttgatttaaaatattgactatgctctccttagatgaggctttctgtttttatcctgcttgggatccactgacttcttggatctctgtgttggtactttttcaaattaactttggaaaaatgtgagccattatttcatgaaacgtttttccatctcagctttgctttgctttgttttgttttgtttttgagatggagtttcactcttgttgcccagcctggagtgcagtggcaccatctcggctcaccacaacctctgcctctcgggttcaagcaattctcytgcctcagcctcccgagtagctgggattacaggcgtgagccaccatgcctggctaattttttatatttttagtagagatggggtttcaccttgttggccaggctggtcttgaactcctgacctcaggtgatccacctgcctcggcctcccaaagtgctgggattacacatgtgagttaccgcgcctcgcctgctttgtttttttttttttttgagacagagtctcgctctgtcacccaggctggagtgcagtggcgtaacctcagctcactgcaagctctgcctcccaggttcgtgccat

SEQ ID NO: 61838 - DNA, 601 bp, Human
tttgtttttgagatggagtttcactcttgttgcccagcctggagtgcagtggcaccatctcggctcaccacaacctctgcctctcgggttcaagcaattctcttgcctcagcctcccgagtagctgggattacaggcgtgagccaccatgcctggctaattttttatatttttagtagagatggggtttcaccttgttggccaggctggtcttgaactcctgacctcaggtgatccacctgcctcggcctcccaaagtgctgggattacacatgtgagttaccgcgcctcgcctgctttgtttttttttttttttgagacagagtctcgctctgtcacccaggctggagtgcagtggcgtaacctcagctcactgcaagctctgcctcccaggttcgtgccattctcctgcctcagtctcccaagtagctgggactacagccgcccgccaccacacccagctaattttttgtatttttagtagagacggggtttcgccgtgttagccaggatggtctccatttcctgacctcgtgatctgcccgcctcggcctcccaaagtgctgggattacaggcgtgagccaccgcgcctggccttgct

SEQ ID NO: 61839 - DNA, 601 bp, Human
ccatgtgcacattcactttggccatcttttcctttaaatctttgaacatgtttgtgctgtttcttagtccattttgtgctgctgtaacagaatgccacagactgggtcatttatttttatttattatttattattttttgagatggagtcttgctctgttgcccaggctggagtgcagtggtactatcttggctcaccacaacctccgcctcccgggttcaagcaattctcctgcctcagcctcccgagtagctgggattacaggcgcccgtcaccacacccagctaatttttgtattttyagtagagacagggtttcactgtgtgttggttggctaggctggtctcaaactcctgacctcgtgatctacctgcctcagcctcccaaagtgctagggttacaggcatgagccactgcacctggccagatcatttataatgaacagaaattgatgggctcaccgttctggaggctggtgagccccagattgagggtggcgtctggcaaagaccttcttgccatgtcatggcaagaaggcatggtggaaggcaggacggcacagaccggagggggctggattcgccctttagtcaggaaccca

SEQ ID NO: 61840 - DNA, 601 bp, Human
ctggaggctggtgagccccagattgagggtggcgtctggcaaagaccttcttgccatgtcatggcaagaaggcatggtggaaggcaggacggcacagaccggagggggctggattcgccctttagtcaggaacccactcccctgctgatggcattcactcatccacgagggcagcgactcagatcctctctctaggccccagccccagccccagcagtgctggattggggaccaggttcccaacacatgacccttggggggtgcatcaaagacacagcactgtgtggagtgacgtctgtgstgcttcttcctcccttgtcacggtcacacctccctcactcacctgtgggacagcctcactgggcgtggccgtggtgtgtgccgtgaggtgtggagggtgccgtctcccggcttgagcgctgagtttgtccccgtggctcaccttgtttctgtcaggttggtttcagcgttgctggggcaaggctgagggtaaacatgagcgactccaaggccagggagccctgtgccaaggtgtggaccttttgggttctcagctgaagtagagaatccagggaggaccccgcactccggccattggagc

SEQ ID NO: 61841 - DNA, 601 bp, Human
gaccttttgggttctcagctgaagtagagaatccagggaggaccccgcactccggccattggagctgtggcgtcctccctcctgtgtgtcccccggaacctcctgagcctctctggagctgttctctgccaggccccgtgggctctcctgccctctgcatgcatcgcgagtactgccggaggaggcccctttggctttcagagcccagagcgcccgacctcctccaggagtctgcagatccacaggcctcagatgctgccacacccacccagcacacacccaggtctctgacacgccagcygcacacagcggtggggttcaggcgaaggtttcttccacagtgcagagtagaagagccgggaaggaccccatcaccatcagatgcatcagagcttcaaaggcccgcccatcaagacgctgccaagagcatgaggccagccaggctggggaggacgttggcgagcatccgcctgcccgtcagggagccacagctggatgatacatcgacagacagcagagggacggtgtagcacacaggcgagggcttgtcctcctcagcctgggggagcgcagctcagtgcttggtggtcagcacgtgact

SEQ ID NO: 61842 - DNA, 601 bp, Human
ccctctgcatgcatcgcgagtactgccggaggaggcccctttggctttcagagcccagagcgcccgacctcctccaggagtctgcagatccacaggcctcagatgctgccacacccacccagcacacacccaggtctctgacacgccagccgcacacagcggtggggttcaggcgaaggtttcttccacagtgcagagtagaagagccgggaaggaccccatcaccatcagatgcatcagagcttcaaaggcccgcccatcaagacgctgccaagagcatgaggccagccaggctggggargacgttggcgagcatccgcctgcccgtcagggagccacagctggatgatacatcgacagacagcagagggacggtgtagcacacaggcgagggcttgtcctcctcagcctgggggagcgcagctcagtgcttggtggtcagcacgtgactgacactttgccggagaaggggacggctgcccgcaggaagagctacacagccgtgttcgccggaactccgctctggagagtcagaactggagacgggagggcgtgcctcaagggcagatgggcaaaccaaaccccatcctccctgtgagcc

SEQ ID NO: 61843 - DNA, 601 bp, Human
ccagcacacacccaggtctctgacacgccagccgcacacagcggtggggttcaggcgaaggtttcttccacagtgcagagtagaagagccgggaaggaccccatcaccatcagatgcatcagagcttcaaaggcccgcccatcaagacgctgccaagagcatgaggccagccaggctggggaggacgttggcgagcatccgcctgcccgtcagggagccacagctggatgatacatcgacagacagcagagggacggtgtagcacacaggcgagggcttgtcctcctcagcctgggggagygcagctcagtgcttggtggtcagcacgtgactgacactttgccggagaaggggacggctgcccgcaggaagagctacacagccgtgttcgccggaactccgctctggagagtcagaactggagacgggagggcgtgcctcaagggcagatgggcaaaccaaaccccatcctccctgtgagccgcggcacagcaccaggcgggcacacgcagcacgacacggcgaggagcccaccgcaggggcagccttttgggcggggaaggggggatgaatccactgtgaatcccacctccgaagggca

SEQ ID NO: 61844 - DNA, 601 bp, Human
ccccatcctccctgtgagccgcggcacagcaccaggcgggcacacgcagcacgacacggcgaggagcccaccgcaggggcagccttttgggcggggaaggggggatgaatccactgtgaatcccacctccgaagggcagcgcaggaaggacacgcaaatgctggactgaacctgcagctgattcagggggcagtgtcctgagctctaaaacttcaaacctggggcagtgtcctgagctctaaaacttcgaaatctgaccaggcacagtggctcacgcctgtaatcccaacactttgggagrctgatgtgggcggatcacctgacgtcaggagttcgagaccagcctggacaacatggagaaagcccatctctagtaaaaatacaaaaattagccaggttgatggtgcctgcctgtaattccagctactcaggaggctgaggcaggagaatcgcttgaacccaggaggcagaggttccagtgagccgtgatcgcgccagtgcactccagcctgggcaacagaacgagactctgctccaaaaagaaaaaaactttgaaatccctctaaaaataaaatggaccggtggatggtagctgtgagga

SEQ ID NO: 61845 - DNA, 601 bp, Human
ggctgcagggaggcacctggtcttccctcgtcctcacgatcctgcaccctcaagatgccacgttgttgaggctgtttagggaacttgacaagctgattggaaactgtgctgaaatagagcccaggtagtgatgcggacagggcagtgccagaaggagccccagcgattcctgtgctgcaaggcacgcccaggacggggcactagccgggggaagaggctctcagggcccaggtgggaccccagcctcagactatgaggtcatgactgtgtacagctcagccaccgggctttgggactttgmatccaccttagcagggtttccaaacccattgtctccacggccaccctgccagtccagctgcagcagggcggaacaaagtggaggcctctttcttgctttcttttttttttttttgagacagagtttctctcttgttgcccaggctggagtgcaatggcaccatctcagctcaccacaaccttcacctcccgggttcaggcaattctcctgcctcagcctccctggtagctgggattacaggcatgcatcaccatgccaggctaattttgtatttttagtagagatggggtttctccatgt

SEQ ID NO: 61846 - DNA, 601 bp, Human
ggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttgggrccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaacccaagtgtagagggatttgtctgggctttccacgaagcttgacctggaacgggcgttgcttccatccccatcctgcctgtccgggacgagtccggagcggctggcggcctccggtaacagaaaccgactgatgaggcggaaggtaaggaagatggaagc

SEQ ID NO: 61847 - DNA, 601 bp, Human
gaaggcaagtgtctgttaaggtgtgtgtatcttttctaagtggactttcgcatcccagagcagatatgtctctctcaaagtaccactgtgccctcggcccgaaacatgggaatatacagaggtacctagactttcttggagtattagatattatgcatgattaatatgttatttttcaatgtaaaattttaattttgcaatttttttgttattgcaaattgtatttgaaggggtgtctctccattctctttataaataaagaactataattggctgctcattcttctctaattactgagaycaccttacacattcacttttgaaagatttcaaaccaatgcaattttattttagttacctgttaaggaaaattttatatttttacctgtggtttcaggtaaatacaaaggcatatgactgtctccattaatgcatttgtaccacttaatgacagcatttttttgggatggatacaacatcatccattttgatcttagttgtcgaaagaagagtcaagtttttcaccactgatgtgagaaagacacttttaggagagaaagcaaacaacagcaaagcaaaaataggagaaatgggtatggtg

SEQ ID NO: 61848 - DNA, 601 bp, Human
agcagatatgtctctctcaaagtaccactgtgccctcggcccgaaacatgggaatatacagaggtacctagactttcttggagtattagatattatgcatgattaatatgttatttttcaatgtaaaattttaattttgcaatttttttgttattgcaaattgtatttgaaggggtgtctctccattctctttataaataaagaactataattggctgctcattcttctctaattactgagaccaccttacacattcacttttgaaagatttcaaaccaatgcaattttattttagttacytgttaaggaaaattttatatttttacctgtggtttcaggtaaatacaaaggcatatgactgtctccattaatgcatttgtaccacttaatgacagcatttttttgggatggatacaacatcatccattttgatcttagttgtcgaaagaagagtcaagtttttcaccactgatgtgagaaagacacttttaggagagaaagcaaacaacagcaaagcaaaaataggagaaatgggtatggtgtttgatggtaggcactggatgggaggcattgttattctttgacaaaaaacttgcttat

SEQ ID NO: 61849 - DNA, 601 bp, Human
ctagactttcttggagtattagatattatgcatgattaatatgttatttttcaatgtaaaattttaattttgcaatttttttgttattgcaaattgtatttgaaggggtgtctctccattctctttataaataaagaactataattggctgctcattcttctctaattactgagaccaccttacacattcacttttgaaagatttcaaaccaatgcaattttattttagttacctgttaaggaaaattttatatttttacctgtggtttcaggtaaatacaaaggcatatgactgtctccrttaatgcatttgtaccacttaatgacagcatttttttgggatggatacaacatcatccattttgatcttagttgtcgaaagaagagtcaagtttttcaccactgatgtgagaaagacacttttaggagagaaagcaaacaacagcaaagcaaaaataggagaaatgggtatggtgtttgatggtaggcactggatgggaggcattgttattctttgacaaaaaacttgcttatttcttctcaaaatgtagaatacattgtttaaattcctaaatgcctgtcaatgtaacatattgttcaa

SEQ ID NO: 61850 - DNA, 601 bp, Human
tgcatgattaatatgttatttttcaatgtaaaattttaattttgcaatttttttgttattgcaaattgtatttgaaggggtgtctctccattctctttataaataaagaactataattggctgctcattcttctctaattactgagaccaccttacacattcacttttgaaagatttcaaaccaatgcaattttattttagttacctgttaaggaaaattttatatttttacctgtggtttcaggtaaatacaaaggcatatgactgtctccattaatgcatttgtaccacttaatgacarcatttttttgggatggatacaacatcatccattttgatcttagttgtcgaaagaagagtcaagtttttcaccactgatgtgagaaagacacttttaggagagaaagcaaacaacagcaaagcaaaaataggagaaatgggtatggtgtttgatggtaggcactggatgggaggcattgttattctttgacaaaaaacttgcttatttcttctcaaaatgtagaatacattgtttaaattcctaaatgcctgtcaatgtaacatattgttcaaattgagtaagtttcagaaataatcacgg

SEQ ID NO: 61851 - DNA, 601 bp, Human
caagttctcattctgtcaaggtaggatgtttataaacctcaaaattagaagtatgcctatatattttaagatttttccattaatatggtttgtgtcagtcagcccagtagagtcaatgttgacttcattgaaaacgtgtgttattttatctatcaaaagaaagagtttattttgggattaggataggagttgtgtttttgagaaagagttattgttgtgagttatactgtcctggatgtgtgaagataatcaatgcaactattgtatcatgcctttgcattgggcgatggggaaatgtctyatgctcccggaagtgatgcataaccctacaggtttatggtgaattgtttacttagctgccatatgtctcctcttcagtggagtcttcctgctccatttctgtgtggtgtttatatcttcttaaaaaaaccctcaaattgagattaaaaaatattatgcttatattctgcattcatgtgtttaatgaacctctgtgaaataattctgaagaccctcagaaagtccagtctcctattcttgcacctaaagatgtgttccattaatgttcaaatgaagataattcctttatatagaaacttga

SEQ ID NO: 61852 - DNA, 601 bp, Human
cttcagtggagtcttcctgctccatttctgtgtggtgtttatatcttcttaaaaaaaccctcaaattgagattaaaaaatattatgcttatattctgcattcatgtgtttaatgaacctctgtgaaataattctgaagaccctcagaaagtccagtctcctattcttgcacctaaagatgtgttccattaatgttcaaatgaagataattcctttatatagaaacttgaatccttttggtaattacctatatatactttcatgataggtagtattttttattaaaggagattttttgttgytgtttgtttttttagtaaggctactatggaattgttttaactttgaactgagaatgtatgtttgtgctgttattgatataaaatatacagatttgatcactgagaaaaaagtctaacagatgtgcctgagttgtagtttagaggaagatgtgttgtataacaatcgtaaaaaatattagttgaccatacctgttcattgtgaatgtataccactgttttaaaagaagatgctacccatagctaatgttacccattatccataaaggcctttgatcaatcaacctaccaggtctcaaatca

SEQ ID NO: 61853 - DNA, 601 bp, Human
tcatttaggacatgttacacttcaaaatagtacactgattgattgtatttatgtcgagttagtttatgactgtaaatagctggttgcactgatattttaaatgcttaattctgaaaaggctgtagttagtagactacaattagtctgattttagagagaaggaaactgagagttagctatatgtgtgaagatagcccaaggcaagatggcttttgtccatttcctctttgacttgactgtgctactgaggaaacagtaggaaaggagtcaggctgctaactttaaccctgggtatcatttktaatttttcccatggagccaactctaaattctcattcagcattagaagactgaataatcagattgagtgtcagatgtgtaaataacacaaaacttgttaataccaggtagcctctggaatgaattattcttgactttgtcacgtaaatgaatatcagttgcactgaaaagtctaactttgtggagtcttatcaaacaaaagtatttagcagtggcttaaatattgaatatttttattttagattttcaatatgtttatttttgtatgttcaggatttccaaattcaaggcaaagcataat

SEQ ID NO: 61854 - DNA, 601 bp, Human
agaagtcacaaactaagcaatgtctgtgtttttgatttgattagagctgtcatttgttatttaggaatctgtgaatgattattaaagctttcaagtatagccagtcctgctaacataataataacattacattaagggcactcatgttctttcctcctgagaagatgactggttacagggggcacatattgtttgctgaagtgtgtgtatgtgcatgtgcatgtgtgtacctgtatgtgcatttatgatttgtgtgtgtgcatgtgtgattttcccctggcagaaaattgctttggttgtrtcaatttagtgaagaaacagtgtcacccagtggctttgatgaaaacagtcctataaacattatagataagcactgtccagtagaaatacaacacaagccatacatttgattttacattttctagaggccatacacacccaagaaacagatgaaatgaattataataatatgctttatttaacccagcatagcatgtcaacatgtaatcggtgtaaaaaaaatgaaatattttgcattctgtttttttgtgagtctaaatatcttgtgtgtgttttacacttaaagcacatttcagtttgg

SEQ ID NO: 61855 - DNA, 601 bp, Human
acctttatattaacctgatttataacacagtatcaatatttccagttaattatgaatttgcctttaggagtttggtatgtaacagggattgcttatggatacactgtaaacacaacacatgttcatgatgattagtctataattgggttatctaatgtctctttagaaatgaaagtgcttatgtttgtaggtcattatctttgtaacttaggaaactaaaagtcacaagcctgctcctagctttaatggatgaaaattgtaacagtgtctgtaaagggctaacttttcactactgtttatwtaaataccactttcatggaaacacaatgaaaatggttcattctgtgtatagagcagattggagattttgatagtgtggaatttttaaagtaggaatttagattaggtgagttttggagccattttctgagttcactccggtttgcaatttcaaactgatttcagatgaaaaagtctggaaatgtttaatgtcatgtcctctccatcacctttccttatactctatgaattcgttaacaatagccgtaattccaattctacatcaagaaataaagagaaaattatatatggcattttactt

SEQ ID NO: 61856 - DNA, 601 bp, Human
ataattgggttatctaatgtctctttagaaatgaaagtgcttatgtttgtaggtcattatctttgtaacttaggaaactaaaagtcacaagcctgctcctagctttaatggatgaaaattgtaacagtgtctgtaaagggctaacttttcactactgtttatataaataccactttcatggaaacacaatgaaaatggttcattctgtgtatagagcagattggagattttgatagtgtggaatttttaaagtaggaatttagattaggtgagttttggagccattttctgagttcactcyggtttgcaatttcaaactgatttcagatgaaaaagtctggaaatgtttaatgtcatgtcctctccatcacctttccttatactctatgaattcgttaacaatagccgtaattccaattctacatcaagaaataaagagaaaattatatatggcattttactttatatatagatatatagattaacttttaaaaatacatttattatgtgtataacgtttatatctgtgtgtgatgcttttagtgattgggacagggtatattacttatttttacactgcagattaatatagacagatttt

SEQ ID NO: 61857 - DNA, 601 bp, Human
acttttaaaaatacatttattatgtgtataacgtttatatctgtgtgtgatgcttttagtgattgggacagggtatattacttatttttacactgcagattaatatagacagattttatatcatagatacatagattttcacttactagaaattctaaaaagatcaaaaggcaatagaatcatggtatacaaagaagcacatttggacaaaatgaaataatgtggatgctggctcgcttctggtaaaagctgacttaatttagagttcttgaagaagctagctgaagaatgaaatgtcatygtaacacacatctgtttcttgaaagagtttatacttgaatgtaactagtcactgttagctctggctaattttgaagttgatttaaattaatatagaggttgttctggtacttttttttttggtcagtctttttctgttctccatctctatctacatgcacattttctttcatttcattttctttttacctaatagagtcttctccctccgaatgtgtttaaaattttaaggaatgccattctgtctctcccagtaccttgttagaatattgaaataattttatgcaagaatcttgtggtt

SEQ ID NO: 61858 - DNA, 601 bp, Human
tttttcacattcaactaataaattgagagagaacaaactctgactttattttcttccattccatcccacagggctctgacaggtgctcttcagctatcaccttttttatactctagtagtctgcattcttgttagaggttcttactgaatagctgtattttctgaaaagtctaatgtaaagcaaatgttatctccttagcttttaattgtgatcaattacaaaacaaagtttgagatggttgcttccagagatgacattgtgaaattgactttttaaaaatgtcatccaactgccgtgctrgttccatcatgtggaatgatctagaaatttggtagcataattgcagaatcaagttgaactgaaaaatcagaagcttatagggttttattgcagtgataaatttagcttttcagtcatttttctttggtccacctactttttaatagaacttgacttgtgaaaatcaaaaaatttaagtcaaataagaatgttttgttgttgcagttttaatacttagagaagatacagtattgttatatcctctcactgaaatcagagacatatcttttgagtatgttaggcagatgatcatgacattag

SEQ ID NO: 61859 - DNA, 601 bp, Human
tgttctcacaggcagactttttagagagattgctatcactgacaacttccagagtttgagagttttttgaatatactacttaaaaaaatctccatatggttttcatttgaaaaaacatattacaaactgagacattcactataaattaaattgaaataatcaaaatataattaagctatttgtgagtttacattttgcaaaacattttagaagcaaaatcatttaactttgtttgcattttgagacaaggagctaactgtgtgtatcatcttgagtagtgtctgtttttattcctagggaytgttttccctataattggagttgttttttgctaggtaagtaggatccaaataacagcatagttattaaggcagtagcctcgttttgtccacttctcgtcattcctttttacttaaataacaattagatttgctcatcttaacccctttacagagctacagctagagcttttaagtgtttttggtggaacttccttaagcaattaactagtcctaataaaaagtgtgagaattagattgggaatgttggatacatatataactaaacaccgattaagtaagttatctaaaaaataaagtgg

SEQ ID NO: 61860 - DNA, 601 bp, Human
ttaagtgtttttggtggaacttccttaagcaattaactagtcctaataaaaagtgtgagaattagattgggaatgttggatacatatataactaaacaccgattaagtaagttatctaaaaaataaagtggcattcagatatgaaaaccaccataaaaatgagtgccaaaaactaatggtagtatttttgcttgtgcacaaagaagactagatcaaaatcaaatgaataattcctcagttttcaaaaaatattttatggtcttttgagggcataatattagtgcatgtaaaaactagaacsctttatgatttgaaaagaggagaagatgctgagagagacactcttggaagctgggcaggaaatccagccatgcattgcctcaaggtctgtcattagatcaaaagcactcaggggacgatggtctgtgtaagaggtcctaatgctattcacgaactctcctgacattcattagtttccaagacattgattcttattctttaactttttagcacatttatcattttcacttatacatgtatgctaatagcaatcttatgtgaacttttacctcttatatgaccagaattgattaaaaatgtc

SEQ ID NO: 61861 - DNA, 601 bp, Human
ctgtgtaagaggtcctaatgctattcacgaactctcctgacattcattagtttccaagacattgattcttattctttaactttttagcacatttatcattttcacttatacatgtatgctaatagcaatcttatgtgaacttttacctcttatatgaccagaattgattaaaaatgtcggcaagtaagtttgttatttaatatctctgaactttctctattttacattgaatatttgctacattgtaagcattacagtatgactagattcttctttttttctaacttctcccctgttgatrattattcttatataactataatgccatgttaatcaaactattgtttatgaattataacagtaaatgcccctggttaatagattaatcaacctgccttagatgcttttgaagtctgtgaggacattgcttaatttcacctacatataattacatatcatttgacactctctaaatcgagctgtttattgtagttctcaaaatttagtgtgaataaaaattatttgggaaaactattaaaatgcagacgtttaaatactagattatagatcctgtaaccttccagatactctgatttagtta

SEQ ID NO: 61862 - DNA, 601 bp, Human
ttcaaaactttagtgaccctgtctgtaccataagaataatataactgatttcttaacgttgcaaaggttaaattaatgtaataatggacagaggttcttgttaaacactgtgcccagctgaacatgaataatacatattcttgcccattagggccaggtcattgaaggttataatctaaatttcagaaagcactatgtaaaacaatgcaaacaaatttgcatttgattacaaaaactcacaagtcttacaaaatatgaaaatttaatggaagttaattaaaacagtattagggagttaaaktgtaagcaaagccactgccaaatgaggcatcctaggagccagataaggcaacagtagaaggagagagatctgatagggacttcagatgcttcgggtgcttcattgaaaaaggcttaagagagatatttaaaaaaattggtggagtctttgaatgtcttcgtaaaaatgatgcttttgagggtcggttgtgtagtgtgtcctataaccccacgtacagaaacttgatttgtgctttaaatttgacttgtactctagctgccattataacctatattttgtcttgaaaaacaaaattatttt

SEQ ID NO: 61863 - DNA, 601 bp, Human
tagtgagtgtttattttatcacataaaaatattcctcaggatgctgtctctttttaccagcttccacagggctttactctaggccttaaccctcagaccactcttcttccagatttttccacttattgaatgatctttcagtctagtctgaggtagttattttggtttggccctaggagcagcaggagtcctgtggagtctcagtctactcctattggtttcagtttataaattctgcctggagtggtcatctctttcctaacttggttacagacagtccatggatttccacttttgtgayagaagatggaaaaaggtgaggaggaggggacagcagatcacataggccatgaggggtcactgcaagactcgttctgaggcagatgggataccatcaaagggttttgagcaaagaaaggatgttaccagccttatgttgaatagggtgtctcatattctctgtgttgagtgagagtaggtgttacgatgtaagaaggaaaccaattaagattgttgcaataatccagagatggttgggagttggaccaaaatgataatgtcaggggcagattttaaatatatattgaaatcagtactgcca

SEQ ID NO: 61864 - DNA, 601 bp, Human
ttctctgtgttgagtgagagtaggtgttacgatgtaagaaggaaaccaattaagattgttgcaataatccagagatggttgggagttggaccaaaatgataatgtcaggggcagattttaaatatatattgaaatcagtactgccaagttgggtattgatgggctggtatttcctttgaggacagacagagagttcctttaatgttttctcttattttagagaccaaataataaaggaatatttatctttatttcttgctttaaaaatatctgattgggttgacattttttttttttttttctctaattttatcttctgcctacaccttccggaagatatacaaactggagacctgacattcgggaaagtcatgaaatctgcttacatggaaataaattctaatcaagcatctcaaactcttcaaaagttttttagtttgttaggatactataacgttttgtgtaataaaagttggttttgaaattttattttgatataaatgtctttatattttaaaatctgttttaacaagatgaaattttaataaatttgtgtcattcacatgctcttccttttaaagagatgtatttgcagctgata

SEQ ID NO: 61865 - DNA, 601 bp, Human
ctttatttcttgctttaaaaatatctgattgggttgacattttttttttttttttctctaattttatcttctgcctacaccttccggaagatatacaaactggagacctgacattcgggaaagtcatgaaatctgcttacatggaaataaattctaatcaagcatctcaaactcttcaaaagttttttagtttgttaggatactataacgttttgtgtaataaaagttggttttgaaattttattttgatataaatgtctttatattttaaaatctgttttaacaagatgaaattttaatmaatttgtgtcattcacatgctcttccttttaaagagatgtatttgcagctgatactctacctatcttttttaaaaattttaatttaatttaattttaaaattccagaatacatgtgcaggatgtgcaggtttgctatgtaggtaaacatatactatggtgctttgctgcatctatcaacctgtcacctaagtattaaacccagcaagcattaactatttatcctgctttttttcaccctgtcgccccacccgacagactccagcatgttgttcccctccccatgtccatgtgttatcatt

SEQ ID NO: 61866 - DNA, 601 bp, Human
tatttgcagctgatactctacctatcttttttaaaaattttaatttaatttaattttaaaattccagaatacatgtgcaggatgtgcaggtttgctatgtaggtaaacatatactatggtgctttgctgcatctatcaacctgtcacctaagtattaaacccagcaagcattaactatttatcctgctttttttcaccctgtcgccccacccgacagactccagcatgttgttcccctccccatgtccatgtgttatcattgttcagctcccacttataagtgaaaacatgtggtgtttgsttttctgtttctgcattagtttgctaagaataatggcttccagctccatccgtgtccctgcaaaggagacgacctcattcctctttatggctgcatagtattccatggtgtatatgtaccacattttctttatctagtctatcgttgatgggcatttgagttgattccatgtctttgctattgtgaatagtactgctgtgaacataaacatgcatgtatttttataatagaatgactcacattcctttgggtgtattcccagtaatgggattgctgagtaaaatggtattactggttcta

SEQ ID NO: 61867 - DNA, 462 bp, Human
agactccagcatgttgttcccctccccatgtccatgtgttatcattgttcagctcccacttataagtgaaaacatgtggtgtttggttttctgtttctgcattagtttgctaagaataatggcttccagctccatccgtgtccctgcaaaggagacgacctcattcctctttatggctgcatagtattccatggtgtatatgtaccacattttctttatctagtctatcgttgatgggcatttgagttgattccatgtctttgctattgtgaatagtactgctgtgaacataaacatgcaygtatttttataatagaatgactcacattcctttgggtgtattcccagtaatgggattgctgagtaaaatggtattactggttctaggtctttgaggaatcaccacactgtcttccacaatggttgagccaatttacattcccaccaccagtgtaaacgcgt

SEQ ID NO: 61868 - DNA, 582 bp, Human
aatatatatataaatatatataaaatatatatataaatatatataaaatatatataaatatatataaatatatataaaatatatataaatatataaatatatataaatatatatataaatatatataaatatatataaatatatataaatatatatataaatatatataaatatataaaaatatatataaatatataaaaatatatataaatatataaaaaataaaaatataaatataaatatattaattatattaatatattatattatattatagtataktatagtataataaaaaaatactaaaaaaaaattgccattctgactggcatgtgatggtatctcaatgtggttttggtttgcatttctctaatgatcggtgatgttgagctttttttcatgtttgttggccacataaatgtcttcttttgagaaatgtctgtttatggcctttgtccactttttaatggggttggggttgtttgtttttttcttttttcttctttctttttttctggtagagttggggtttcaccatgttggccagactggtctccgtctcctgacctcaagtgatccacc

SEQ ID NO: 61869 - DNA, 601 bp, Human
tatattatagtatattatagtataataaaaaaatactaaaaaaaaattgccattctgactggcatgtgatggtatctcaatgtggttttggtttgcatttctctaatgatcggtgatgttgagctttttttcatgtttgttggccacataaatgtcttcttttgagaaatgtctgtttatggcctttgtccactttttaatggggttggggttgtttgtttttttcttttttcttctttctttttttctggtagagttggggtttcaccatgttggccagactggtctccgtctcctgacstcaagtgatccacctgccttggcctcccaaaatgtgggattataagtgagagccactgcgcctggcctttttcttgtaaatttaaattccttgtagattctggatattagacctttgtcagatgaatagattgcaaaaattttctcccattctataggttgtttgttcactctgatgattgttttgctatggagaagctctttaattagatccatttctcaatttttgcttttgttgcaattgcttttgatgtttttgtcatgaaatctttgcccatgcctatgtcctaaatgatattgt

SEQ ID NO: 61870 - DNA, 601 bp, Human
aaatactaaaaaaaaattgccattctgactggcatgtgatggtatctcaatgtggttttggtttgcatttctctaatgatcggtgatgttgagctttttttcatgtttgttggccacataaatgtcttcttttgagaaatgtctgtttatggcctttgtccactttttaatggggttggggttgtttgtttttttcttttttcttctttctttttttctggtagagttggggtttcaccatgttggccagactggtctccgtctcctgacctcaagtgatccacctgccttggcctcccamaatgtgggattataagtgagagccactgcgcctggcctttttcttgtaaatttaaattccttgtagattctggatattagacctttgtcagatgaatagattgcaaaaattttctcccattctataggttgtttgttcactctgatgattgttttgctatggagaagctctttaattagatccatttctcaatttttgcttttgttgcaattgcttttgatgtttttgtcatgaaatctttgcccatgcctatgtcctaaatgatattgtccagattgtcttctagggtttttatagttt

SEQ ID NO: 61871 - DNA, 601 bp, Human
ttaagctctagtatagcaaaaacatgagactttcaaagaaaattcaaggctttctctattagtctttgaatagtctgacaaatcccaattccatcaaagacatattgccaatacatcccaggtctttttatagaggaaatacttctattttgtatccatattaactcagactatctgttgacatacagagcacttcagtgataggtgctatataaatatttaaattaggatagctgattgctctgtaagttaggagtttgctaattctacattgtggttaatttctgattatgaaacattktttacatactgcttgggaacaacaaaagataagatattttaaaatgtgtgaaatgaagagtttttaaatcacatgggaaaatacttttgatgagtggaaagtgaaatcatgaaacacaattgaggataggccaaattcacagcagaaaggaaacttgtcaagatgttcattcttgtttatgtgggagaataatgggttatttttacgtacttttatatcttttttctgtattttgtaagttttcaaccctccacacgtattttacaatcagcaaaacaaagctttataaagaaatgtatt

SEQ ID NO: 61872 - DNA, 601 bp, Human
agggaaggattaagatgtgttgaagagctggacatcaggtgtggagtgcatactgggttgtggaaaagacaggtggaaaagacatgtgaaaaagacacatagccctgcttttgtgctgaggagtagaggtgggatgctgggaaattttaagaggtaagataagggggatgtggggccggtgtggagaggggagcaggatgaagacttgagtgttttaagattaggttgaggaatttgatattttatgtgtaccaaacattatattttttaaccaaagagtgatgtgaacagattaaacatrattattctagcagtggattaggtggggacccaaatggacacaaggaggcgtttaagagggtattgtgaaagtcctgggtagagacattgaagatttattaagatagtagtggtgggcaggaaaggtgatttaagaaaaaaaaaaaaaaaactgcagttgggaggattagcttgtgattgatagtggaaggtgttaacaaagggcatgaacgccacttaaaactgtgaacctgagaaactagaaagatagtggcgctggtcactgagaaaaaaagcatcagatcagtttttgtttatttta

SEQ ID NO: 61873 - DNA, 601 bp, Human
tactgggttgtggaaaagacaggtggaaaagacatgtgaaaaagacacatagccctgcttttgtgctgaggagtagaggtgggatgctgggaaattttaagaggtaagataagggggatgtggggccggtgtggagaggggagcaggatgaagacttgagtgttttaagattaggttgaggaatttgatattttatgtgtaccaaacattatattttttaaccaaagagtgatgtgaacagattaaacatgattattctagcagtggattaggtggggacccaaatggacacaaggaggcrtttaagagggtattgtgaaagtcctgggtagagacattgaagatttattaagatagtagtggtgggcaggaaaggtgatttaagaaaaaaaaaaaaaaaactgcagttgggaggattagcttgtgattgatagtggaaggtgttaacaaagggcatgaacgccacttaaaactgtgaacctgagaaactagaaagatagtggcgctggtcactgagaaaaaaagcatcagatcagtttttgtttattttagtttcggggtgaaggagggaagatgatgtgtttggtttggacatattcag

SEQ ID NO: 61874 - DNA, 601 bp, Human
gctgggaaattttaagaggtaagataagggggatgtggggccggtgtggagaggggagcaggatgaagacttgagtgttttaagattaggttgaggaatttgatattttatgtgtaccaaacattatattttttaaccaaagagtgatgtgaacagattaaacatgattattctagcagtggattaggtggggacccaaatggacacaaggaggcgtttaagagggtattgtgaaagtcctgggtagagacattgaagatttattaagatagtagtggtgggcaggaaaggtgatttaagaaaaaaaaaaaaaaaactgcagttgggaggattagcttgtgattgatagtggaaggtgttaacaaagggcatgaacgccacttaaaactgtgaacctgagaaactagaaagatagtggcgctggtcactgagaaaaaaagcatcagatcagtttttgtttattttagtttcggggtgaaggagggaagatgatgtgtttggtttggacatattcagtgtatgttacttttgcaacctcatgtgaccctgtctccttgaagctgctcaattttcttagttcacaaaaaaatattttaatacc

SEQ ID NO: 61875 - DNA, 601 bp, Human
ttaaccaaagagtgatgtgaacagattaaacatgattattctagcagtggattaggtggggacccaaatggacacaaggaggcgtttaagagggtattgtgaaagtcctgggtagagacattgaagatttattaagatagtagtggtgggcaggaaaggtgatttaagaaaaaaaaaaaaaaaactgcagttgggaggattagcttgtgattgatagtggaaggtgttaacaaagggcatgaacgccacttaaaactgtgaacctgagaaactagaaagatagtggcgctggtcactgagaaaaaaagcatcagatcagtttttgtttattttagtttcggggtgaaggagggaagatgatgtgtttggtttggacatattcagtgtatgttacttttgcaacctcatgtgaccctgtctccttgaagctgctcaattttcttagttcacaaaaaaatattttaataccacaaccacgttagttcaccgtattttcctgattagtatgtacatgctttttagaactggagcttcttgtgcccagcctatcactacaaacacagaaatgttgtaggctttggacatttcaatttgtgcaaag

SEQ ID NO: 61876 - DNA, 601 bp, Human
ccatcagatctcatgagacttattcactaccacaagaacagaatgggggaaactgctgccatcattcagttacctcccaccagttccctcccagaactatgggaattatgggaggtacaattcaagataagatttgggtggggacacagccaaactatatcagtctccaacacaaagaaagataaatgtttaaggtgatgtatcatccagttacctgatttgattattacacattgtatacatatatccaaacgttacatataccccaaactatgtacaactctgatgtatcaattaaaawgtaaagaaaaacaaaacagaaaaaaagctggaaaaggaaggcttgagatttgatgcactaaattctgtgtacttttggaaataatattaacataaggtggcaccgttaatggtgaaatgaacttttcatcctaggtgcaccctttgagatggcaggcacaatggctctttgtcttctacaagggtgattatcacatggtaggctttttcaaacactaacctgccttcgattctgatatgttctctctagggcacctcccaacctcctgaatcaatgctgtagtgagccacagttactgat

SEQ ID NO: 61877 - DNA, 601 bp, Human
gtgtgtcacatccatcaggtatgttgacgtgagagaaaaagtttacaaatcgcagctctataaacttgaacctagaagggcatgaacctaatttgtggaccacgcaagcatttactttcctgtacaaagttcctgtaaggagaaatttaaataaatatagtgtagaggaagggcctttccaggagtttctttaacatcagtgaaatattcttgcaagaggcaatatttgactcagtattttcattggtcatttagattttacttttgactttaattactggtattctagccttcaatggtwgactgtttcatgtttctccagaaagttaggtttcatttttattttctatagtttatgagtccatgcttgtaacttatagggaaatcataaaaacagaacagagtgtagttagaacactgaacttctaaaaggatatccctgccttagagatggtatataatactttttcatgagttgggataaataagaaacctctttgtggcactttgggcaagaaaagaagttttgctgtagttaacattgtgatgaaatggactattaatctgaagagttgcacctggaattttttaactaatgtag

SEQ ID NO: 61878 - DNA, 601 bp, Human
ctgtcactcaggctgaagtgcagtggcatgatcatagctcactgtaaccttgaacacttacgctcaagtgaccctctggccttggcatcccaaaacactgggattacaaacatgagccactgcacttggcctattcttccatattgtcatattgcttaattttgttttcaaaaaacatacattccttttgtaatttagaaaacaagtattataaatgaaaaaaaccctcatagctccccaatataaatggtgaaaaatataatcgttaaaacattcctcttctaatttataaggttacccytttttgctggtttatctctattagttggttttcctcttcagtcacctttctaaaagtggataagctgtaggacccattaacattttactggcatgataaagctggtcatgttgatgcctttatcgcctaagctggcatgtagtgctattgtgaagccagtacagtttcgtctgggtggtgagtagaggaaaagtgcagaagaatttagaacttgaatgtctaaagccagaactctatccttgaccaagtcttccctaataatttattaaaaacttcaatagaaatatagaaagcatatta

SEQ ID NO: 61879 - DNA, 601 bp, Human
tggataagctgtaggacccattaacattttactggcatgataaagctggtcatgttgatgcctttatcgcctaagctggcatgtagtgctattgtgaagccagtacagtttcgtctgggtggtgagtagaggaaaagtgcagaagaatttagaacttgaatgtctaaagccagaactctatccttgaccaagtcttccctaataatttattaaaaacttcaatagaaatatagaaagcatattatttaaacttccagttgacaaaaactggaagacatacatactagcttagatgattgartatcagtttcaaaatatgcatagagttgaataacgagtaaacattaaattttaaaaatatttaatttaaaaatatttaaaaggagaaaaggtaaatttctataaatttagatttaggaataattttataatttcatgatgagagaagctggaccattatctaatgcccgttacctaagggttagtttgccacagttcattgaactgtctcttagactagattttgaaagcaaacttttcagaatcctttgctatgtttgtagcattgtgaccagttctgcttgctgtattttaagaggag

SEQ ID NO: 61880 - DNA, 601 bp, Human
aacttgaatgtctaaagccagaactctatccttgaccaagtcttccctaataatttattaaaaacttcaatagaaatatagaaagcatattatttaaacttccagttgacaaaaactggaagacatacatactagcttagatgattgagtatcagtttcaaaatatgcatagagttgaataacgagtaaacattaaattttaaaaatatttaatttaaaaatatttaaaaggagaaaaggtaaatttctataaatttagatttaggaataattttataatttcatgatgagagaagctggrccattatctaatgcccgttacctaagggttagtttgccacagttcattgaactgtctcttagactagattttgaaagcaaacttttcagaatcctttgctatgtttgtagcattgtgaccagttctgcttgctgtattttaagaggagtattgatcactatgaagtggtcagaaagcctggaattagtcaaatccctgctctgccatgtattaactctgtggctttaggtaaattgtaatgcttaatctctcaaagcttaggttttcttatatagaaaattttttttaagctaccccaga

SEQ ID NO: 61881 - DNA, 601 bp, Human
ttcatgatgagagaagctggaccattatctaatgcccgttacctaagggttagtttgccacagttcattgaactgtctcttagactagattttgaaagcaaacttttcagaatcctttgctatgtttgtagcattgtgaccagttctgcttgctgtattttaagaggagtattgatcactatgaagtggtcagaaagcctggaattagtcaaatccctgctctgccatgtattaactctgtggctttaggtaaattgtaatgcttaatctctcaaagcttaggttttcttatatagaaaattttttttaagctaccccagaaaaatgttttggggattgactgagattataaagatgctaataataataacttaataaaccttgtatgttgcttactctaagccaagctaaattctaaaaatgtatgtttgtaagtacatttaattctcattagtactctgaggttgatactgttgttctcattttacagctgaagacacaggcacagtgagcctgtctctatatatgtctctctatatgtctttatatatgtctctatatattctagtaaatcatagttaaaaatttttgtgcatatgag

SEQ ID NO: 61882 - DNA, 601 bp, Human
attgtaatgcttaatctctcaaagcttaggttttcttatatagaaaattttttttaagctaccccagaaaaatgttttggggattgactgagattataaagatgctaataataataacttaataaaccttgtatgttgcttactctaagccaagctaaattctaaaaatgtatgtttgtaagtacatttaattctcattagtactctgaggttgatactgttgttctcattttacagctgaagacacaggcacagtgagcctgtctctatatatgtctctctatatgtctttatatatgtstctatatattctagtaaatcatagttaaaaatttttgtgcatatgagtgctagacatggtatcatgtgtttatatacctttgttaatttttgccagaagaaggaagttgggcttatctcaataaacgttttgagcccttttggtacctataaagatacatataaagaattatacttatggtatatctcaaaactgagtttgtttcctataacccatactaaaaacaatttatcaagttaatatagtaatatattgtgtaagtatacatgtataatatagtaagatgtatatgataatata

SEQ ID NO: 61883 - DNA, 601 bp, Human
cagtgagcctgtctctatatatgtctctctatatgtctttatatatgtctctatatattctagtaaatcatagttaaaaatttttgtgcatatgagtgctagacatggtatcatgtgtttatatacctttgttaatttttgccagaagaaggaagttgggcttatctcaataaacgttttgagcccttttggtacctataaagatacatataaagaattatacttatggtatatctcaaaactgagtttgtttcctataacccatactaaaaacaatttatcaagttaatatagtaatatrttgtgtaagtatacatgtataatatagtaagatgtatatgataatatatgttcaagttaatatagcataattagcaaaatcataattgggttcaaataatattattgactgatactttaaaatatttcccaactattatgctgttccatttacttttaaaaaaaatagagatattcttttcaatttagagtgtaaaataattgcctcctccgtatatattttaaagatggcctataaactagattcattaattcaaaattactaaaataggcaactcagtaacaaagagaatcagctcat

SEQ ID NO: 61884 - DNA, 601 bp, Human
taacaaagagaatcagctcattttcttagatgctaacaaaactaattatacaaattctgacaaagtggacattgcaaatgaatgaaaataaaaggattgttcacgatcttattgattaaataaggagaggctttgactgagtagatgatttattgaatacttaattgaacattaattgattatttaaatcattttaaagaatcagtagtattcatccctccatgagaatgacaggttttttttttttgttttttttttcgggagtactggcaatcaccatctgattcagtctaacgttttytggctggggcaggaactctgaactttatttccaaatgagtaataatgataaacaatcctagaggaaagtgggaaaatgcctgatggcttattggcgggaaaaagaagggtgtgtgagaggaggaattattcagttatcactggtctggagaagaaagagcatggcccatttgcaaaaatgattcttagttcacttttttttttttttttgcctttagtgatattatgggtaatagcgataaatttttattttctcaatttatatatatcagatttctcactctgtgtcatcaattaattc

SEQ ID NO: 61885 - DNA, 601 bp, Human
agatttctcactctgtgtcatcaattaattcattcaaatccatttccaaaactttaatctcgttaaccttgccaatactgttttgaaaatctgtcttgagtttctgagttataaacagcctcatattttcataaatatgaaagaaagccatcaaaaaaactgcacttatttttttagccttggtttctctgtattctgtaaaatgatatagcctaataagagagctttactctagtggccttcattatagcccatgtgcaggatgattctgaaatatataaattaaatgaatggaaacagrcatgttgacaagtttgtttagcaccaacgattggatatgctattcttaaaccaaaacttttgtttactcattcattcctagaatttcagtattttaagaagtctcagtgctacaggatttcctgtatttttttaaaatgtggtaacatatacataaaatttaccatgttaaccatttttaaatatacagttcagtgacattaagtacatttacattgttgggcaactgaaaccacagtccacttccggaactttttcatcttcccaaactgatactctatgcacatttaaacaacaactt

SEQ ID NO: 61886 - DNA, 601 bp, Human
tctcactctgtgtcatcaattaattcattcaaatccatttccaaaactttaatctcgttaaccttgccaatactgttttgaaaatctgtcttgagtttctgagttataaacagcctcatattttcataaatatgaaagaaagccatcaaaaaaactgcacttatttttttagccttggtttctctgtattctgtaaaatgatatagcctaataagagagctttactctagtggccttcattatagcccatgtgcaggatgattctgaaatatataaattaaatgaatggaaacagacatgytgacaagtttgtttagcaccaacgattggatatgctattcttaaaccaaaacttttgtttactcattcattcctagaatttcagtattttaagaagtctcagtgctacaggatttcctgtatttttttaaaatgtggtaacatatacataaaatttaccatgttaaccatttttaaatatacagttcagtgacattaagtacatttacattgttgggcaactgaaaccacagtccacttccggaactttttcatcttcccaaactgatactctatgcacatttaaacaacaacttcccat

SEQ ID NO: 61887 - DNA, 601 bp, Human
taccatgttaaccatttttaaatatacagttcagtgacattaagtacatttacattgttgggcaactgaaaccacagtccacttccggaactttttcatcttcccaaactgatactctatgcacatttaaacaacaacttcccattccctcttcctcccagcccctggtaactaccattccactttctgtctccatgaatttaactattcttgatatcttatatgagtggattcatgatgtttgtccttttatgactggcttagtttacttggcataatgtcttcagagttcatccatgtygtagcacatgtcagaatttccttcctttttaaggctgaataatattccattatatacgtatgccatattttgtttatccatttattattgatggatacttgggttgctttcactttttgtttattgtacatatgttgctatgaatatgtgtgtatgaataggaagatttttatattgtttaaaagtggcaataatgtgaactttttgtataacatcaccaagttgacaaaggagctgcagcaaatgtgggtggttttactgcattttaaaaactagaacaccttcttaaactgatcctaa

SEQ ID NO: 61888 - DNA, 601 bp, Human
ttggcttgtctttacatacaggattcagactattaaaaagctgatagaaaaagcttaaaatactattattttagtaatcctagagaagcaaagaagcctcttaacaaataacaaaaatgtgggcataaataacacatttatttcaagataacttaatgcttttttattaggctctttttggaactaatgaaactattatccaaggaggagataaattaaatttccacctacaagatcagtatagcaatattctgaattcaaaattctgttgttaaggatggtgtaaccatatatgacaagscttttacaaactcctttttgaacattgctttaagcaatcatttgtgtatttgtattaattttcaatctaatcattccaaatgaggcaaagttttgtgtaccagtgattgaattagaagaaagaacaagttattttgtatagtctaaaagctttgtaagaatcctctgcttgcagtgtttgcacagttctccattagccctgtcgtgttttcttcttctttgagacatccattagtagatactttaacactaatccgttttctgtcccaaatacataggagtccaggagccagggatgcag

SEQ ID NO: 61889 - DNA, 601 bp, Human
tagaaaaagcttaaaatactattattttagtaatcctagagaagcaaagaagcctcttaacaaataacaaaaatgtgggcataaataacacatttatttcaagataacttaatgcttttttattaggctctttttggaactaatgaaactattatccaaggaggagataaattaaatttccacctacaagatcagtatagcaatattctgaattcaaaattctgttgttaaggatggtgtaaccatatatgacaaggcttttacaaactcctttttgaacattgctttaagcaatcatttstgtatttgtattaattttcaatctaatcattccaaatgaggcaaagttttgtgtaccagtgattgaattagaagaaagaacaagttattttgtatagtctaaaagctttgtaagaatcctctgcttgcagtgtttgcacagttctccattagccctgtcgtgttttcttcttctttgagacatccattagtagatactttaacactaatccgttttctgtcccaaatacataggagtccaggagccagggatgcaggtgtcattttaccttctagtagtctatttttgtgttctggtgca

SEQ ID NO: 61890 - DNA, 601 bp, Human
tgtcctagtttatggccgtatcactttgtagttggatgggctgttgcagtaacttctcaactggtctccctaccctcatgccatctgaatattaatttattcattgaactaccacactacatcttcttgatgtacagctctaatcaggcagcagttttgttgaatgttaatatttaatcatgtaaatcctttgataaaaagtagtttgtagttgttttttgcctttcaaatgaaataaatacctccttgtttgggattcaggaccctctctaatctacccttcttaacattcagtcatttyaaactgctactgccttcatcacatcaattttctagtgactttgaagcgtgccttttctctctcaagacagagataggtagatctcttgaggtcctacttctgtctaccacattattgccctctgcccctaattctcatctctctatcctgatctccaaccagcttaggttgaaattttacccatcttctacctgcttcacgatgtgttttctgatcatccccgttggaagctctttctccttcctctgagtctccatagcgctgtatctattgctgtcttacggcacttacattctccgt

SEQ ID NO: 61891 - DNA, 601 bp, Human
gtgaatagttttataagtgagggtgagttccttgaggatgatcaatgtataattgagcccacctctcctgcgccccacattatttattgcagtgccatgtagatgcttaacaaatgtttttgaggcaatgagatatcatcataatttgaatgcaggtagtgcttggaaatttagataatatcttaagtatatgttatctcattaaatctgataacaatagtgtggaatttggtgattatccccagttgatgaatggtacttaggaattcacagacataggttcagtatgtatctgtggagmtttgtggatagttgtgctgctggggaagttgttaggtagaagtccaagttaaacagtagggagctaacaagacctcctgggaaattggatcctggatttcttttttttaattctttttttgagagagagtctcactctgctgtgcagtggcacgaccttggctcactgcagcctccgcctcccgggtcaagcaattctcctggctcagcctcccaagtaggtgggattacaggtgtgtgccaccacgccctgctaatttttgtatttttagtacagatgtggttttgctatgttggccag

SEQ ID NO: 61892 - DNA, 601 bp, Human
agcttcaaataaaaacaaacaaaatgttaggactatcaattctaataaatttttatttaggtttttctggcacagttagaaatttagttatatataatacatatgtagatacatatatatatgtatcttgagagacgttagattagacatggtaggcactcaatttctgaaaattttcaaactctataatttagttactctttagatttctacttcaacttcctaatgaattattttctttcaaaggctcttcctggaatttttctgtttttggcaggtatgtttgcatatctcaagtgasacaatttggccaggtttctgaaaaagaatactttaaaagaaaaatgtaggttggctcttaagtgttttaatgttatttgagataaactaaaatagagcataatcatatggtatattaataggaatatgtgctgatttcttaagccccattcaaattttacgatagtttttgtttcttttaataaatttgtttggtttataactttatctcaggggggatatattattattttttcctcatttcttgagtgaaattttagcagaagtgacttaattataatcttggagatgcatgttgctt

SEQ ID NO: 61893 - DNA, 601 bp, Human
gtggcgaccatacttaaagtctgctctcttagcaaactttgagtaaatgatacagtatttttaactatattgtaaattagatccccagaacatgtgaacttactcatcttgtaactgaaagtttctacctttggaccaacatctccctattccctccaccttccagcgcttgacaatcaccattctaccctctgtttttatgagttcaactttcttagattccacatgtaagtgagatcatgtggtatggcttatttcacttagcatgatatcctacaggttcacccatgttgtgcaaatrgtaggattttctcctttttatggctgaatagtatttcattgtgtatgcacacacatacatatacacacatcacatgttctttatccatttatatattgttgaacacttaggttgtttcaatgtcttggctttgtaaatagtgctgcaataaacatgggagggcagatatctctgtgacatgctgtttttatttcctttgcatgtatacccataaatgagattgctggatcttagggcagttctgtttttaagtttttgaggaatctcagtgttgtttttcgtaatcagtttactaaatta

SEQ ID NO: 61894 - DNA, 601 bp, Human
gtatggatatacagttttccaagcaccatttattaaagacatattctttccccattgtttattctgtgcccttgttaaggattaggtgaccgcatgtgcataggtttatttctgggctctctgttctgttctattggtctatgtgatagacatcctgtcttatgctgcttttctgccttattggaggcaaaagtcactggtatactatacagtttgggatcagcatagatgttgattacaggctctgtgatctagagaaagttacttagcatctctgtgccttttctttctctatttaatrgggacaatatttcctatctccaaatgttattacttaatcttgagataatttgcttacagcatctgtcaaagtgccaaacatatagcaggtacacaatataattttgttttcctcataaatacatggttaggttcagcatggttattcatgaaaaacttcttttaaaaaattgagcaactgaataaattctaattgaatggctgaattatttgaaaggcaaaaaaggcaggcaataaagttagtctgaagtatcttcatgtaggtattcttggtgtagaagtgtagtaactctaaatctag

SEQ ID NO: 61895 - DNA, 601 bp, Human
ttatgctgcttttctgccttattggaggcaaaagtcactggtatactatacagtttgggatcagcatagatgttgattacaggctctgtgatctagagaaagttacttagcatctctgtgccttttctttctctatttaatagggacaatatttcctatctccaaatgttattacttaatcttgagataatttgcttacagcatctgtcaaagtgccaaacatatagcaggtacacaatataattttgttttcctcataaatacatggttaggttcagcatggttattcatgaaaaacttyttttaaaaaattgagcaactgaataaattctaattgaatggctgaattatttgaaaggcaaaaaaggcaggcaataaagttagtctgaagtatcttcatgtaggtattcttggtgtagaagtgtagtaactctaaatctagcaaaacaagctttattcccatatactgtagctgattaccaagttcccagagggaggttggtggtgctttggggtccagtttattagattggattagatggggtagatgcaagaagatataccagcattcccaattccttccaatacaaagattttgtgg

SEQ ID NO: 61896 - DNA, 601 bp, Human
gccttattggaggcaaaagtcactggtatactatacagtttgggatcagcatagatgttgattacaggctctgtgatctagagaaagttacttagcatctctgtgccttttctttctctatttaatagggacaatatttcctatctccaaatgttattacttaatcttgagataatttgcttacagcatctgtcaaagtgccaaacatatagcaggtacacaatataattttgttttcctcataaatacatggttaggttcagcatggttattcatgaaaaacttcttttaaaaaattgarcaactgaataaattctaattgaatggctgaattatttgaaaggcaaaaaaggcaggcaataaagttagtctgaagtatcttcatgtaggtattcttggtgtagaagtgtagtaactctaaatctagcaaaacaagctttattcccatatactgtagctgattaccaagttcccagagggaggttggtggtgctttggggtccagtttattagattggattagatggggtagatgcaagaagatataccagcattcccaattccttccaatacaaagattttgtggcttattaaattttta

SEQ ID NO: 61897 - DNA, 601 bp, Human
tcattaaagagtttcttttcataagggtcatttttcatttttatttcaaagattaaatggatttatacataattatttcaacatgacatctgttctcattttttcctttcagagctttcttcccaaatattccatgtttgtattttgtaaaccatacaaacaagttttaaaggaaaatatataatcctgagtgattacataatttattgccgttctctatcttatgcttttaattttatttaatgcatgtcttaagtttttcaacagacttttctaaatgccatgataatattaagctctktgacaacattaattatgtgtacatatattatttcgattgcacagtttttgagtgcaatgatggatccattgagaatgaggattctggaaagctctaaaagagtggcttgtgtatttttccttcttcctttttacccgctttcctctctccctccctttcttctggaaatgggaatttttttaatgaaatttcatgcaaattcaatgaatgaatggtaaaacaaatctgatccaaactattgacagaagtggaggcaggcacagaactccagcctcttcatcatctcctcgtttcctcctg

SEQ ID NO: 61898 - DNA, 601 bp, Human
attaagctctgtgacaacattaattatgtgtacatatattatttcgattgcacagtttttgagtgcaatgatggatccattgagaatgaggattctggaaagctctaaaagagtggcttgtgtatttttccttcttcctttttacccgctttcctctctccctccctttcttctggaaatgggaatttttttaatgaaatttcatgcaaattcaatgaatgaatggtaaaacaaatctgatccaaactattgacagaagtggaggcaggcacagaactccagcctcttcatcatctcctcrtttcctcctgaattccttttcatgtagtttcttggacagatgcatctggaatctgaaagtaatatttaatagagtattcacattcttaatagttgttatatttgtaagtcagcgacacaggttgaagccacaagcaatatttagtcttgaataggttttactttttaaaattctatttgagcttttttcttttttattaattgtggtcatttctacaactctttctagaaaactgtatttctcagatttgaatatatttgttattattagctctcttatttaaagatgaactaagtttct

SEQ ID NO: 61899 - DNA, 601 bp, Human
tatttgagcttttttcttttttattaattgtggtcatttctacaactctttctagaaaactgtatttctcagatttgaatatatttgttattattagctctcttatttaaagatgaactaagtttcttaaggacaaaaaagaaaataatttttacctacaatttgatactatgtagagagaacattttctttcagaaatgatcaaaattgtgaaatctttgatagatggaagaaagtagttgtctttgcttgtaatgaatactttcaaaataaagtcgctgaataaaaatagtgatcttaygaaatattatagttggatatcatcagagaggtgatattataaatcttctaccccagataatgattttttaatagtctttctgttacaaatgtttagtcactactgaaatacattatatgaaagagagctcaccacaaatcaaaccaatacaaaggagtattacaaggaaaaaggctttgaatccaagtgcacattggagcaagctgctattcttttacagattaactatttgttattgcgcattcagcaaattccttagcttttggtcttctgtctactaaaggaaaatttaaattccag

SEQ ID NO: 61900 - DNA, 601 bp, Human
tgtatttctcagatttgaatatatttgttattattagctctcttatttaaagatgaactaagtttcttaaggacaaaaaagaaaataatttttacctacaatttgatactatgtagagagaacattttctttcagaaatgatcaaaattgtgaaatctttgatagatggaagaaagtagttgtctttgcttgtaatgaatactttcaaaataaagtcgctgaataaaaatagtgatcttacgaaatattatagttggatatcatcagagaggtgatattataaatcttctaccccagatartgattttttaatagtctttctgttacaaatgtttagtcactactgaaatacattatatgaaagagagctcaccacaaatcaaaccaatacaaaggagtattacaaggaaaaaggctttgaatccaagtgcacattggagcaagctgctattcttttacagattaactatttgttattgcgcattcagcaaattccttagcttttggtcttctgtctactaaaggaaaatttaaattccagctctgcaagtttgttgagtaataatataaatggattatctcatagacaaatgttttaaaa

SEQ ID NO: 61901 - DNA, 601 bp, Human
tgttattattagctctcttatttaaagatgaactaagtttcttaaggacaaaaaagaaaataatttttacctacaatttgatactatgtagagagaacattttctttcagaaatgatcaaaattgtgaaatctttgatagatggaagaaagtagttgtctttgcttgtaatgaatactttcaaaataaagtcgctgaataaaaatagtgatcttacgaaatattatagttggatatcatcagagaggtgatattataaatcttctaccccagataatgattttttaatagtctttctgttrcaaatgtttagtcactactgaaatacattatatgaaagagagctcaccacaaatcaaaccaatacaaaggagtattacaaggaaaaaggctttgaatccaagtgcacattggagcaagctgctattcttttacagattaactatttgttattgcgcattcagcaaattccttagcttttggtcttctgtctactaaaggaaaatttaaattccagctctgcaagtttgttgagtaataatataaatggattatctcatagacaaatgttttaaaataaaatattgctataggatacttgc

SEQ ID NO: 61902 - DNA, 601 bp, Human
atggaagaaagtagttgtctttgcttgtaatgaatactttcaaaataaagtcgctgaataaaaatagtgatcttacgaaatattatagttggatatcatcagagaggtgatattataaatcttctaccccagataatgattttttaatagtctttctgttacaaatgtttagtcactactgaaatacattatatgaaagagagctcaccacaaatcaaaccaatacaaaggagtattacaaggaaaaaggctttgaatccaagtgcacattggagcaagctgctattcttttacagattarctatttgttattgcgcattcagcaaattccttagcttttggtcttctgtctactaaaggaaaatttaaattccagctctgcaagtttgttgagtaataatataaatggattatctcatagacaaatgttttaaaataaaatattgctataggatacttgctatattgaaccaaaaactgccttgtaactttgactcctttgtcctagtgtttattttctatcctacatgtctgttaggattcccaagtcttgctgtccccaggctaaagctattcattgaattcaactgtccattgtctg

SEQ ID NO: 61903 - DNA, 601 bp, Human
agtctttctgttacaaatgtttagtcactactgaaatacattatatgaaagagagctcaccacaaatcaaaccaatacaaaggagtattacaaggaaaaaggctttgaatccaagtgcacattggagcaagctgctattcttttacagattaactatttgttattgcgcattcagcaaattccttagcttttggtcttctgtctactaaaggaaaatttaaattccagctctgcaagtttgttgagtaataatataaatggattatctcatagacaaatgttttaaaataaaatattgctrtaggatacttgctatattgaaccaaaaactgccttgtaactttgactcctttgtcctagtgtttattttctatcctacatgtctgttaggattcccaagtcttgctgtccccaggctaaagctattcattgaattcaactgtccattgtctgacctcattttcatattccttaaacattgctcttccctgggatgcactagttaaatcttattgtggtattgggctatccttttttgtagccatcctcagggaagccacacttgtttggcatgaccctgttgtcttggctgcactcaatt

SEQ ID NO: 61904 - DNA, 601 bp, Human
gctctgcaagtttgttgagtaataatataaatggattatctcatagacaaatgttttaaaataaaatattgctataggatacttgctatattgaaccaaaaactgccttgtaactttgactcctttgtcctagtgtttattttctatcctacatgtctgttaggattcccaagtcttgctgtccccaggctaaagctattcattgaattcaactgtccattgtctgacctcattttcatattccttaaacattgctcttccctgggatgcactagttaaatcttattgtggtattgggctrtccttttttgtagccatcctcagggaagccacacttgtttggcatgaccctgttgtcttggctgcactcaattgtacgtccccaagctgagcagtgagattctgattcaggcattcagtattgggaccaagggagagttaagttagtcttttccaacatgcaaaagctgtagggcttgaagcagagaaagtcaattcacagagaaaatgaaacataatttctgttctttctgctagtgtggggagaggaagagggatctcagttacttcaggactttcatgattcttactctacttcttc

SEQ ID NO: 61905 - DNA, 601 bp, Human
gaaacataatttctgttctttctgctagtgtggggagaggaagagggatctcagttacttcaggactttcatgattcttactctacttcttcctgaagctacaccgtgatcctgccctttgttctagaaataaccacctccgtcagctacctagagttagtttctgatactgcagttactatttttcatcaaaagatgatgtttgttttgttgttgttgttgttttgggtgagaaccattaagatgtgtcctgtgatatcatttttacttgtcaattatgtctccataatttttaaaagaygctgttcattataagaccttcccaattcagaggtatcaaaatgtgaaaaaaatactttaatatagcaatctattttgaaaacatctctgttaaaatctagggctcagaattgaacatgaaaactggctcccctcttcccctgaaatggtggcactaaaataaaagccaacatatttcctgttctgtccacagagcccttatctcttgtctccagaaacctatgaaacatttccatttagatgtccccatcaaacgtatttcacaattcatgctcttctgccttgtcaggctggatctcct

SEQ ID NO: 61906 - DNA, 601 bp, Human
ctagtgaccaaagagagtaatttgggatttttttcttctttcaaattttggcatttatttttaaattaatattttaaatcatggtataatacacataacaaagtttaccatcttggtcatttttaagtgcacattttaatggtaataagttaattcacattgttgtgcaaccatcatcaatatccatcttcagaactctttccattttacaaaactgaaacactgtacccactaagaaattactccccatttcttcctttaccaagcctctggtagccaccattccactttctgtccctawgaatttgactactttaggtaccttttagaagtaaaataggacagtatgtgtctttttttgtgactagcttattttacttggcataatgtattcaaggtttatgtgtattgtagcatgtgtcagagttttgacatttcttgtgttgacattattctgctacttactcttttttttttcctatctttatgctgtcgctgacaactagaaggcctaaggttttattactttgcacctgcgctactgaaataatgtcctaacaggtctctggagattccctccctgcttactgtcataatctgt

SEQ ID NO: 61907 - DNA, 601 bp, Human
tgactactttaggtaccttttagaagtaaaataggacagtatgtgtctttttttgtgactagcttattttacttggcataatgtattcaaggtttatgtgtattgtagcatgtgtcagagttttgacatttcttgtgttgacattattctgctacttactcttttttttttcctatctttatgctgtcgctgacaactagaaggcctaaggttttattactttgcacctgcgctactgaaataatgtcctaacaggtctctggagattccctccctgcttactgtcataatctgtaatgcrtgaatagtctttatatacatggctttcttctggttgttgacaataggactatcatgaatggacctccatgggtggttagtgcaatgtagaggtccgagataaccccattcttgctaaaaacattacacattttcatctaatgtccccgacgtagtctatcccttcaatgtaatttccgagacctttacaatataggtagaccctttaaaaaattaccgtgtgcttaaatttatattccaccattgttagccaaggaccttcatttcaattttatagtcatttaattttctcagtgtttat

SEQ ID NO: 61908 - DNA, 601 bp, Human
tttaggtaccttttagaagtaaaataggacagtatgtgtctttttttgtgactagcttattttacttggcataatgtattcaaggtttatgtgtattgtagcatgtgtcagagttttgacatttcttgtgttgacattattctgctacttactcttttttttttcctatctttatgctgtcgctgacaactagaaggcctaaggttttattactttgcacctgcgctactgaaataatgtcctaacaggtctctggagattccctccctgcttactgtcataatctgtaatgcgtgaatartctttatatacatggctttcttctggttgttgacaataggactatcatgaatggacctccatgggtggttagtgcaatgtagaggtccgagataaccccattcttgctaaaaacattacacattttcatctaatgtccccgacgtagtctatcccttcaatgtaatttccgagacctttacaatataggtagaccctttaaaaaattaccgtgtgcttaaatttatattccaccattgttagccaaggaccttcatttcaattttatagtcatttaattttctcagtgtttatatctgtg

SEQ ID NO: 61909 - DNA, 601 bp, Human
taccttttagaagtaaaataggacagtatgtgtctttttttgtgactagcttattttacttggcataatgtattcaaggtttatgtgtattgtagcatgtgtcagagttttgacatttcttgtgttgacattattctgctacttactcttttttttttcctatctttatgctgtcgctgacaactagaaggcctaaggttttattactttgcacctgcgctactgaaataatgtcctaacaggtctctggagattccctccctgcttactgtcataatctgtaatgcgtgaatagtctttttatacatggctttcttctggttgttgacaataggactatcatgaatggacctccatgggtggttagtgcaatgtagaggtccgagataaccccattcttgctaaaaacattacacattttcatctaatgtccccgacgtagtctatcccttcaatgtaatttccgagacctttacaatataggtagaccctttaaaaaattaccgtgtgcttaaatttatattccaccattgttagccaaggaccttcatttcaattttatagtcatttaattttctcagtgtttatatctgtgtcttct

SEQ ID NO: 61910 - DNA, 601 bp, Human
ccttttagaagtaaaataggacagtatgtgtctttttttgtgactagcttattttacttggcataatgtattcaaggtttatgtgtattgtagcatgtgtcagagttttgacatttcttgtgttgacattattctgctacttactcttttttttttcctatctttatgctgtcgctgacaactagaaggcctaaggttttattactttgcacctgcgctactgaaataatgtcctaacaggtctctggagattccctccctgcttactgtcataatctgtaatgcgtgaatagtctttatctacatggctttcttctggttgttgacaataggactatcatgaatggacctccatgggtggttagtgcaatgtagaggtccgagataaccccattcttgctaaaaacattacacattttcatctaatgtccccgacgtagtctatcccttcaatgtaatttccgagacctttacaatataggtagaccctttaaaaaattaccgtgtgcttaaatttatattccaccattgttagccaaggaccttcatttcaattttatagtcatttaattttctcagtgtttatatctgtgtcttcttc

SEQ ID NO: 61911 - DNA, 601 bp, Human
ggacagtatgtgtctttttttgtgactagcttattttacttggcataatgtattcaaggtttatgtgtattgtagcatgtgtcagagttttgacatttcttgtgttgacattattctgctacttactcttttttttttcctatctttatgctgtcgctgacaactagaaggcctaaggttttattactttgcacctgcgctactgaaataatgtcctaacaggtctctggagattccctccctgcttactgtcataatctgtaatgcgtgaatagtctttatatacatggctttcttctgrttgttgacaataggactatcatgaatggacctccatgggtggttagtgcaatgtagaggtccgagataaccccattcttgctaaaaacattacacattttcatctaatgtccccgacgtagtctatcccttcaatgtaatttccgagacctttacaatataggtagaccctttaaaaaattaccgtgtgcttaaatttatattccaccattgttagccaaggaccttcatttcaattttatagtcatttaattttctcagtgtttatatctgtgtcttcttctttttgcctttaattccc

SEQ ID NO: 61912 - DNA, 601 bp, Human
tctctggagattccctccctgcttactgtcataatctgtaatgcgtgaatagtctttatatacatggctttcttctggttgttgacaataggactatcatgaatggacctccatgggtggttagtgcaatgtagaggtccgagataaccccattcttgctaaaaacattacacattttcatctaatgtccccgacgtagtctatcccttcaatgtaatttccgagacctttacaatataggtagaccctttaaaaaattaccgtgtgcttaaatttatattccaccattgttagccaaggrccttcatttcaattttatagtcatttaattttctcagtgtttatatctgtgtcttcttctttttgcctttaattcccctcagccaaaaatttcagcatacttatgatctatccaaatatgtgttctgtgtatagcttatctttttcattaaaacttcactattgtttcagccctgtatagttcacttagttacacgtgtaattttaaacactgttgttgactgtgttgtactggttagaagccatattaactagatttcagtttcttgaaaatttatacattagcaagcatagtgtaaat

SEQ ID NO: 61913 - DNA, 601 bp, Human
ccctttaaaaaattaccgtgtgcttaaatttatattccaccattgttagccaaggaccttcatttcaattttatagtcatttaattttctcagtgtttatatctgtgtcttcttctttttgcctttaattcccctcagccaaaaatttcagcatacttatgatctatccaaatatgtgttctgtgtatagcttatctttttcattaaaacttcactattgtttcagccctgtatagttcacttagttacacgtgtaattttaaacactgttgttgactgtgttgtactggttagaagccayattaactagatttcagtttcttgaaaatttatacattagcaagcatagtgtaaatatgtattaagtgggcaataaatatttgctgtgttagtggcattttaatagtacatgatggaataaatgatagatgtgttgtaaaagcttttattgcatgattgccagtttctacctcattgttgtttctaaatctcccacttttaatttacctgaaagtgctttaatgtgtgaaaatatttaagaaattattagtgttccttttttctcctgagaatcacacggacaactttttttgatttaatc

SEQ ID NO: 61914 - DNA, 601 bp, Human
attttctcagtgtttatatctgtgtcttcttctttttgcctttaattcccctcagccaaaaatttcagcatacttatgatctatccaaatatgtgttctgtgtatagcttatctttttcattaaaacttcactattgtttcagccctgtatagttcacttagttacacgtgtaattttaaacactgttgttgactgtgttgtactggttagaagccatattaactagatttcagtttcttgaaaatttatacattagcaagcatagtgtaaatatgtattaagtgggcaataaatatttgytgtgttagtggcattttaatagtacatgatggaataaatgatagatgtgttgtaaaagcttttattgcatgattgccagtttctacctcattgttgtttctaaatctcccacttttaatttacctgaaagtgctttaatgtgtgaaaatatttaagaaattattagtgttccttttttctcctgagaatcacacggacaactttttttgatttaatctatattttgtctagcattatcccaacattagaagtagttaatgtatccataggcaattgttagatacatatgtaagaaagtga

SEQ ID NO: 61915 - DNA, 601 bp, Human
cctacatggaatatggggtatgtgtaaagaatattgtttagccctattttttcgtttgtttcttttgaactactccgttttccttaactctccttatctttttctgaatgaccttaaactcaaggtagtcgttgagtgggagggatgatttttagccatctttttcctccaactcaggtagataggatttaccagcttggccttaatttcctcctttctgttaacattgaaaaccatcatactaactgtaaaaatcaaatactgtaataagagtgagggagtgcatgttttaaagtctgtmgctatattagctcataccacatatgtggcaagaagcagatactgtacaaatcagttcaataatgaggcattgaaacacaagttacatactgtgctaggaataaaatgataaacagagtaacactattctgtccttttggatttttatagtttagtaggaatgtattaagtaatgacaagtacatgaatatgattaaagggatgtaaaatactgaatagcaaagggattttactttgtctatgggaccagtgaaaacctttgagaaagtgttctttaaacaaagacttgaaagttgagcag

SEQ ID NO: 61916 - DNA, 601 bp, Human
tccttatctttttctgaatgaccttaaactcaaggtagtcgttgagtgggagggatgatttttagccatctttttcctccaactcaggtagataggatttaccagcttggccttaatttcctcctttctgttaacattgaaaaccatcatactaactgtaaaaatcaaatactgtaataagagtgagggagtgcatgttttaaagtctgtcgctatattagctcataccacatatgtggcaagaagcagatactgtacaaatcagttcaataatgaggcattgaaacacaagttacatacygtgctaggaataaaatgataaacagagtaacactattctgtccttttggatttttatagtttagtaggaatgtattaagtaatgacaagtacatgaatatgattaaagggatgtaaaatactgaatagcaaagggattttactttgtctatgggaccagtgaaaacctttgagaaagtgttctttaaacaaagacttgaaagttgagcaggaggtagccaggcataaaggaacccagagagttttccaagtggagttttccaaaaagcatgtgtgaagacttgcaagcttgtgcaaccca

SEQ ID NO: 61917 - DNA, 601 bp, Human
gtcgttgagtgggagggatgatttttagccatctttttcctccaactcaggtagataggatttaccagcttggccttaatttcctcctttctgttaacattgaaaaccatcatactaactgtaaaaatcaaatactgtaataagagtgagggagtgcatgttttaaagtctgtcgctatattagctcataccacatatgtggcaagaagcagatactgtacaaatcagttcaataatgaggcattgaaacacaagttacatactgtgctaggaataaaatgataaacagagtaacactatyctgtccttttggatttttatagtttagtaggaatgtattaagtaatgacaagtacatgaatatgattaaagggatgtaaaatactgaatagcaaagggattttactttgtctatgggaccagtgaaaacctttgagaaagtgttctttaaacaaagacttgaaagttgagcaggaggtagccaggcataaaggaacccagagagttttccaagtggagttttccaaaaagcatgtgtgaagacttgcaagcttgtgcaacccaccattttttttgttgttgctgttctgttttgttttgc

SEQ ID NO: 61918 - DNA, 601 bp, Human
tacatactgtgctaggaataaaatgataaacagagtaacactattctgtccttttggatttttatagtttagtaggaatgtattaagtaatgacaagtacatgaatatgattaaagggatgtaaaatactgaatagcaaagggattttactttgtctatgggaccagtgaaaacctttgagaaagtgttctttaaacaaagacttgaaagttgagcaggaggtagccaggcataaaggaacccagagagttttccaagtggagttttccaaaaagcatgtgtgaagacttgcaagcttgtrcaacccaccattttttttgttgttgctgttctgttttgttttgctttaggattttagcagcctgaagccatggatctttgtttctgtctctagttttaagtggaaaagtgggctgaggaaggggcttcactggcccagcaagaaacagaaatttggaacccatgactgtatttctcctgtggacaccccctgcctaggacaagagagagctgtgctgtagaatgctggggaaatggaaaggcagcattggtggaacagagagcatggagaaatcgtcagtgctgggaaattgtgggagct

SEQ ID NO: 61919 - DNA, 601 bp, Human
gcatggagaaatcgtcagtgctgggaaattgtgggagctgagcaacaagtgtgagatgagacaggtgggggccaaatgatgcagggcctagctctacttgtcaaggattttgaaatgaaccttaaaggaagctatttaaaggcttagtcaagggcctattatggtgtgatttgtgttttaaagtagccattcacctgcattatggagaatgaaatgaaaggaagccaggagtaaatgtgggaaaaccagcagccaggacagtggaggagagcatctttgaccagtgtgatggtacgggagrgtgaaaatagatggactttagagacgtttagtaatagttttaaactcatgtgctgtaaattcgatttgattttaagaggtgacaggaaggcaggaggcaacaatagctttcaggtttataccttgagtagttctgtgaaaggtgatgatagataacagaatgtgattcctgagatgagaaaaactggccaaagaacagattctggagagacggcaaagaggaattctgtgatattatacattattgtatgttaatatatagtgtaatatttatgtatacgtatatttgattatatgccta

SEQ ID NO: 61920 - DNA, 601 bp, Human
agatggactttagagacgtttagtaatagttttaaactcatgtgctgtaaattcgatttgattttaagaggtgacaggaaggcaggaggcaacaatagctttcaggtttataccttgagtagttctgtgaaaggtgatgatagataacagaatgtgattcctgagatgagaaaaactggccaaagaacagattctggagagacggcaaagaggaattctgtgatattatacattattgtatgttaatatatagtgtaatatttatgtatacgtatatttgattatatgcctataggatacygattttggaatcatccctccacaaatggccaataaggccacggaattagacaaaatatattgggagcttgtagaaaaagaagcactcttgagaatacaagtacttaacaagagagtagaagtgaatttagggcagacaaccatagatttcaaatcatatagcaggaaaaagtcttgtacatcatccaatctgatataatcaaaatgaagatgaatgaaatgaaattctgtcagactgtataaatttctctaagtcatgcatagaaagtctcctaagtctatgtttcttgtgtaggttttg

SEQ ID NO: 61921 - DNA, 601 bp, Human
agttctgtgaaaggtgatgatagataacagaatgtgattcctgagatgagaaaaactggccaaagaacagattctggagagacggcaaagaggaattctgtgatattatacattattgtatgttaatatatagtgtaatatttatgtatacgtatatttgattatatgcctataggatactgattttggaatcatccctccacaaatggccaataaggccacggaattagacaaaatatattgggagcttgtagaaaaagaagcactcttgagaatacaagtacttaacaagagagtagargtgaatttagggcagacaaccatagatttcaaatcatatagcaggaaaaagtcttgtacatcatccaatctgatataatcaaaatgaagatgaatgaaatgaaattctgtcagactgtataaatttctctaagtcatgcatagaaagtctcctaagtctatgtttcttgtgtaggttttgaaaaatacaattcagcttcctattgatattttgtctgaattgaattatatattgcgaaggtgtcaaaaatgttttcctatgtttaaatttaacaccctttggtggcagcaaattttcaca

SEQ ID NO: 61922 - DNA, 601 bp, Human
atatttatgtatacgtatatttgattatatgcctataggatactgattttggaatcatccctccacaaatggccaataaggccacggaattagacaaaatatattgggagcttgtagaaaaagaagcactcttgagaatacaagtacttaacaagagagtagaagtgaatttagggcagacaaccatagatttcaaatcatatagcaggaaaaagtcttgtacatcatccaatctgatataatcaaaatgaagatgaatgaaatgaaattctgtcagactgtataaatttctctaagtcaygcatagaaagtctcctaagtctatgtttcttgtgtaggttttgaaaaatacaattcagcttcctattgatattttgtctgaattgaattatatattgcgaaggtgtcaaaaatgttttcctatgtttaaatttaacaccctttggtggcagcaaattttcacatctctcttgagtattcaaatttgttaaaatatgaaacacagtgcttggccaaaaacagataatatttgctgaatgaatcaaacgggtttctgagacgatcaattctttaaagatagagactcagttatttgtctttt

SEQ ID NO: 61923 - DNA, 601 bp, Human
ttatatgcctataggatactgattttggaatcatccctccacaaatggccaataaggccacggaattagacaaaatatattgggagcttgtagaaaaagaagcactcttgagaatacaagtacttaacaagagagtagaagtgaatttagggcagacaaccatagatttcaaatcatatagcaggaaaaagtcttgtacatcatccaatctgatataatcaaaatgaagatgaatgaaatgaaattctgtcagactgtataaatttctctaagtcatgcatagaaagtctcctaagtctaygtttcttgtgtaggttttgaaaaatacaattcagcttcctattgatattttgtctgaattgaattatatattgcgaaggtgtcaaaaatgttttcctatgtttaaatttaacaccctttggtggcagcaaattttcacatctctcttgagtattcaaatttgttaaaatatgaaacacagtgcttggccaaaaacagataatatttgctgaatgaatcaaacgggtttctgagacgatcaattctttaaagatagagactcagttatttgtctttttcttctgagccaagtacaaatact

SEQ ID NO: 61924 - DNA, 601 bp, Human
aaatgaaattctgtcagactgtataaatttctctaagtcatgcatagaaagtctcctaagtctatgtttcttgtgtaggttttgaaaaatacaattcagcttcctattgatattttgtctgaattgaattatatattgcgaaggtgtcaaaaatgttttcctatgtttaaatttaacaccctttggtggcagcaaattttcacatctctcttgagtattcaaatttgttaaaatatgaaacacagtgcttggccaaaaacagataatatttgctgaatgaatcaaacgggtttctgagacratcaattctttaaagatagagactcagttatttgtctttttcttctgagccaagtacaaatacttacataacaattatattgaattattgttatttttttcttgtagctattttttctcatggtgtaaactgagggcaataattggcatttttcagagcaaaagtttgatgtttaaaaatctaataaatataaaccactattagacctaaaagtatgtcaaacataatacaactctgattataaagtactcattacttttttgatcataaagattaaactttacaggattgctgataaac

SEQ ID NO: 61925 - DNA, 601 bp, Human
attctgtcagactgtataaatttctctaagtcatgcatagaaagtctcctaagtctatgtttcttgtgtaggttttgaaaaatacaattcagcttcctattgatattttgtctgaattgaattatatattgcgaaggtgtcaaaaatgttttcctatgtttaaatttaacaccctttggtggcagcaaattttcacatctctcttgagtattcaaatttgttaaaatatgaaacacagtgcttggccaaaaacagataatatttgctgaatgaatcaaacgggtttctgagacgatcaatyctttaaagatagagactcagttatttgtctttttcttctgagccaagtacaaatacttacataacaattatattgaattattgttatttttttcttgtagctattttttctcatggtgtaaactgagggcaataattggcatttttcagagcaaaagtttgatgtttaaaaatctaataaatataaaccactattagacctaaaagtatgtcaaacataatacaactctgattataaagtactcattacttttttgatcataaagattaaactttacaggattgctgataaacttaatag

SEQ ID NO: 61926 - DNA, 601 bp, Human
tctcctaagtctatgtttcttgtgtaggttttgaaaaatacaattcagcttcctattgatattttgtctgaattgaattatatattgcgaaggtgtcaaaaatgttttcctatgtttaaatttaacaccctttggtggcagcaaattttcacatctctcttgagtattcaaatttgttaaaatatgaaacacagtgcttggccaaaaacagataatatttgctgaatgaatcaaacgggtttctgagacgatcaattctttaaagatagagactcagttatttgtctttttcttctgagcsaagtacaaatacttacataacaattatattgaattattgttatttttttcttgtagctattttttctcatggtgtaaactgagggcaataattggcatttttcagagcaaaagtttgatgtttaaaaatctaataaatataaaccactattagacctaaaagtatgtcaaacataatacaactctgattataaagtactcattacttttttgatcataaagattaaactttacaggattgctgataaacttaatagcacattttttttttgctttccaaaaaagcttttatttaaagact

SEQ ID NO: 61927 - DNA, 601 bp, Human
tttgctttccaaaaaagcttttatttaaagactttcttttttaaccacagaatgtcaagatagttatgttctatttattgctgatttctccctttctatttttttcctttctttttgtatcatgcccatagcagctgtttccctaacccttaccccaacccacaggctttcccacgctccttttttggctctcatttggcatcgatcctgagtttgacagataaaacatgtgtctgaattgtagttacagccaaactacaatctatcagcttttccctcagggtaattatgcttattttaycccaaaacaaggtaattgttttgtgataaagtattcagttcactcggaataagccgttggcctccttttatctacttatttatttatttatttatttatttatattttttattttttttgagacggagtctcactcagcttcccagaccggagtgcagtggcatcgatttcagcttactgcaaccaccagctcactgcaaccaccgtctcctgggttcaagcgattctcccatctcagcctcccaagtagctgggcttataggcacccgccatcatgcccagctaatttttgtattttag

SEQ ID NO: 61928 - DNA, 601 bp, Human
gataaagtattcagttcactcggaataagccgttggcctccttttatctacttatttatttatttatttatttatttatattttttattttttttgagacggagtctcactcagcttcccagaccggagtgcagtggcatcgatttcagcttactgcaaccaccagctcactgcaaccaccgtctcctgggttcaagcgattctcccatctcagcctcccaagtagctgggcttataggcacccgccatcatgcccagctaatttttgtattttagtagagacggggtttcaccatgttgrccaggctggtcttgaactcctgacctcaggtgatctgcccgcctcggcctcccagagtgctaggattacaggcgtgagccaccatgcccggctggcctccttttatttaattcctcatccaatgataacatgctgacagatgactcaggttctttggagtcagtgtgaatgaagctcatgggatattagaattggagacagaaacagagaggcagtacaggcttcagtgttagacagaaatgggattcagtccaaacttggacacatactaggttgtgactctggatgtgatattcaatt

SEQ ID NO: 61929 - DNA, 601 bp, Human
tggtcttgaactcctgacctcaggtgatctgcccgcctcggcctcccagagtgctaggattacaggcgtgagccaccatgcccggctggcctccttttatttaattcctcatccaatgataacatgctgacagatgactcaggttctttggagtcagtgtgaatgaagctcatgggatattagaattggagacagaaacagagaggcagtacaggcttcagtgttagacagaaatgggattcagtccaaacttggacacatactaggttgtgactctggatgtgatattcaatttctatgwgtttccatttcctcatgtgtaaaatgagataactacaagccttttgaaactttgatcctgaagacgtcgttttggtagatctaaaatgaatacatggtggatcccatcactgttttatttagaaatacaaaatcaaggttattaattctaagatatgcatccatagctctgcagtatccaaagcacagcattaactttagttgcatgaaaatttcccaagttggtatatggatgtatatgaaattggagtggtcatggaaagcatatgtgactttaaaaaatgaaaattctcactcgagg

SEQ ID NO: 61930 - DNA, 601 bp, Human
gcgtgagccaccatgcccggctggcctccttttatttaattcctcatccaatgataacatgctgacagatgactcaggttctttggagtcagtgtgaatgaagctcatgggatattagaattggagacagaaacagagaggcagtacaggcttcagtgttagacagaaatgggattcagtccaaacttggacacatactaggttgtgactctggatgtgatattcaatttctatgtgtttccatttcctcatgtgtaaaatgagataactacaagccttttgaaactttgatcctgaagaygtcgttttggtagatctaaaatgaatacatggtggatcccatcactgttttatttagaaatacaaaatcaaggttattaattctaagatatgcatccatagctctgcagtatccaaagcacagcattaactttagttgcatgaaaatttcccaagttggtatatggatgtatatgaaattggagtggtcatggaaagcatatgtgactttaaaaaatgaaaattctcactcgaggttatcaacacccttggacttaaagatctgattgtgaattgtctaaattatgtgaaacagacaaac

SEQ ID NO: 61931 - DNA, 601 bp, Human
ggttatcaacacccttggacttaaagatctgattgtgaattgtctaaattatgtgaaacagacaaactaccgttaggttgttttcctatgcggaatatttgacaactaaacttaaattcacaaatttaagacatgaatggatataacccacctttgtatgtgaatgcatgtgtgtgtatgtgtgtgtgtcactaaatggtcacaatttaaaacaagaccagaattaagcattcaaaaaacatttattaagcagccactatgtgccaggaatagtagaataaataaaatcttctaaagtttrcagttactttaaagtactccaaatttaggcatacttcacacgtgctatataaaacataaaacaacttaattcttcattagtgtgtatttcagttgcatctttaggctttttctgaatgccttcattacttcttaaagccctcaagaaattatgaaaactcagaaggcaacctatctgatttcttaaatttaaatttcctggttaatttatttagattatttgaaaattcttctttgcccaggtacctcacacatacatggactatactacttggtcacttttaatttagaaggaacttcc

SEQ ID NO: 61932 - DNA, 601 bp, Human
ctgattgtgaattgtctaaattatgtgaaacagacaaactaccgttaggttgttttcctatgcggaatatttgacaactaaacttaaattcacaaatttaagacatgaatggatataacccacctttgtatgtgaatgcatgtgtgtgtatgtgtgtgtgtcactaaatggtcacaatttaaaacaagaccagaattaagcattcaaaaaacatttattaagcagccactatgtgccaggaatagtagaataaataaaatcttctaaagtttgcagttactttaaagtactccaaatttargcatacttcacacgtgctatataaaacataaaacaacttaattcttcattagtgtgtatttcagttgcatctttaggctttttctgaatgccttcattacttcttaaagccctcaagaaattatgaaaactcagaaggcaacctatctgatttcttaaatttaaatttcctggttaatttatttagattatttgaaaattcttctttgcccaggtacctcacacatacatggactatactacttggtcacttttaatttagaaggaacttcctttaggaacagatactttgtatagctgt

SEQ ID NO: 61933 - DNA, 601 bp, Human
ggttgttttcctatgcggaatatttgacaactaaacttaaattcacaaatttaagacatgaatggatataacccacctttgtatgtgaatgcatgtgtgtgtatgtgtgtgtgtcactaaatggtcacaatttaaaacaagaccagaattaagcattcaaaaaacatttattaagcagccactatgtgccaggaatagtagaataaataaaatcttctaaagtttgcagttactttaaagtactccaaatttaggcatacttcacacgtgctatataaaacataaaacaacttaattcttyattagtgtgtatttcagttgcatctttaggctttttctgaatgccttcattacttcttaaagccctcaagaaattatgaaaactcagaaggcaacctatctgatttcttaaatttaaatttcctggttaatttatttagattatttgaaaattcttctttgcccaggtacctcacacatacatggactatactacttggtcacttttaatttagaaggaacttcctttaggaacagatactttgtatagctgtaaattatttaaattcacatgaaatcactctttatattcaaagtacat

SEQ ID NO: 61934 - DNA, 601 bp, Human
ttaagcattcaaaaaacatttattaagcagccactatgtgccaggaatagtagaataaataaaatcttctaaagtttgcagttactttaaagtactccaaatttaggcatacttcacacgtgctatataaaacataaaacaacttaattcttcattagtgtgtatttcagttgcatctttaggctttttctgaatgccttcattacttcttaaagccctcaagaaattatgaaaactcagaaggcaacctatctgatttcttaaatttaaatttcctggttaatttatttagattatttgmaaattcttctttgcccaggtacctcacacatacatggactatactacttggtcacttttaatttagaaggaacttcctttaggaacagatactttgtatagctgtaaattatttaaattcacatgaaatcactctttatattcaaagtacataaggtgagatgtagtttctttttcttataaatttatcctattaagggaataaattggctattttatttaaaacagaaatagaaattttatgaatgatggttgggaactttaaccaaaatgtacataatgtgcataaatgatgggaaac

SEQ ID NO: 61935 - DNA, 601 bp, Human
cagccactatgtgccaggaatagtagaataaataaaatcttctaaagtttgcagttactttaaagtactccaaatttaggcatacttcacacgtgctatataaaacataaaacaacttaattcttcattagtgtgtatttcagttgcatctttaggctttttctgaatgccttcattacttcttaaagccctcaagaaattatgaaaactcagaaggcaacctatctgatttcttaaatttaaatttcctggttaatttatttagattatttgaaaattcttctttgcccaggtacctcayacatacatggactatactacttggtcacttttaatttagaaggaacttcctttaggaacagatactttgtatagctgtaaattatttaaattcacatgaaatcactctttatattcaaagtacataaggtgagatgtagtttctttttcttataaatttatcctattaagggaataaattggctattttatttaaaacagaaatagaaattttatgaatgatggttgggaactttaaccaaaatgtacataatgtgcataaatgatgggaaactttgtttctgcaactagaattcatgct

SEQ ID NO: 61936 - DNA, 601 bp, Human
atcattagttagcagagttatttatgtgacattatgtggcatgccttaatttttagaaccagtttactttttcaaaaaatacattgcagtacacaaaagtcctgtagaaaaaggtcatttgaagtcttatattagaatgatataatttccttttttgttttactttgagttttaaaaattgatttatttggaaacagattagcaagtccccaattatatctttagatactggtatattaaagaatattttacaaaatcacagtatcaaccatagcctcgagaggtaaaacttatcctattyttaatttccagtggtagcactttgtaaataaaaattatggtgtatgtgccaaaagcctggacttttgtctggcaaaggttgtttaaaacttgaagagacatcaagaaatatgtgagttcatccacccagatctagccagaactgcttttgaatggttctgtggctcatttaggcaattaaagccttgtgattgccctattaaaagtctgaaagtatgcatataacccaccagtgttttacagaggaataataggtaagatttataaaacatctgaaatgaaaaaaatgtaggataataaa

SEQ ID NO: 61937 - DNA, 601 bp, Human
tgtgacattatgtggcatgccttaatttttagaaccagtttactttttcaaaaaatacattgcagtacacaaaagtcctgtagaaaaaggtcatttgaagtcttatattagaatgatataatttccttttttgttttactttgagttttaaaaattgatttatttggaaacagattagcaagtccccaattatatctttagatactggtatattaaagaatattttacaaaatcacagtatcaaccatagcctcgagaggtaaaacttatcctatttttaatttccagtggtagcactttrtaaataaaaattatggtgtatgtgccaaaagcctggacttttgtctggcaaaggttgtttaaaacttgaagagacatcaagaaatatgtgagttcatccacccagatctagccagaactgcttttgaatggttctgtggctcatttaggcaattaaagccttgtgattgccctattaaaagtctgaaagtatgcatataacccaccagtgttttacagaggaataataggtaagatttataaaacatctgaaatgaaaaaaatgtaggataataaaagcaggtatttgttgagtacttac

SEQ ID NO: 61938 - DNA, 601 bp, Human
caccagtgttttacagaggaataataggtaagatttataaaacatctgaaatgaaaaaaatgtaggataataaaagcaggtatttgttgagtacttactgagtgttcgaggcagcgtacttagataatctctgagttttgttatacgtattaaatgagttaatataaagcacatatgtgcctggcacataaatgttatgtatttacagtaacaacaataacagttgtcattgatttaattatacattattatcctaaaaataacagaaaatcaatagatgggagagccgggattggaattscaggctgtctgtctctgaagtccattctccatatcactgagctattctagttttcctaggtagagaatctaggatggccaaaaaatgtccccagagcctccctgtaagctgtcctccacaacagacttctggaatagaaagaagttggcttatgacctcttgtcactgcctagtccttgggtgtgataaagttatttaaactgtttgaactcctccttctgtaagcaggggatatcagtaatatcaatcctaaatgtgtcgggaggattaaatgagataatgcatgcatattgctgctga

SEQ ID NO: 61939 - DNA, 601 bp, Human
aatgtaggataataaaagcaggtatttgttgagtacttactgagtgttcgaggcagcgtacttagataatctctgagttttgttatacgtattaaatgagttaatataaagcacatatgtgcctggcacataaatgttatgtatttacagtaacaacaataacagttgtcattgatttaattatacattattatcctaaaaataacagaaaatcaatagatgggagagccgggattggaattgcaggctgtctgtctctgaagtccattctccatatcactgagctattctagttttcctrggtagagaatctaggatggccaaaaaatgtccccagagcctccctgtaagctgtcctccacaacagacttctggaatagaaagaagttggcttatgacctcttgtcactgcctagtccttgggtgtgataaagttatttaaactgtttgaactcctccttctgtaagcaggggatatcagtaatatcaatcctaaatgtgtcgggaggattaaatgagataatgcatgcatattgctgctgaacacaaagtctgtcacataataggtactcaataaaggaaggctgtccttgttgctttg

SEQ ID NO: 61940 - DNA, 601 bp, Human
gaatagaaagaagttggcttatgacctcttgtcactgcctagtccttgggtgtgataaagttatttaaactgtttgaactcctccttctgtaagcaggggatatcagtaatatcaatcctaaatgtgtcgggaggattaaatgagataatgcatgcatattgctgctgaacacaaagtctgtcacataataggtactcaataaaggaaggctgtccttgttgctttgaggaatgcagatgactgattccattggttctgagtgctcagtttgtggcctgactgaattatgtgcaccagatytggtggtaggtttttgtgaattgacctcaccccggttgcatcttagcttttctccaccttttaggggatatactttcctcagccgtttcatttaaattgtatttaatgtggttatatttttaaaaggtggtttttaaaggctttcttttttaaccacagaatgtcaagatagttatgttctgtttattgccgatttctctctttctgtttttttcctttctttttgtatcatgcccgtggcaactgtttccctaacccttgattagcttactttctgaaataagagcgtaaaataataaa

SEQ ID NO: 61941 - DNA, 601 bp, Human
tgcaccaccatgtcccactgtttttgttttttgtttttttcaattttcttttagagacagggtctctaaaagacgctgtgttttttagttccaaggatgcttttcaaaatatcgagtttcacaaaaaataaagtcaagatatgttgcttcatgtggctaatgtttttgttccattttataataaaatgtaaatattaaattctcatataactcattagagaaccacaaataaatgcatttacttaataaataatttattttaaattatatgacaaccctatgattaaatttaatattgtattttttttttttttttttgagacaaagtctcactctgtcacccaggctggagtgcagtggctgtgatctcggctcactgcaacatctgcctccgaggttcaagtgattcttctgcctcagcctcttgagtagctgggattacagatgtgtgccaccatgcctggctaattcttttatgtttagtagatatggggtttcaccatgttggccaggctagtctcgaactcctgacctcaagtgatccacccaccttggtgaggacacagagccaaaccgtatcgaatatcattaaaaagaaact

SEQ ID NO: 61942 - DNA, 601 bp, Human
ggaataagctagcatccgagaggaatgaaactccattggtaatgacaagtagcaggactcttggccaagagttaagttggggcaggaagtttgaactgactgctgaattgggggacattcagggcaattgtacacgtattgcaagggacagggaggctccaggtgacagcttggttacatgattttttttcaagagcaatgtacaggaagcacaggccttactttttattgttgtatggagcagagtcccagaaggaccggctgtggagtgctgaataaaatccctgtgaatgcacaccgrgttctctgaaaatacaagcttctagtcatttctgggttaaggtgtagtccatttcgctttgctatcagattacacataagttattgagcaataaaaggaagaatgtcttgttctttattcatatgttctaaatctggtaggccatcgaactgtactttaataagaataggggaaggacaggtatacgagtgttggacttgttccatattgtcccatttggcagaacaggaccaaaaagtagtctttttctttttttctgatcattagaggtatttaagagcagaaacaaagtttggtggg

SEQ ID NO: 61943 - DNA, 601 bp, Human
cacataagttattgagcaataaaaggaagaatgtcttgttctttattcatatgttctaaatctggtaggccatcgaactgtactttaataagaataggggaaggacaggtatacgagtgttggacttgttccatattgtcccatttggcagaacaggaccaaaaagtagtctttttctttttttctgatcattagaggtatttaagagcagaaacaaagtttggtggggataaaatagagaacactgaaatggtaaaaccacaataatattgacaaataggatagttatattagacaaaamcatgttccttgagtctggaaattgttagtgtcaagttacactatgtattaaggcaccgtaacatattgtggcactgacttttaggcacatatatttgtatatctttctaatttttttcaaaagtggatttttctgccatttatatttgccatcgtataaataaaatttttatgttttgatgttcaacagccattttatactaataggagctctaactgtgacaatcaaataaattaatgtttttatacatgtctttatcggacttaaatctgtgttcacaccagataacaactcaagact

SEQ ID NO: 61944 - DNA, 601 bp, Human
ttggcagaacaggaccaaaaagtagtctttttctttttttctgatcattagaggtatttaagagcagaaacaaagtttggtggggataaaatagagaacactgaaatggtaaaaccacaataatattgacaaataggatagttatattagacaaaaccatgttccttgagtctggaaattgttagtgtcaagttacactatgtattaaggcaccgtaacatattgtggcactgacttttaggcacatatatttgtatatctttctaatttttttcaaaagtggatttttctgccatttatrtttgccatcgtataaataaaatttttatgttttgatgttcaacagccattttatactaataggagctctaactgtgacaatcaaataaattaatgtttttatacatgtctttatcggacttaaatctgtgttcacaccagataacaactcaagactgtgactatgctattggctatgaggagtgttgctttaattgcagcgaagttaatctgtagaatttaacaattatgttgccatctatcttaagggtttataactctggtatagaataagcaaatagcataaaacacttgtacctgt

SEQ ID NO: 61945 - DNA, 601 bp, Human
gttttgatgttcaacagccattttatactaataggagctctaactgtgacaatcaaataaattaatgtttttatacatgtctttatcggacttaaatctgtgttcacaccagataacaactcaagactgtgactatgctattggctatgaggagtgttgctttaattgcagcgaagttaatctgtagaatttaacaattatgttgccatctatcttaagggtttataactctggtatagaataagcaaatagcataaaacacttgtacctgtgtgtactcctcagagttttattggtaataaaaaaaaaaaaaaaaaccacccatgctcacttttgtgcttgggaacagaatctgtttctaacctttgctattaacaggaagtgggagaggtgaaatgagccctggttttgtggccgggccagagcactctgtgttcctgagagtggtattcaggtttcatgtctgtctagcttcttgctcctttgaatagctggcctttgaagtgctaaaaacatagattggtaatgagcaatgtaaagtaaagagtgggaaaatatttggaaaattcaagctctgagaatagcctgtctgggatgattt

SEQ ID NO: 61946 - DNA, 601 bp, Human
atagattggtaatgagcaatgtaaagtaaagagtgggaaaatatttggaaaattcaagctctgagaatagcctgtctgggatgatttggctcaggctgtgttgtaactgtgtttttctttcccaggtaaattgtgaagttttatgaatataatagtataaatttcctctataagaataattgaaaaatctcaacttcacttgcgtttttggtagaacgattgctatatttagtttaaaattttagggcggcaggccgggcgcaatggctcacgcctgtaatcctagcactttgggaggccraggtgggcggatcactaggtcaggagatcgagaccatcctggctaacatggtgaaactccatctctactaaaaatacaaaaaattagccgggcatggtggcgggcacctgtagtcccagctactcgggaggctgaggggagaatggcgtgaacccgggaagtggagcttgcagtgagccaagatcgcaccactgcactccagcctgggcaacagagcgagactctgtctcaaaaaaaaaaaaatttagggtggcactaactgtcgagtcttttaaaaagataatctatgccttgaagtgc

SEQ ID NO: 61947 - DNA, 601 bp, Human
attggtaatgagcaatgtaaagtaaagagtgggaaaatatttggaaaattcaagctctgagaatagcctgtctgggatgatttggctcaggctgtgttgtaactgtgtttttctttcccaggtaaattgtgaagttttatgaatataatagtataaatttcctctataagaataattgaaaaatctcaacttcacttgcgtttttggtagaacgattgctatatttagtttaaaattttagggcggcaggccgggcgcaatggctcacgcctgtaatcctagcactttgggaggccgaggygggcggatcactaggtcaggagatcgagaccatcctggctaacatggtgaaactccatctctactaaaaatacaaaaaattagccgggcatggtggcgggcacctgtagtcccagctactcgggaggctgaggggagaatggcgtgaacccgggaagtggagcttgcagtgagccaagatcgcaccactgcactccagcctgggcaacagagcgagactctgtctcaaaaaaaaaaaaatttagggtggcactaactgtcgagtcttttaaaaagataatctatgccttgaagtgccatt

SEQ ID NO: 61948 - DNA, 601 bp, Human
caatgtaaagtaaagagtgggaaaatatttggaaaattcaagctctgagaatagcctgtctgggatgatttggctcaggctgtgttgtaactgtgtttttctttcccaggtaaattgtgaagttttatgaatataatagtataaatttcctctataagaataattgaaaaatctcaacttcacttgcgtttttggtagaacgattgctatatttagtttaaaattttagggcggcaggccgggcgcaatggctcacgcctgtaatcctagcactttgggaggccgaggtgggcggatcackaggtcaggagatcgagaccatcctggctaacatggtgaaactccatctctactaaaaatacaaaaaattagccgggcatggtggcgggcacctgtagtcccagctactcgggaggctgaggggagaatggcgtgaacccgggaagtggagcttgcagtgagccaagatcgcaccactgcactccagcctgggcaacagagcgagactctgtctcaaaaaaaaaaaaatttagggtggcactaactgtcgagtcttttaaaaagataatctatgccttgaagtgccatttttatttttgta

SEQ ID NO: 61949 - DNA, 601 bp, Human
gtataaatttcctctataagaataattgaaaaatctcaacttcacttgcgtttttggtagaacgattgctatatttagtttaaaattttagggcggcaggccgggcgcaatggctcacgcctgtaatcctagcactttgggaggccgaggtgggcggatcactaggtcaggagatcgagaccatcctggctaacatggtgaaactccatctctactaaaaatacaaaaaattagccgggcatggtggcgggcacctgtagtcccagctactcgggaggctgaggggagaatggcgtgaacycgggaagtggagcttgcagtgagccaagatcgcaccactgcactccagcctgggcaacagagcgagactctgtctcaaaaaaaaaaaaatttagggtggcactaactgtcgagtcttttaaaaagataatctatgccttgaagtgccatttttatttttgtaattacaaatgggtatcagaagaatggaatctaatatgaagttgaggtcatatattaaatctaacacctttgaataaaagtagaccttttgttccattgcatgttattattgaggggcccccattataatacaacagtg

SEQ ID NO: 61950 - DNA, 601 bp, Human
aacacttatatgtttatttggaggacataattttaaaatactgacatctttatctaatttgttatattatgttacagtaatagtttaatattgtagtgcatgatattagacttgaaatgctagaaatcactggaatgtatagccaatgaagcctgggttgatttttgatatttttggattatatagtaccaaattataatcccatattctatattcagatctctgaaaaaagtggcctttcattgatcaaaatatatttatataaaacattttaatgaagaatacctatttataaaatatscagaggaaatatatgcagatgtaaaattgagcccaataaatccttgtgttttcataggtatgaaagttacaataaataatggcaattagatattgtgtgtgtcagaaaatcaatttttctcccaaatcaatccctctctttctttctgtttctgtatctctttcacagacacaatgtaaacacctatgcatatgtgctcatatctgttttagttgacttctttcttgagactttaaattctgaaatgttttacactgcatgtacagctaagattaaagtcttctttttaacagtacactt

SEQ ID NO: 61951 - DNA, 601 bp, Human
tcttagttttactgttacagtatgtagcacttcatcttaggcaaatatgacagtctgtggaatcctgtgtcattcatttgaaagaactgacaaaagaacatgtttttagatcaacttgcatttgcaggaacacacatgggttgccaaaaatatccatttagagtgtttaaaagaggcacacgcctggattggcctcggtgaccaataatgtctggtggtaatgcgtgttttttggagtagtctttaattactaaacaaggtggtgacatacataaagccagtgggttttttttccaccggmagatgggtgctaaagaaactgagcgattttatttttttcatcatataatatttctgatggtcttgcctccttcaagtctcaacatgtgtctctttaaagagaatatttcacctttcaaaatgaagtctcctaatgactcacttaaatgtttattgttttcttgccgtaaggaactttgtgacttgtaaatatgaatttatgtatgcatttttgtatgaataaatacatttataaaattgatatttaaaaagagctagcacttaagttaggccagacgtttttctaagcactttacagatg

SEQ ID NO: 61952 - DNA, 601 bp, Human
caactgtatgttgcaactgcttaaaagagaaaaaaagaataaaaaaccctgaagaattccttaggcattataaatagaaataagagtgtccacatcatgggaagtaacatagttgacgtacttcacactggccgcatcacggctggaataccatgttccgtccaagacaccataattttaggaaagacttggacaaactggagtgccagaagtctggaaatatgagaaatggaggaagtgggactgtatagtgtagagaagactaataggaactaaaacacttgtctccaactatttatamggttgtcatttagaaaaatggacacgcttatatattgccctagaaaacaaagagtagaatcaatataatgaaagtaccatgtatatttttactcagtattaagggtgaaaactaatgggtaccagtgctgagtcttgcagcaatcatataagaattcctgtatatggccgaagcttacattcagttacattcactaaaataagatttttgcattcatatcctcattgggcttgggcagtaaaggaattaaatcccccaaaagttcattaaaattttagggctgttctatgattgcatgga

SEQ ID NO: 61953 - DNA, 601 bp, Human
cagtattaagggtgaaaactaatgggtaccagtgctgagtcttgcagcaatcatataagaattcctgtatatggccgaagcttacattcagttacattcactaaaataagatttttgcattcatatcctcattgggcttgggcagtaaaggaattaaatcccccaaaagttcattaaaattttagggctgttctatgattgcatggatggttaaaattagacctgatggcactattggttattctaagaaaggagctaaaagtctatataattggtttactttttattcagtctagttttkaaatcttaagaatggatcaaggaacattggatgaagaagggacacagggtaatgttattttcccaaatttcagaaattcttccaatttaggttcagcaggtaattaagaatgatttcatgcatgtcagcaaaaatagtttgatacaggactcattgaatattgtattgtgttgggaactgatcagagaaaaccatggtgtttgtccgtgaactctcgttgctttttatctaagaggggttgaaatgttgcgtgcttttgaattttatcatggacaatacttgagatttgtaccagtacac

SEQ ID NO: 61954 - DNA, 601 bp, Human
tttaaggattgagtaaaatggaagtgtattaatgggaaatagaatagaagatagctatagtatgaccttggaaactgactttacgttttacaggcatgtttttctttccatatttcattcttgtatcttgaaataagctgtacttatggttaggtatatgctagatcttagaattcctttaaattcatcttgtcaaaatatcagccattctgtatgaatattaccaagtttaagacattggtttatgttcaatttcagcagtttgtataactgatttgaaaaagcaataaataggcttcawaattttatattttttataggaaacaggtaatttaatacatttaatacattaatacatttataatgtatgtattttttcatgaggtagactatgtaaaaagtaaagaagatgatctaaatccagaattaaaaggcacagtcacatttttttttcttttgcagcattggatagtatcagtttgttataatctagaatatataatatattctgtttttacatttcttaactaaatcctctttttaaaatataaataaatatctttaaaataatattttaggccgggcatggtggctcattcct

SEQ ID NO: 61955 - DNA, 601 bp, Human
gtaatttaatacatttaatacattaatacatttataatgtatgtattttttcatgaggtagactatgtaaaaagtaaagaagatgatctaaatccagaattaaaaggcacagtcacatttttttttcttttgcagcattggatagtatcagtttgttataatctagaatatataatatattctgtttttacatttcttaactaaatcctctttttaaaatataaataaatatctttaaaataatattttaggccgggcatggtggctcattcctgtaatcccagcactttgggaggctgagacgggcggatcacgaggtcaggaggtcaggagtaatcccacatcgttcaagtcagtaatgaatttatttgaatcaaaagtggatacatttaaggaattgtttctatacatccaattaggtaattctggttggctaaattgagagctggtcataatcccaaaagacacaattctgaatgtcataattctgaatgttaaaatcccagaagagtaaaatctctaaagtctaaaatccagaaaatcacaatccccaaaacatcaaaatcctgaaaatgtaattctgaaaaaaattaaaatatta

SEQ ID NO: 61956 - DNA, 601 bp, Human
catcatttcagtttcttattttgtttcagatacagaaacatcaaatccatgttccatacatcttagacactgatttttttttttatgtcattttgacatccctccagcacccaaatgccaacatctgctacattttgccacacggttgtaggcttgaactctgaaatgcccctaaatgtttttaaaatttctttgtgtatgttttcaaaataaccttcctttgagttctcagttttatgtgaactgtagttaaactcttttttttccatgacttgtagcatatggtatttaactgtttgcyagtatcgctttctgaaatgaacctatttgtacaaaggcattttaagagaacagtgcacttaatcagagaacctccttcaaggtgactctactgcttaaacatggtttaaaaaaattaaaatatttatggctcagcattgttgtttcattgtctatcaaagttaataaaaataactggcctttgagaaagagtacacctttaaaatttttgaaggccaaatgatttttttttatttttcatccagaagtatctatccctaaaggaagagaaactttcttcagaaaggtatttgttttaatc

SEQ ID NO: 61957 - DNA, 601 bp, Human
gctacattttgccacacggttgtaggcttgaactctgaaatgcccctaaatgtttttaaaatttctttgtgtatgttttcaaaataaccttcctttgagttctcagttttatgtgaactgtagttaaactcttttttttccatgacttgtagcatatggtatttaactgtttgccagtatcgctttctgaaatgaacctatttgtacaaaggcattttaagagaacagtgcacttaatcagagaacctccttcaaggtgactctactgcttaaacatggtttaaaaaaattaaaatatttrtggctcagcattgttgtttcattgtctatcaaagttaataaaaataactggcctttgagaaagagtacacctttaaaatttttgaaggccaaatgatttttttttatttttcatccagaagtatctatccctaaaggaagagaaactttcttcagaaaggtatttgttttaatcaaggaagtttctgctgagattaataacttggtatcatcccttagttcctgataaacatcataccttaaatgagtcttctgttttttaactagtttttcttttgtctaaaacaaaattgcctctttt

SEQ ID NO: 61958 - DNA, 601 bp, Human
agttaaactcttttttttccatgacttgtagcatatggtatttaactgtttgccagtatcgctttctgaaatgaacctatttgtacaaaggcattttaagagaacagtgcacttaatcagagaacctccttcaaggtgactctactgcttaaacatggtttaaaaaaattaaaatatttatggctcagcattgttgtttcattgtctatcaaagttaataaaaataactggcctttgagaaagagtacacctttaaaatttttgaaggccaaatgatttttttttatttttcatccagaartatctatccctaaaggaagagaaactttcttcagaaaggtatttgttttaatcaaggaagtttctgctgagattaataacttggtatcatcccttagttcctgataaacatcataccttaaatgagtcttctgttttttaactagtttttcttttgtctaaaacaaaattgcctcttttgttttagagatgaattactcaatttttaattgttttgggggcagggtgcattattttcctattgaagaacaaaatgtaaaacactgccctgaaaggaatatttgcaaaaccatgaaagtga

SEQ ID NO: 61959 - DNA, 601 bp, Human
cagtgcacttaatcagagaacctccttcaaggtgactctactgcttaaacatggtttaaaaaaattaaaatatttatggctcagcattgttgtttcattgtctatcaaagttaataaaaataactggcctttgagaaagagtacacctttaaaatttttgaaggccaaatgatttttttttatttttcatccagaagtatctatccctaaaggaagagaaactttcttcagaaaggtatttgttttaatcaaggaagtttctgctgagattaataacttggtatcatcccttagttcctgrtaaacatcataccttaaatgagtcttctgttttttaactagtttttcttttgtctaaaacaaaattgcctcttttgttttagagatgaattactcaatttttaattgttttgggggcagggtgcattattttcctattgaagaacaaaatgtaaaacactgccctgaaaggaatatttgcaaaaccatgaaagtgagcaaagttgagatgggctactctatagaaattttgcattttattctaaaatactgtattttgccatgatttgttccctggtgtgtatagaagcattggctgcag

SEQ ID NO: 61960 - DNA, 601 bp, Human
ttcttcacagaaatgttgttcggccatgtatgttcatgagggaaaaaagttctcatcctttgagagtatgaggattgtatacacgatgtatataatgttggagaaaaaggtttttattagtttcatgacattagtttccttagctgcctttctgagaatggtccttatgtttaagatgggggcatttaagttattgtcaggattaaattcaatcgaaagaattaagtgttaggaaactgtgccttgcctgtcaaatagtgactagtcaggaaaacacacacacacacacacacacacacacgcacacacacgcacgcacaaatgcatgcacacattcctcactgctattttgacgtatatgtacctatagtatgtctaaatttttcatggtattagattatacttcaattatttgaaattaatttaaagaacagaaactaagaggaatcatagaatcaaagataactatgcgccttatctcaattgtgtataaaccttttgaaagaaaataggttcatttaatagtttaataacacattttgcagttgttgtaaggttcgtaagtttttgtttgctgagtattaaggcaaaatttttaaac

SEQ ID NO: 61961 - DNA, 601 bp, Human
cagaaatgttgttcggccatgtatgttcatgagggaaaaaagttctcatcctttgagagtatgaggattgtatacacgatgtatataatgttggagaaaaaggtttttattagtttcatgacattagtttccttagctgcctttctgagaatggtccttatgtttaagatgggggcatttaagttattgtcaggattaaattcaatcgaaagaattaagtgttaggaaactgtgccttgcctgtcaaatagtgactagtcaggaaaacacacacacacacacacacacacacacgcacacwcacgcacgcacaaatgcatgcacacattcctcactgctattttgacgtatatgtacctatagtatgtctaaatttttcatggtattagattatacttcaattatttgaaattaatttaaagaacagaaactaagaggaatcatagaatcaaagataactatgcgccttatctcaattgtgtataaaccttttgaaagaaaataggttcatttaatagtttaataacacattttgcagttgttgtaaggttcgtaagtttttgtttgctgagtattaaggcaaaatttttaaacaaatgaa

SEQ ID NO: 61962 - DNA, 601 bp, Human
acaagaaaagttgtttttatttatggagaaacaagtaaaggccctaaggtggttaaatgattgcttaaagtcacacagaagtggcatggctctgatttcccagtttaccagatacttagatactcttttcaatgatggaaaagcaaataataaataatttactttctagatattgttgaattcttactatgtttctgggcttctatgagatgctggaagatttcttaaaagtgaagagggtgaaatggggaggtgttagtcaaagggtatacagttttggttatgcaagatgagtaagttytaaagatctgtgtagtatattgcctacagttaacagtacatactctgttgtagacttaaaaagagggtagattttatgttgtgttcttatcacaaaaaaaggtgggaggaaacttctggaggtgatggataggtttatggcacagattgtggtgatggtttcacaagtatatatatgcttatctccaaactcatcaagttgtatatatttaatatgtgtagctttttgcatgtcgatcataccttaataaaataggtcaaaaaaagaggaagagcttcaattatttttctcttctttcct

SEQ ID NO: 61963 - DNA, 601 bp, Human
acttagatactcttttcaatgatggaaaagcaaataataaataatttactttctagatattgttgaattcttactatgtttctgggcttctatgagatgctggaagatttcttaaaagtgaagagggtgaaatggggaggtgttagtcaaagggtatacagttttggttatgcaagatgagtaagttctaaagatctgtgtagtatattgcctacagttaacagtacatactctgttgtagacttaaaaagagggtagattttatgttgtgttcttatcacaaaaaaaggtgggaggaaayttctggaggtgatggataggtttatggcacagattgtggtgatggtttcacaagtatatatatgcttatctccaaactcatcaagttgtatatatttaatatgtgtagctttttgcatgtcgatcataccttaataaaataggtcaaaaaaagaggaagagcttcaattatttttctcttctttcctttttccataccttcataaaaattcagagtgcaaatttcttagtttatttcacctactttctgagcaatattttttaaaacctgtgttacatttcaaaagcaatattcaattta

SEQ ID NO: 61964 - DNA, 601 bp, Human
ttaataaattcaagactcaagttaacttttaataaatactgtacatattttactatcagaattttaagaacagcatacgttttttaaaaaaatacacaagatgtaattttagtaaggttaggaagagcatgtactgctggaagtatagttctgtaactacatagacaaaatatatgtcttctctgtcacaattttgccttcagattcattgtttgtagaatgtttcttaaggcttcacagatattgtaatttcttatagatggattgtggagagagatcatgtgtagatagaattcctacrtggtcccagtgttttaagtatagtagtcttctgccactctaatattgaataagaagtgctagtggaaaaattgggtgatcgattacttatttccactctgagatcaggtctcatttaccttgaatttgatttgttcttcctcagactcagtgtttctgatgcaggtggtgttaggctcccacattgttaaaataatgtgcaacattggtattcttttaaaataccattaacatgctttatctttgttcatttgtcaaatcaaggctttactattgaaggtgactttttttttttcctgcg

SEQ ID NO: 61965 - DNA, 601 bp, Human
tatacgggcaagattgagatttttggtgtgggaggggtttttctggtgtccctcaaattcaattacgtaggtaaaggtggaattgatccttgttactcaaagtaagacttgtcaacaaactcagcattacctgggagctgctagaaatgcagggtctcaggttccactccagatggctggatcaaaatctgcattttaacaaaatccccacgtttattgtatgcaaattttcctaaacagagaagttgacagatttctaaaactaccctgatcattccaaaagactctttaggaagttacrgcttcaatgacagcagctgcgagatgttttagcaccacctgggagaacgggggattgggtgggggagaggggctatactaaaaaacaaaacaaaacaaaaaaaactatgctgctttctgttcccaaggaaacattttaggggtgaaaggttcatattccattatcagtcccctgagcccaccagtgttcaaaaatgtttttttcccaagacttttatggcacttaagtcagactgctcctattggaataacagaccaaaaatgactgacagttatagtgtctgggattagggagaaaaat

SEQ ID NO: 61966 - DNA, 601 bp, Human
taattggctcacggttctgcagactgggcaagcatggtgctggcctctgctcagcttctggggaggcctccaggagtttttactcatggcagaagggaagcaggagcaggtgtgtcacatggcgagaaagggagcaaagtgaacaccgggagggtgccacacactcgtaaacaaccagatttggggagaacaaacttactaatatgagaacagcaccaagccattcatgagaaacctgtcccccatgatctcatcacctctaatcaggcctacctccaacattggggatgacaattcaacrtgagatttagaggggtaagatatccaaactttatcaaggaccgtaatggaaatagacttgtactcatacagcttacattttatcctagtagacatgcctttgattgcatagcttgaaaggttgaaatgaactaaattgagggttgtttatattaaataaagctattttcccccaattttagctaaacctctttttatgtaaagaaaaaggattttttttttccagtaagatttaccagtcaaagcaggaaatcattttgttacaattgtcttacaaagcagccctgtgcaaggctgttgc

SEQ ID NO: 61967 - DNA, 601 bp, Human
gattctctctcgagaagtcttcctattcttggatgtagagtgttgctaaaaagaattagttccattttctccagagtgctctaagttatagctatttatcttttaaggaagctcctaagtatccacaggtgttcagccccctaaaatttcaatttatcttcagcacagccagcttttcagtgtttactataaggctttaaccacatggtaattcctcccttaaagaagtctgctgtatataatgttaaggcagggttgtcagggctgttatgctgtgtcccaagccaaatacatttctcarcattccaaggttatgcgaatacacagaaataattattttcagatgttgacattgcacttagtgatttagtaatatgagaaaatatggttcaaaagttattcatctaaaaagcaatgcaaaatatagtagagacaaatatggtatgcattcaggcacatactgtgaagtagaaatgttggagtgatttagctttctgtcataacatctttatcacacaggatatggacttgctatgatgtgagttagcatgtttcctctgacacaactagagtccagagatgtgccttgcttctagtccaa

SEQ ID NO: 61968 - DNA, 601 bp, Human
aaagttactctaaatttactttttcctaacattgatttatgacattcagtatgaattttgtctgtttatatccacatatcatgtagtcaacatagaaaagggaaaaacctgaatgaagttttattatactcattgattctttatatgcatgaaaggggaaattatcattatttcttaatagtctttaaatttctacggtagcatttgaggaaaatgaaatgaactccatttgatatatgacctattgcacttaaaaatattcagatcactggttattgctgactgcttataaggcaaaatrttttgattttactgtattgttcatgctgcgagcaaaatgggtgtctgctaagtttttattttaaaatgcatatttctgtctttaccttgtagccttgcaatgcgtaattcaaaatgtttgcaaagtacaagtttattatattgtttgtctgcttcttattataactttaaaaagaaaatgggacaccctcctctcaccccaccctagagacagattttccatgacagaatagttttaaacatcaggatattgcataagtcagtctggaaaaaataggaacagacagctagcactatctag

SEQ ID NO: 61969 - DNA, 601 bp, Human
taataaattataatgaaattgtatgccaggattggatctaattccttgaattattcaacagtgaagctcagtaagttcaaggcactaccacaaagtactgttgggagtataatggatacataagaagtaatactggttaaaggaaaatagaacataattgagaaaaataaattctgcaaatatataattaagtaccatgaagcaattagaaactgtgttatagtccagacttgaaagagattatttcctgaggcaaagggagcattcatggagtagagtagtcattgagtaggatccttcrtggagcagatagtcattgagtgggttctgaagggtgagtggaatttgaacagggagagacctgagaaagacgtagtcgaaggcaacatcattagtagcagaagagtgaaaaaaatatagtattgaagaagaatagtgcaattatgtaatgggtcataaaatggattagattgacaagttaattctcactaagagccaggtactttgctaaaataagcattttacataaattatttagccctcacagtaaacctaagaagtagaaatgtatggataaagaatttaggacatgatacaacta

SEQ ID NO: 61970 - DNA, 601 bp, Human
cataagaagtaatactggttaaaggaaaatagaacataattgagaaaaataaattctgcaaatatataattaagtaccatgaagcaattagaaactgtgttatagtccagacttgaaagagattatttcctgaggcaaagggagcattcatggagtagagtagtcattgagtaggatccttcatggagcagatagtcattgagtgggttctgaagggtgagtggaatttgaacagggagagacctgagaaagacgtagtcgaaggcaacatcattagtagcagaagagtgaaaaaaatatrgtattgaagaagaatagtgcaattatgtaatgggtcataaaatggattagattgacaagttaattctcactaagagccaggtactttgctaaaataagcattttacataaattatttagccctcacagtaaacctaagaagtagaaatgtatggataaagaatttaggacatgatacaactaatatgtggcagcagatgaacttgaaaccagggactggggtcttgaccactaatctctgttccctgatgttggtatttggtactacagggaaggatggatatttcattctgtaagctgt

SEQ ID NO: 61971 - DNA, 601 bp, Human
gaatattgaagcatatgcttaaacttaacacaataaatgtaagcatttcatggccatggcacaaaaatgtgttaaaactatatcgttcatccactgacagtgttgaagaacaaagcagtgtcacagaaaataggttgcattattcttagaaatatatcatgctttgagggatccttttttttaatggaggtcatgatcatctttcataaataatttatcagttaatggtagtgaacagagtttgaatgagtcaaaattctacaatgaaatgctcctgtataggtgtaagtatataaatgtatatataaatatacatatacaaatgtaaatatataaatgtatatatttaatgtgtatttgcccctagtttaatttgtcagcagtaactgctggtttttatttctttttgcaagaaattatatagaaattgatttgagggagatttaaaataaatgtttagtgagaggaaatcttactctgtcctatctatggatattgataaactgtaccactgtattcctaactcctaacttggatataggagcttgactatctgcatagatacgtaaggggatatggctgacaggaggaattacaaatg

SEQ ID NO: 61972 - DNA, 601 bp, Human
ttttttttctatcatattgtataaatctgtgtaaatctcattttccccctttttggagttaagtagcataattaactgtaaggcttttccaaatactttcttaaccctgaaaaactttccctcgggacttacagtatagccaaatggatatcgattattgctaaatgtaaatacatatgcacatatgaggtgaagctgtattaaaatatgggtggcagtgtctttaactcagatttgggatgctttatacagtcatgggaaatatcaggggatcaacttgaaattctttaaaagttaacaraattttggaacgatcaaggaacatgggaatatggcctcaccttttctttctcactgatgacataaatgccgccctcactgtgttgtttattgtttcttccagataatctttgcatactcagtacttggaatatagagccattgccctgtactcattttttccttcctggaggtataaatagactgatgacgccctatgctctctgcagtctgtgcatcattcataccgtacatctcctttctaggtcacaaagcttttaaaaaaaatcagcagtggtagcagcatgtgagaagatgagca

SEQ ID NO: 61973 - DNA, 601 bp, Human
gaaggtggtacaaccacccagggaggacatgggagctctgcaccccttctcctatacttcaccctatgcagctctccaactggctgttcattcatatgctttgtaatttttttataataaatgggtaaataaatatgaaatgtttctctgaattctgtgagctgctctagaaaattaatcaaacacaaagaggtgggttataggatctctgatttataactggttggtcgaaatacaggtcacaacctgggatttggaattggcatctgaagaggggggcagtcttgagggactgaggggygatgctatgtccaggtggatagtgttaggattgaattgaattagacgatgctcagctggtgtctgttgaagaatctggtgtcagaagtgttgagtgatgtgtgagagtaggagaaacaatggtttttcctacattctcttacactaatggatttgtattcggagagattggaaagatggatctgtcatttcctgagatgggaagtcacagcgaggagcccattaaccatatattaaaactccattagtaatattaagactgtccattctagaagaggtggtgggtcacgcccgtaatcct

SEQ ID NO: 61974 - DNA, 601 bp, Human
ggtgggttataggatctctgatttataactggttggtcgaaatacaggtcacaacctgggatttggaattggcatctgaagaggggggcagtcttgagggactgaggggtgatgctatgtccaggtggatagtgttaggattgaattgaattagacgatgctcagctggtgtctgttgaagaatctggtgtcagaagtgttgagtgatgtgtgagagtaggagaaacaatggtttttcctacattctcttacactaatggatttgtattcggagagattggaaagatggatctgtcatttmctgagatgggaagtcacagcgaggagcccattaaccatatattaaaactccattagtaatattaagactgtccattctagaagaggtggtgggtcacgcccgtaatcctagctagcactttgggaggccgaggcgggtggatcacctgaggtcaggatttcgagaccagcctggccaacttggtgaaaccccgtctctactaaaactaccaaaaattagccgggcgtagtgctgggcacctgtaattccagctactcaggaggctgagacaggagaatcgattgaacccgggaggcggcg

SEQ ID NO: 61975 - DNA, 601 bp, Human
ttgagggactgaggggtgatgctatgtccaggtggatagtgttaggattgaattgaattagacgatgctcagctggtgtctgttgaagaatctggtgtcagaagtgttgagtgatgtgtgagagtaggagaaacaatggtttttcctacattctcttacactaatggatttgtattcggagagattggaaagatggatctgtcatttcctgagatgggaagtcacagcgaggagcccattaaccatatattaaaactccattagtaatattaagactgtccattctagaagaggtggtggstcacgcccgtaatcctagctagcactttgggaggccgaggcgggtggatcacctgaggtcaggatttcgagaccagcctggccaacttggtgaaaccccgtctctactaaaactaccaaaaattagccgggcgtagtgctgggcacctgtaattccagctactcaggaggctgagacaggagaatcgattgaacccgggaggcggcggttgctgtgagccgaggtcgcgtcaatgcacaacagcctgggcaacaagagcgaaactctgtctccagggggaaatattagtgaagaggacaa

SEQ ID NO: 61976 - DNA, 601 bp, Human
attagtgaagaggacaatattgtaacctacaaaaattctgtggtaggtatgttacttttgttaacagacttttctgaataaagtactccaaagtaacttggagttaagacattttaatattatgccttggttttcaaaacatgaatggtttccttctcttttcatgaatttggatatgaatgcaggcacttacctacgtaatttctaatattgatgatactggtgtttcttaaattcactaaaaaattttatttgtaaagggtaacctgcgttacattatttaaagtttttattttaaggtttttttttttttttgagatggagtcttgctttattgccctggctggtgtcaaacttttgggttcaagcagtccccacgccctagcctcctgagtagttggaattaccacattacattttgaaagaagagagtttacaaatgtctgtttccatgcattttaaaagaggtcttgttacaaaagattcagttaatctctttaaatggaatttattttggtttcctacttcctccattaaagtacattaatccttcttaacatatgtatttatcacctgctggattgctaagtatgtaaaagct

SEQ ID NO: 61977 - DNA, 601 bp, Human
cttggatttgatgctgctcctttcccagaatgcatcgcagcccaacattgccatttattatgctttattttgttgagcttgatgctttgcattagtttgtttacttattcaataattatatattgagtgcttactagagttgtctagtttctcaaaattgtgaggtttatgctaaacactggggacacagcagtgaatgagacctagtccctgtcatccaggggccaataggtcacagatgtgaattagccctttcccttgacttttgggattccaatttcaaagaggttgtaaaagagasagtgccatattcttgaaccttttagccaactaggtaaaaataaattttcacatatttctattgagcccactggacaccaatatactttaataattgtgtttaaaatagaaaactccttcagcttgaagctgtcttttatttgagaaaagtgaaaaagagattcgtgggatattataaaagatgaacaagatgcctaaaatggacaatgctcctttacatgttactttaacatttgagagaatgctatcaaaatgcagaactggctaaaagtgttagaaggagtagttcaagttgtcttca

SEQ ID NO: 61978 - DNA, 601 bp, Human
gtagttcatcagtttaagtagggaagtggaacttggcgatctcagaggagttctgtagcctccatgcccctgctccccccttttcatggctcactactgccattcacataagcaaacactagcttccctcagtcattcagatcatggatgaatgccattctgtgttagcttaaccaccatcattcttgataaaatataactttttacctgagtaatgcatacctagtataataggctacagtatttcttgaaatgtagagtccgtatcagtggtggtataaaagattgttttacatgcaaygagatatgctggtatataatattaagtgttttgctaaattatttgcctttcatttctactctaatgttactgattaagataaggggagcagatctcaccttggagctaggatgctttcatgtccctccaaccctcactgattatctttgtaacagagagcaggcctcaggctaggagtgtttgtcagaaaaaaaaaaaaaaaaaaaaagaggatcttgtgagaattgaaagagatagcattgtctttccttgactttagttttatggccactttgtacttatataaagtattactgagtt

SEQ ID NO: 61979 - DNA, 601 bp, Human
tcagaggagttctgtagcctccatgcccctgctccccccttttcatggctcactactgccattcacataagcaaacactagcttccctcagtcattcagatcatggatgaatgccattctgtgttagcttaaccaccatcattcttgataaaatataactttttacctgagtaatgcatacctagtataataggctacagtatttcttgaaatgtagagtccgtatcagtggtggtataaaagattgttttacatgcaacgagatatgctggtatataatattaagtgttttgctaaattrtttgcctttcatttctactctaatgttactgattaagataaggggagcagatctcaccttggagctaggatgctttcatgtccctccaaccctcactgattatctttgtaacagagagcaggcctcaggctaggagtgtttgtcagaaaaaaaaaaaaaaaaaaaaagaggatcttgtgagaattgaaagagatagcattgtctttccttgactttagttttatggccactttgtacttatataaagtattactgagtttccatttaagtagtgacataaagttttaaaaaataaatcca

SEQ ID NO: 61980 - DNA, 601 bp, Human
tgagtaatgcatacctagtataataggctacagtatttcttgaaatgtagagtccgtatcagtggtggtataaaagattgttttacatgcaacgagatatgctggtatataatattaagtgttttgctaaattatttgcctttcatttctactctaatgttactgattaagataaggggagcagatctcaccttggagctaggatgctttcatgtccctccaaccctcactgattatctttgtaacagagagcaggcctcaggctaggagtgtttgtcagaaaaaaaaaaaaaaaaaaaaagaggatcttgtgagaattgaaagagatagcattgtctttccttgactttagttttatggccactttgtacttatataaagtattactgagtttccatttaagtagtgacataaagttttaaaaaataaatccaattggaaacaaaattttatttatagaagactaagtgtacaatattatgggtggctggtccataacatggtagaatcaccaaggtaattgctacatgaataattgaaattttggaagcagtaatatatatagcacatttgcttctatctttttcttctttaattttac

SEQ ID NO: 61981 - DNA, 601 bp, Human
tcatttctactctaatgttactgattaagataaggggagcagatctcaccttggagctaggatgctttcatgtccctccaaccctcactgattatctttgtaacagagagcaggcctcaggctaggagtgtttgtcagaaaaaaaaaaaaaaaaaaaaagaggatcttgtgagaattgaaagagatagcattgtctttccttgactttagttttatggccactttgtacttatataaagtattactgagtttccatttaagtagtgacataaagttttaaaaaataaatccaattggaaasaaaattttatttatagaagactaagtgtacaatattatgggtggctggtccataacatggtagaatcaccaaggtaattgctacatgaataattgaaattttggaagcagtaatatatatagcacatttgcttctatctttttcttctttaattttacataaagatataaaacagaactataggcttatctagaaaaattagataaacataatcattcatctacttctttctctaggtaatgtatattaagctttgggcccaacccagtaactaaatgggatgatggtgatgacgattat

SEQ ID NO: 61982 - DNA, 601 bp, Human
gtacaatattatgggtggctggtccataacatggtagaatcaccaaggtaattgctacatgaataattgaaattttggaagcagtaatatatatagcacatttgcttctatctttttcttctttaattttacataaagatataaaacagaactataggcttatctagaaaaattagataaacataatcattcatctacttctttctctaggtaatgtatattaagctttgggcccaacccagtaactaaatgggatgatggtgatgacgattattattgattattgttttcttaaaagccrtgattcctattaaaatactcttgtagcaaattgtaatgaatttttcccagttggtttaccaagtgcgtaagaatcagatatcagtaaaaatgtcaaagtatacatttataatagcctatcttttccccagaatggcttattattatctctctgcagtgtatcagaatataaatagtattagaaggttttaaaaatatcaattagaatgggaatgaaaggaatactgaaggaaggaaaagagatgaagtgacgaagcacttcttttggccactttcctgctgcatgtctcactttgggtgc

SEQ ID NO: 61983 - DNA, 601 bp, Human
ttgaaatgatgggaaatgttattgcccttattaacattatatggaatgcacacaaatataattgcataataattcaacagagtatgcctgtgataatttaaatggtatttcaatagatccacaaatttaatatatccccttcaaaatgagggttatatttacttagaaagcaatatattcacttaacaaggttcactgtcacttagtaaatcaatattggaattattttttcagctctcgctttttatatcaataactttgatattgagtaagttgttttttcccattgcttggctaattkttatcataattatcttttctgtacttcagtatgatgactgtccttctgtaggcccaagaaatatactctatataagtaagattttcttctggatggctattacggtaagatgttttaccgtgagctgaatcatgattactctcaaagccaatctggtttcaggtgggtcctaagcccatgctaatttctatggccaggattgtacactatgcaaattttcattttccttgaagagtgagtgcaggactataaattgctgacgtgggattgaataaaatgagacacatggatacagacatt

SEQ ID NO: 61984 - DNA, 601 bp, Human
ttgaatgttgttctgacttgaggtggaatactatattaagagggactctgaggctctgagttcagtgggaaagagggaagtgagaattcatcatgtctgagtgggacatctagttgtaaagggggttgtgtcccagggtttcaagtatgaacactgtaatgagaggtttgaacctagaaccacctgattacaaagcttacatcctttaatagctagtctggattacccctcataaaaatttgcaaatggtcaggaaagtgtgttataatttacaacacttttccacttgaagtattttagrcaggactagggaacaatgtaaggatgtaaaagtggaggtggtagagatggggtttatctcttttcttcttaaataataatcttggaattatgaatctgtatgcacgaatcttgaataagcatcaaaatctttctaaaactttcacagtgcaatgctgtgggttgcattgtgtccttttccccccaacccgaattgatatgttgaagttctaatcccttatgtgatggtatttggtgaaggggcctttggcaggcagttaggtgtagatgaggtcgagagagtgggccctcgtaatgggat

SEQ ID NO: 61985 - DNA, 601 bp, Human
attattttctgaacagcaaatccatagtttcaaaaaccatcttttttctgttgcctcaagttttccagtactttaaatctcagaatgaggactgtaaaagtaagaaagtaaattgattttctaggatgtttggattctgggcaaattggtgttatttatttaaaactccacatttcaaagatgtaatgggttttagattttataccaaaacaatatttgatatatgatgcctttctaaaggttatctttctgatttttttcccaaaatatatttattgaatacttttttgtaatccctccyagctactgtgttggcactcaggatgtaaatgaaatggtaacatttagaatattttttaaccagcgtggcattgacgcgattggtcagaaagaacattgattgtaagccaccctatggtcatcctggtgcattttggctctgaatttaataccaaaagaggcagctacatccccaccctcttaaggcttatggttccttgtaaagtcttgtatttgaatgtatgttgacatgacctagatcatttttggatactaccctagagtatctgatacagtggatcagagttggggctcagtaatc

SEQ ID NO: 61986 - DNA, 601 bp, Human
agtaaattgattttctaggatgtttggattctgggcaaattggtgttatttatttaaaactccacatttcaaagatgtaatgggttttagattttataccaaaacaatatttgatatatgatgcctttctaaaggttatctttctgatttttttcccaaaatatatttattgaatacttttttgtaatccctcccagctactgtgttggcactcaggatgtaaatgaaatggtaacatttagaatattttttaaccagcgtggcattgacgcgattggtcagaaagaacattgattgtaarccaccctatggtcatcctggtgcattttggctctgaatttaataccaaaagaggcagctacatccccaccctcttaaggcttatggttccttgtaaagtcttgtatttgaatgtatgttgacatgacctagatcatttttggatactaccctagagtatctgatacagtggatcagagttggggctcagtaatctgcattttcaacatgtttcctaggacactggataggaaaagacaaccaggaagggattactcagttgttccataaagcaattcccattgtcttcagtaaactctag

SEQ ID NO: 61987 - DNA, 601 bp, Human
atttctcagaaaaaaacagtaagtagctagtgactctgtacacagagaaaaaaataaagaacagtttaaatcatatcagggtttcttctgaaatttttttcagtgttggaatgtgtaacttttaatctcattttggggaattttaaaatttggtttggattaaagagcaaaatgttggaaaagtaaacagcttattatctaaaggcattaaatatctaaaggcattaaatgtctaaagatattaaagaatgcatactttcagattcacctttttaaatacattgaaatttttattcaccawcatggtaaatcttttaaatctgtttgaattaacatattgtaaatgatactcaatatatacatattgtatgtgattttatatgcagtaagttataagacccatggctttttgaacaattgataatgaacatttaaaatggtaagatagatcttagaaatggtatctgatttcctcttacttctagtgagttgtgtcattgaatgttttagataaaatctttgaattatgaatattatgcacatgaaagagtatatataatattggtacagtttaaagaatagcaaacattggtgcatatta

SEQ ID NO: 61988 - DNA, 601 bp, Human
gctagtgactctgtacacagagaaaaaaataaagaacagtttaaatcatatcagggtttcttctgaaatttttttcagtgttggaatgtgtaacttttaatctcattttggggaattttaaaatttggtttggattaaagagcaaaatgttggaaaagtaaacagcttattatctaaaggcattaaatatctaaaggcattaaatgtctaaagatattaaagaatgcatactttcagattcacctttttaaatacattgaaatttttattcaccatcatggtaaatcttttaaatctgttygaattaacatattgtaaatgatactcaatatatacatattgtatgtgattttatatgcagtaagttataagacccatggctttttgaacaattgataatgaacatttaaaatggtaagatagatcttagaaatggtatctgatttcctcttacttctagtgagttgtgtcattgaatgttttagataaaatctttgaattatgaatattatgcacatgaaagagtatatataatattggtacagtttaaagaatagcaaacattggtgcatattagcctcaaatttaacactgaaagaga

SEQ ID NO: 61989 - DNA, 601 bp, Human
ctcggttgtcctataaagtaattcagtgtgtcttcaacaaacactagccaactcgatgcattttcccgttactgctttcagagtgttctactattcagcttaagaaataaaacattatcagtgactacagtttcctgagtgctctaccctgatcccatacttctctcttccttatacagttaacctgtagcatgagttttaagaaaatcattccatagcatggatctcttaaaaatagaattatatatatatatgtttatttttgtctatttttgaacgcgttagaatcatactgtgtttmttctttgactcatttttttcattcaggtttgtttttgagattcaaccgtgttgatatgtataattatagttcattcattttcccactatatattaatgcattatacgaaggtcctataacattgatccattctagtattgatgggtttttggattgttttcaatacttttttgaatattatcaacaatatgaataaaattatatgtggcttttagtgcacatgtacaagtatttctctaaggcatatacctgggagttaaattgttaggttaaatatggtatgtgcttgttcagctttcc

SEQ ID NO: 61990 - DNA, 601 bp, Human
ttcattcaggtttgtttttgagattcaaccgtgttgatatgtataattatagttcattcattttcccactatatattaatgcattatacgaaggtcctataacattgatccattctagtattgatgggtttttggattgttttcaatacttttttgaatattatcaacaatatgaataaaattatatgtggcttttagtgcacatgtacaagtatttctctaaggcatatacctgggagttaaattgttaggttaaatatggtatgtgcttgttcagctttcctaaatagaatcaaagtayactccaaagtgattgtagcaatatacactctccccggcagggtgggtgaattctagttgtcctatataccgacaaatatgatgggtgtaaaatgaaatttactgtggttttaatttttatgtctatgatgaataatgatgttgaagctctttttatatatttaggagtcattcttgaaatgcctttgtttttgttcactttattattgttggtttgtcttcgtattatttcataagattcctttacatattttcgatatgtgtcttttgtcgtctagatatattgtgagtgttttctcgt

SEQ ID NO: 61991 - DNA, 601 bp, Human
ctcacacttgctttttcatgtgaagtttgttctatggcataatcttagtaaagcgttttaaaaacaaaaagatacggaggctttttacaaccccttcgcctaattatatgattcattaaaagaatcttgggggtgggcatggtggtgactcatgcctgtcatcccagcactttgggaggacgaggccagcagatcacttgaggtcaggggtttgagaccagcctggccaacgtggtgaaaccccatctctaccaaaaaatacaaaaattagccagacatgttggcacatgcctgtggtccyagctactcgagaggctgaagtaggaggattgattgaacctcggaggcagaggttgcagtgagccgagatgatgccagtgcacttcagcctgggtgacacaccatacacacacacacacacatacacaatcttggtatgtaatgaacagagaaaatgctttcagttttgttttgtgcatctggaaagaaaatgggattcaaatgggctgaagaaacaggccgtacccctaagaaagaaagaaactgagaggcagatattcttggaacttttggtgcagaatgccagaagctagataagcac

SEQ ID NO: 61992 - DNA, 601 bp, Human
tgctctctttttgtgggtataacgtgattgtactagtaagcccaggggactttacaccactcctccttgatcagtcctgaagttcatgtattacctttttacctaaatttctttcagtgttttcttctctgctatcccttgagtatatctcttgagcttatcatgtgtcttggttgttgagggccagaactgaagaactgtccctatcccttcttgtgagttaaaagggaattaaggaaaaggaatctcactgcagaagaatgttttggttgttcatcctatatttaatcttgctcctttragtttatggtcaaacatgagcacatttataaaatgctttcctggggcagcgtggaagaaactgtgtttggaaagtgatattacactgaggacacttgggcaagaggcttctgcagcttcagtcgccattgctttgaagatcatcactcattgctcgaaatcttctatgaactcctgtaagttcagatgttaatagctgaacattgttcaacaaagtcttaaattgattttaaatggactggtatagcaaagcaattggaaggtatacaaaagagcaaaattgagaagctgggtgatctaa

SEQ ID NO: 61993 - DNA, 601 bp, Human
ctgtgtttggaaagtgatattacactgaggacacttgggcaagaggcttctgcagcttcagtcgccattgctttgaagatcatcactcattgctcgaaatcttctatgaactcctgtaagttcagatgttaatagctgaacattgttcaacaaagtcttaaattgattttaaatggactggtatagcaaagcaattggaaggtatacaaaagagcaaaattgagaagctgggtgatctaagcctgaagtcctcaaatatttaaaagacttagtttgtcaagatttaaccatctttttctgrgttcttttcatcactgttgacaaaagcaagcactggagaaaaatttttcttttgcctatggggccagcagtgaagatgagctcatctgtccatcaagctcttgctgctgctacctggcctcatttaatagctgtgaggccaaatccttactgtctttgaagtcagaacatgcaaagtttgagtatttgatgtatctttgagatgtgtcagtggccaaccaatgagagggatttggcagttagtgtcaatgctacaaaagacagttaattgtacgaaaaccacaggataaaactccaagtc

SEQ ID NO: 61994 - DNA, 601 bp, Human
aacaattgcttaatttttagttggttgcttctagtctttcaaaagcaatgtttcatgtttctgtggaaagatttttttcctagaaagtgcaaagtacgatatgacgtaggaattaggcaaataaaagtttctgcttgatttttttaaaacataaaagttgtatttcctctctttatagcactgcttttcctagacatccttttttcagacaacattactaaggagatttgatgcctacatatcagtcttcatctcaaaacttctaaaagaggccttacgcggtagctcactcctgtaatcycagcactttgggaggccgaggtgggcggatcgcgaggtcaggatatcgggaccatcctggccaaaatgttgaagccccgtctctactaaaaatacaaaaattagctgggcgtggtggtgggcgcctgtagttccagctaccggggaggctgagccaggagaattgtttgaaccccggaggcggaggttgcagtgagccgagatcgcaccactgcactccagcctgttgacatagcgacactccatctcaacaaaaacaaaaaacaaacaaacttctaaaagattgtaagctgtaacaaat

SEQ ID NO: 61995 - DNA, 601 bp, Human
tgggaggccgaggtgggcggatcgcgaggtcaggatatcgggaccatcctggccaaaatgttgaagccccgtctctactaaaaatacaaaaattagctgggcgtggtggtgggcgcctgtagttccagctaccggggaggctgagccaggagaattgtttgaaccccggaggcggaggttgcagtgagccgagatcgcaccactgcactccagcctgttgacatagcgacactccatctcaacaaaaacaaaaaacaaacaaacttctaaaagattgtaagctgtaacaaattctggcaartgacttgcaaatgagaagaaaaaaatcacgctcattcatgtaaaatggtatctgctttgagaataacccagtatcaagtatgtgttacttgaattagaactttgactttttaatatagagagatacttttatctttgacgtattttattaaaatgtaaagcacatgatgttcctttcctatttccttatattactctgtttttactgtaatgtttagaaatctactttctagtttaattgttatggagaaatcatcttcctgtatagattaaaattcaatcttttttgaactcaaagaaa

SEQ ID NO: 61996 - DNA, 601 bp, Human
atgagaagaaaaaaatcacgctcattcatgtaaaatggtatctgctttgagaataacccagtatcaagtatgtgttacttgaattagaactttgactttttaatatagagagatacttttatctttgacgtattttattaaaatgtaaagcacatgatgttcctttcctatttccttatattactctgtttttactgtaatgtttagaaatctactttctagtttaattgttatggagaaatcatcttcctgtatagattaaaattcaatcttttttgaactcaaagaaaaatttggaggsaaagataaatattaatgatggattatctaatatttgttccaatctcaacatgttttacttctcatagccttttatcttccagataaaattatgagcgcagatgtatagacatttaaaatgtgattttaaaaatgtataatgcttttaactttcctcatgtaagacttgtctatagggctctggatgtgtgagcaggctgcctggaacctcctagcctgctggttcctttactcctcccatatccaactgactcatagcttagtgaacagttttttgtttttgttttttctttaaattttg

SEQ ID NO: 61997 - DNA, 601 bp, Human
aaaacccatttgtaataaaaacagagttaagtataatcagtgttcccccaaatcaacgtatctctcttgtacaatttctcatcatattgggtaagggaaaatgtgatttttggcgtatctgtgatttctgaaggaaaggggtttctctgtagaacacaatgtgcttattctttttcactttaacactggtatctattaatggctaatgagctccattaggtttaatcaacatttcagcaatttttgacttgaattttgtttaaactttctgctttgtcttttaccttttgttctttattaygttagctcatttaatttttatacgtaggataaaacatacactttgaaatggcctcagaatttgaaagtatggctgtaaagggtgaaatcactgatgttaagggaacataactaataatggtcattgacgtacggatgactagaaaggccagttgtaattcgtgtttaaaaaattactatatcatcttcaaagatttatttatttatttttgttccttttcttggtgtggtttgtgtgttgatgggtggtgaatttggaggaaagaaatgagtcttgagaaaataccttggtcattcattc

SEQ ID NO: 61998 - DNA, 601 bp, Human
gacaatgaaatgtcaatttttgtattagtttcctggggctgttgtcacaaagtaccaaaaactgtgctgcttaaacaataggaatgcattgtcccacagttctggaggctgcaagtcgaagatcaaggtgtcagcaagttggttctttctgagggctgcgagggaaaatctattctgtgcctctctcctagcttttggggactcaagcattccttggcttgtaatggcattcttcccatgcctctttttatatgtctgtctctgaatccaaatttcttttttataaagacacagacatattggattggaacctagcctaatgactccaacttgatcatcagcaatgaccctattttcaaataaggtcatgtttattcacactgaggattagaactgcaaatatgtttttttttaggggggacacaattcaacccataagaattctgaaactttgttttgtccttttttgattagtgttaatacattttcagagtactttatattctcagggcttagaataagacaaagtaagattattcattcgagtatactgggttatttagtaagaaaatggactgagatttcataatgaactctctgc

SEQ ID NO: 61999 - DNA, 601 bp, Human
ggcatgtgccaccacatctggctagtttttgtatttttagtagagatggggtttcaccctgttggccaggctggtctccagcttctggcctcaagtgacctgcctgccttggcctcccaaagtgttgggattacaggcatgagtcaccacgcttggcttaatcacagatattaaaatcacatgtttgtttgagagttagagatacgtgtagagactttcaaagcattacttgaatttttttcatagttttttaaaactttgtttctaattattgaaataatcaatgcttactgaacaaatyttaaaaaataaagagaagtatgtgaagagaagtacttaaaatccaagcataatataatattaaatttgactggcgtagtgtctatctgtgagtgtgtgttcacatgcctatgtgtagaactaaagaataatttaaataaattatgacttatacaaatgtgaatgaatgtatgcccaaaattccatttaactgattgattaatgagggaaccagtaagatgttacaactgattcaaatgagaagttaaagtatcacatacatttaaagtcagaaaagaagtgctaaatgaatttacaaaaa

SEQ ID NO: 62000 - DNA, 601 bp, Human
taatcacagatattaaaatcacatgtttgtttgagagttagagatacgtgtagagactttcaaagcattacttgaatttttttcatagttttttaaaactttgtttctaattattgaaataatcaatgcttactgaacaaatcttaaaaaataaagagaagtatgtgaagagaagtacttaaaatccaagcataatataatattaaatttgactggcgtagtgtctatctgtgagtgtgtgttcacatgcctatgtgtagaactaaagaataatttaaataaattatgacttatacaaatrtgaatgaatgtatgcccaaaattccatttaactgattgattaatgagggaaccagtaagatgttacaactgattcaaatgagaagttaaagtatcacatacatttaaagtcagaaaagaagtgctaaatgaatttacaaaaaggtgcataaggctggacacggtggctcatgcctgtaatcccagcaatttgggaggctgagataggcagatcacttgaggtcaagagtttgagaccagcctggtcaacatggtgaaaccctgtctctactaaaaaaaaaaaaaaaaaaaaaaaaaaatt

SEQ ID NO: 62001 - DNA, 601 bp, Human
acatacatttaaagtcagaaaagaagtgctaaatgaatttacaaaaaggtgcataaggctggacacggtggctcatgcctgtaatcccagcaatttgggaggctgagataggcagatcacttgaggtcaagagtttgagaccagcctggtcaacatggtgaaaccctgtctctactaaaaaaaaaaaaaaaaaaaaaaaaaaattaattccagctacttgggaggctgaggtgggggaattgcttgaacccaggaggcagaagttgtagcgagccaagattgcgccactgcactccagccygggcaacagagagagactcaggcttaagaaaaaataaaaaataaaataaaaaaagtggtcagtttctacaaggcaatattcaattgcattccaatggatacaacatccatttctatttttgttatttttctgttagtaaatgagattgctgtcagtttctattattttcagagttgtaaaatggctcaaagacaataaaagccagagaaatgcatgagctagtcagggaacctactaatttgtcatgttttttctttttgcccattttgaagtttttcacacagtttttaatacagctca

SEQ ID NO: 62002 - DNA, 601 bp, Human
aatttacaaaaaggtgcataaggctggacacggtggctcatgcctgtaatcccagcaatttgggaggctgagataggcagatcacttgaggtcaagagtttgagaccagcctggtcaacatggtgaaaccctgtctctactaaaaaaaaaaaaaaaaaaaaaaaaaaattaattccagctacttgggaggctgaggtgggggaattgcttgaacccaggaggcagaagttgtagcgagccaagattgcgccactgcactccagcctgggcaacagagagagactcaggcttaagaaaaaawaaaaaataaaataaaaaaagtggtcagtttctacaaggcaatattcaattgcattccaatggatacaacatccatttctatttttgttatttttctgttagtaaatgagattgctgtcagtttctattattttcagagttgtaaaatggctcaaagacaataaaagccagagaaatgcatgagctagtcagggaacctactaatttgtcatgttttttctttttgcccattttgaagtttttcacacagtttttaatacagctcatattgatatatattctcatcagttggaattatgtt

SEQ ID NO: 62003 - DNA, 601 bp, Human
aaaggacacatacattccaaagtgtctagtgatgaggcaaaattgttcatattgaattcctttttcttgctcaaggccatttctggaggaaacttgtaatattggagaagttacatgagcacattgtgtttgctgcatggaaaggagaatataaggcttctcagcacagtggctaagcagatcaagagttgaggttaggttagcaatcatgaggctgaggtgcaacttagactccagtcccctataaaatataccttatagagtttagagatttgatgcaattcaaagcaaatttactatrttgaacatcagcaatgtcccaaagaagaccataaaattctgtggtggttaaaatctgttgtttaaacattagaagtataatattaaacatttctttctgttggttctcgtcccattagaagagctagatcctaatagctctttggtaccttatcaaaacaggagaaacaataatttaatgatcctttaatccaggggtggtggctcatacctgtgatttcagttatttgggaggcccaggatcacttgaggccggggagtttgagaccagtctgggcaacatagtgagaccccgtctgta

SEQ ID NO: 62004 - DNA, 601 bp, Human
aatttgtgaccacaagctcagtgttttgaaaggtagaatcatacaaagaaacaactataatctaattaacctaagataagtagttaatgttttatgtgtcttcatcattttatatattttacatagaacaatatacttaattttgaatattccttttaaacttgtctgtttcacaggcatttttttctgtattaagttttcaaaaacatttttaatggtcatgtgccaatttttttctatggctattacataacattctctcttgttagacatttttgttgttttcgacttttccctactrcaattaataatgacatgaaaagttttgtataaaacacttcaagttgcagaacatctctttacagaatattcctagaagtggaattattaggccaaatggtaggaatacttttaagctttctgtatatgttgccagattgctttttaagaaggttgtaccaatttacactcccactagcaatgtaggagagtgcctggtaactttttaattggatttctttgataagaaactaaatggacaacatttaactgttcatcaaaaagagagaggagtttgttgaatttctgttattgcactaaa

SEQ ID NO: 62005 - DNA, 601 bp, Human
taagtcaatatatcttttgctatcccactgtttaccaattgcgtatgagctaattaactatgcagaaatgtgttatagcagaaaagatttagtagtgttatacggtaggctaaaaggagtactggttagaaaaattatcaaactatatcctatcatttttccatttatccatatcaagcattttccactataatctctgttatgtaaactggtaactatacctatgttgttaaaggaaaatttaccctaatgttaaataatataaaatcccaagtctcatagattggtgggcattgtggarcttgcagattaaaatataccgcccacccccccaactgaaggaaatgtaggaactctgtatagtcagccttctgtatccctggattctacatccatggattcaaccaacctcagatggaaaatatattcaagaaaaaaagtgagtgagtgtgtctgaactgaacatgtgcagactttaaatcattattccctagacagcagactataccaactatttacatagcatttacattgaattaggtattataagttatctagagatgatttaaagtgaacgggagaatgtgcataggttatatgc

SEQ ID NO: 62006 - DNA, 601 bp, Human
tgagacaaggtcttgctctgttgcccaggctggagtacagtggcgccatctcagctcactgcagcctcgacctcctgggttcaagcaatcctcctgactcagtccctgaagtagctggaactacaagtgtgcgctactatgcccagctaatttttgtatttttagtaaagatggggtgtcatcatgttgcccaggctggccctgaactcctgagctcaagcaatctgcccacctcggtctcccaaagtgctagaattataggcatgagccccggcagctggccaaggcttttattctttcmctgtagagaatttataagtattacagctaaacaagaaaataacgtactaatgtggattcatggttcaggcatacaagttttttctcttaatactaggttctctcaattctgtgaacaaggagttgtactacttttctctttgggcttatgaaacatctagaataattaaatcagaaaagggaaaatatttgttaagtcaaaggaagtattttcttcatctttgtaaacataagtctctacagcaccgtaatccatataacctcagcgtcaagtcagattttttttattgcctgaaaactg

SEQ ID NO: 62007 - DNA, 601 bp, Human
cttattttaggttctaattttaaaatatacatcatttttcatattctttagaatttataaaccaccctagaatttataaaccacctttaatgtgtcatcattaaattgtagctttcaaatgtaacagaatctgtaatttactgttacaattagaagatatgaatcaattccttagcttaaaattttttgttgaaaaagaaaataccatgacaactgactgtcttcagaatcatctagggctgattgattcataatctaaatttagggattgttcatatcagaatctaaggaggacttcacrttgcattcattttgttaattcagcaaaagtagtactagttagatctgggaaagtggatgttaaactttatgaatgccagactggattatagttttctcatttgtacagttagcttaatgatttctaaaaccttttttcctttattttccttttccttctcctgttactctgttggtattctgcatgcagataaacatgtgtatctacatgtaacatgtacacagaagccaattcatatatgtgaaaaagctattcactcctgaccacagagagcatgtcttagttttctttaatcctgaa

SEQ ID NO: 62008 - DNA, 601 bp, Human
gtctgacatggaccatacggagctaaaatcaaggtgctggcaaggtctcattcctttctcaagtatctgagagggatctgtttccttgccttttccagcttctagaggctgcccaagttccttggcttgcgaccctctttctccagtttcaaagctggcaaaggtgagttgattccttctcacatcacatcactataatttctaccatcttcacgtctctcactattaactctggccctcctgcctcttcttataagtaccttgtgataacattgggcccacccagaaaatcaggatcatygctctaactcaacatccttaatcgcatctgcaaagtaacttttgccatgtacgataacttattcacaaattctagggtttagaacatggacatctttgggggctgtttttctgccaggcactctgagtgtatgccagtagctgaaagcaccagaggtcttttccttgtaattatacagggaagttgcttttttgcttagcaaatacaagtgcttaggccaaacctgtctgaggttttagctcaaagagaagtgctccattcttttaagtttagatttcattccaaatgtgtaaccagcaa

SEQ ID NO: 62009 - DNA, 601 bp, Human
ggtaaattagacaaagcagatttatcatgccatttcttttttgaatggcagtgttagtccaagttcctgttgatggtctcactattctttccatagttctgttacataaatgtgaaactttaatacctaaataattctaaatatatttttaatgaggaagtcttcaggacagtggttttccaagttattttgtagcagaaggctttttgcaagaaaatatttttgtatatggcagcatggagctgccatatacaaaacaaatatatgtggagctactctggttgtataaggtgataaggcrccaagtccattggttagtgcccccaaaacacatattccagtgtctgctaacttcactggtttctagggaccatagtgggtttcagtggatagggctatttatttggaaaatatttaataagtattgaaatatgccaaataatatatattagggtcaaggagctatgggaactctaaaggaaggtgtgtgtgtgtgtgtgtgtgtgtatgtgtgtgtagcaggttaaacaaatgagttctccaaaaatttattttgtaaatgttaatgctaagtcagtgtttattctctgagctaacctca

SEQ ID NO: 62010 - DNA, 601 bp, Human
tattttgtgagaaacaggtcatttttcaagaagactacttatttagtaaataaaaccataaaatattttaaagattttggttggaattttaaaagactgtgtatatttttattctttataaaaggttattaaatttagttttaaacttaattcacataaagggtatttattatgatccggggggtaattgtgcacagttccgcattcactttttggatttatttttttcccctcatcccagaagccagaatgtaagctacatttctgtttgtattggacctttgagagactatgctacatrgctaatggaaaaacctgcatacgagtccaagttctgcctcttctaaaattcattaccataaaggaagttggttagccacagggagtttcttaggctttctcagtttgatttcttagtccctagaaagttcaagtctgtaaaaactagaagtttttataaggaagttatgagaagtaaatgacaaggtatttgaaagtacatgacattgtgtatggcatatgttaattgaccagtgaatgctttacatcccttgatctcttaactagaaattaagtggcagactgataactcctaagttca

SEQ ID NO: 62011 - DNA, 601 bp, Human
taattgtgcacagttccgcattcactttttggatttatttttttcccctcatcccagaagccagaatgtaagctacatttctgtttgtattggacctttgagagactatgctacatagctaatggaaaaacctgcatacgagtccaagttctgcctcttctaaaattcattaccataaaggaagttggttagccacagggagtttcttaggctttctcagtttgatttcttagtccctagaaagttcaagtctgtaaaaactagaagtttttataaggaagttatgagaagtaaatgacarggtatttgaaagtacatgacattgtgtatggcatatgttaattgaccagtgaatgctttacatcccttgatctcttaactagaaattaagtggcagactgataactcctaagttcatatcgacagcttcccctcttctgaattccacactcatatatccaattgcaataattggcttcttgacttagatacctaacagacgcctcatactccaaatgtgccaaatggaacttccaattattgcctccaaatctgctccatcctttctaacagctgatggcaactccaaccttccgcttac

SEQ ID NO: 62012 - DNA, 601 bp, Human
tacatagctaatggaaaaacctgcatacgagtccaagttctgcctcttctaaaattcattaccataaaggaagttggttagccacagggagtttcttaggctttctcagtttgatttcttagtccctagaaagttcaagtctgtaaaaactagaagtttttataaggaagttatgagaagtaaatgacaaggtatttgaaagtacatgacattgtgtatggcatatgttaattgaccagtgaatgctttacatcccttgatctcttaactagaaattaagtggcagactgataactcctargttcatatcgacagcttcccctcttctgaattccacactcatatatccaattgcaataattggcttcttgacttagatacctaacagacgcctcatactccaaatgtgccaaatggaacttccaattattgcctccaaatctgctccatcctttctaacagctgatggcaactccaaccttccgcttactctgtcagaaatcctgaaggcatctctgactcccctttctctgttacacctcacatccaatctaccattagttcaacttgctaaataatccagaatctggtaacttctcac

SEQ ID NO: 62013 - DNA, 601 bp, Human
gttagccacagggagtttcttaggctttctcagtttgatttcttagtccctagaaagttcaagtctgtaaaaactagaagtttttataaggaagttatgagaagtaaatgacaaggtatttgaaagtacatgacattgtgtatggcatatgttaattgaccagtgaatgctttacatcccttgatctcttaactagaaattaagtggcagactgataactcctaagttcatatcgacagcttcccctcttctgaattccacactcatatatccaattgcaataattggcttcttgacttaratacctaacagacgcctcatactccaaatgtgccaaatggaacttccaattattgcctccaaatctgctccatcctttctaacagctgatggcaactccaaccttccgcttactctgtcagaaatcctgaaggcatctctgactcccctttctctgttacacctcacatccaatctaccattagttcaacttgctaaataatccagaatctggtaacttctcaccatctctgctgctacaactctagccaggctggcatcatgcctagctctgattactacagaaacctcgtagctgttc

SEQ ID NO: 62014 - DNA, 601 bp, Human
ctgtgtccacagctgctgccttttaaacaggacccatagcatgatattctggacaagggccttttaaggtgtctagttttaggtgttgggcaaagcctttcctttagtgttctgggcttctagagcaccacccatttttccccttacagaatgttcactttctgtcttctgggtacccctacattagtttctgttgccctaattaagacctcttttccagaagcaatctattatttttgtccagtgagatctatttaccctagaagtgtttgttcttataccttaatttttaaagtttttkttcagtaaaaaacagatatgaataagttggtaggaaaactattttaaaagggtatttttggccctataaaaatcccagcaggtatctctgcctacttttttgttttataatgtctagctctgaaattattgtagcctctgttttctgtttgttaccagatgatattttaatgttttccttccggatgttaaatgtcttttcttctctttagtgccacttagaaaacttggaaataaacaaaaaatgaagctcatatatttttttaccactgtctagaaaccattactataatgctggtct

SEQ ID NO: 62015 - DNA, 601 bp, Human
ttttaaagtttttgttcagtaaaaaacagatatgaataagttggtaggaaaactattttaaaagggtatttttggccctataaaaatcccagcaggtatctctgcctacttttttgttttataatgtctagctctgaaattattgtagcctctgttttctgtttgttaccagatgatattttaatgttttccttccggatgttaaatgtcttttcttctctttagtgccacttagaaaacttggaaataaacaaaaaatgaagctcatatatttttttaccactgtctagaaaccattactataatgctggtcttaattcatacttactagaattgggagatgtatttgacttactcataaatttgataggtggaaaaagtagcttatttattacgaagctgaaaatgtaatgttttttagccatttgtattttttctcatgaattgtcttctcatttacattttaaatattaatgatatttatatgataaaacatttcaaatgtgcttgacatacattaatatagttttcaaatggaaatttttaatcattttatggtagacattatttcatttaaaaaattctaaaatgggctttattt

SEQ ID NO: 62016 - DNA, 601 bp, Human
ttactcataaatttgataggtggaaaaagtagcttatttattacgaagctgaaaatgtaatgttttttagccatttgtattttttctcatgaattgtcttctcatttacattttaaatattaatgatatttatatgataaaacatttcaaatgtgcttgacatacattaatatagttttcaaatggaaatttttaatcattttatggtagacattatttcatttaaaaaattctaaaatgggctttatttagatagcaacacattttatcagtattttcttctaaattttttcatttagckgatttttaacatagttctttaatacttttggaattcagttatacaaatggtagttgcatataataagcaaactgtgagtttttttctaaattgctatacaaatttgtcagccagtttaattgaataatgtatattcttttctgttggtatgtaatatattagatcaactaaaataatccactagaattagcaaactaggtagaaattgactatatttaattagagctagaagccagatagtacagtagagaaatggatggcagttcaaaattctggaatatgaagaaaaatagaaaaaga

SEQ ID NO: 62017 - DNA, 601 bp, Human
gggctgagatggagaagttgaagacacaggatggattaggcaaaggattgatgaaactatatattggaaagggcaagaaaagggagtgtaactcccagatggatctgtcaacatggggtagagatgaatgctgtttccattgtagaaatagaagatacagagagttatggtgcaggtagatttgtaggtaggagggcctgaagttgaggaagattccataatatgtcctctgtttcttctataaattaagaagggaagcattctctgagagtgaagaggaaggaaggtcatacatgttatktatatgtcttctccttcattcatttgctcaaaaaaacacttattgaatgtttccatgtgccatgttctgtgttaagactagaagaagcaaccaaaaatgaagtgcacagtggagtctatcaaacaacttcagtcacgagtcagccaggcagccacatgatgaaaaggactctgtcacttctccactgcaacaactaagtcaccactgagtcaaaaataggatctgcttgactaggtgttgccagtttggggaaaacattttcagtttggttgatggcatcaaaatttaaaaaaaggcttc

SEQ ID NO: 62018 - DNA, 601 bp, Human
caaaggattgatgaaactatatattggaaagggcaagaaaagggagtgtaactcccagatggatctgtcaacatggggtagagatgaatgctgtttccattgtagaaatagaagatacagagagttatggtgcaggtagatttgtaggtaggagggcctgaagttgaggaagattccataatatgtcctctgtttcttctataaattaagaagggaagcattctctgagagtgaagaggaaggaaggtcatacatgttatttatatgtcttctccttcattcatttgctcaaaaaaacacytattgaatgtttccatgtgccatgttctgtgttaagactagaagaagcaaccaaaaatgaagtgcacagtggagtctatcaaacaacttcagtcacgagtcagccaggcagccacatgatgaaaaggactctgtcacttctccactgcaacaactaagtcaccactgagtcaaaaataggatctgcttgactaggtgttgccagtttggggaaaacattttcagtttggttgatggcatcaaaatttaaaaaaaggcttcatgttgatacaagtgggtagatatgaaaccaggtgttaaa

SEQ ID NO: 62019 - DNA, 601 bp, Human
agcaaccaaaaatgaagtgcacagtggagtctatcaaacaacttcagtcacgagtcagccaggcagccacatgatgaaaaggactctgtcacttctccactgcaacaactaagtcaccactgagtcaaaaataggatctgcttgactaggtgttgccagtttggggaaaacattttcagtttggttgatggcatcaaaatttaaaaaaaggcttcatgttgatacaagtgggtagatatgaaaccaggtgttaaaatatacacatatatttccttgctccgcatactgcagtgttcattgytacactccagcagcaaggatcatacccagcactgagatcgtgatttctaatacctttgcaaattgaaggaaccagagatctgtgaaaaagtggcttaatctagggctggttcaggaatatacgagaaaagcttggagtatcttttagtgcccataaattaggaagtgctcaaatacacacacacacacacacacacacacatacacacacacgatggtgatatgtcagttggacacaggagccaactgaaagagttcccaatggctaaacaacctaagaaacaaaatgaataatgtatta

SEQ ID NO: 62020 - DNA, 601 bp, Human
agtggcttccaaccttggctgcacattaaaataacatgggaataggtaaaaatcccagtgcccaggtttcaccctaaaataattaaatccacatctctggggtgagacacaggcattttatttttgtttgaaattttcaaagaagatatcaaaatttgcaaggcataatcaaataaggcaattaacatactttagcctatacctaatattttgcttgtttttagtttcaaatcatcctaggatattattgattactcaactgattgacatggtttgggaaataaggtattttgaaaggaawaatgtcttctttttataaactgtacaggaaccttctattaaattctgtaaatgtcattgatctcaaatccatgcatcacatgtgtaaattatattatttgtgttgtgtttgaagtaaagcatgattgataacatttgatgtgaaaatatatgcaatggcagtaacgttatcatttctaaaagaacagaacccttgaagacaaagggtagaagtaatgtcagtcctgtttctacaatatttgagctatgtgaccttgagaaagtcatttaaactttctgattcttaattcccaggtctata

SEQ ID NO: 62021 - DNA, 601 bp, Human
atggtttttggaattgaatttggcttcccacattagttgtatcttactagctgtgtgactttggcatgtgacctaacccaagtttatgtaaaatggtttcaataacatgttcctgtcttagcccattttgtgctgctgtaacagaatacctgacactgggtaacttataaagaacagaaatttatttcaagaacagttctaaaagctagaaagttcaagattatgatatcagtatctgacaaggaccttcttgctgcatcatcacatggcagaagggcaaagaaagggcaagagggggccraactcatcctttcataatggtatcaatcccagccatgagggtagagccctcagggcccgttcaactcttcaaattactacatcttaatactgttacaatggcatttaaatttcaacgtaagtttgaaggggacagatactcaaaccatagcactttattagaagttgttttaagaatttaatgagacaatatatgttaagggcctactgcctggcatatagtagatactgaagaaatggttgttgatagtgatgataatgtaatataccactaacatgttaaatgtgtttctgaatgcat

SEQ ID NO: 62022 - DNA, 601 bp, Human
cccacattagttgtatcttactagctgtgtgactttggcatgtgacctaacccaagtttatgtaaaatggtttcaataacatgttcctgtcttagcccattttgtgctgctgtaacagaatacctgacactgggtaacttataaagaacagaaatttatttcaagaacagttctaaaagctagaaagttcaagattatgatatcagtatctgacaaggaccttcttgctgcatcatcacatggcagaagggcaaagaaagggcaagagggggccgaactcatcctttcataatggtatcartcccagccatgagggtagagccctcagggcccgttcaactcttcaaattactacatcttaatactgttacaatggcatttaaatttcaacgtaagtttgaaggggacagatactcaaaccatagcactttattagaagttgttttaagaatttaatgagacaatatatgttaagggcctactgcctggcatatagtagatactgaagaaatggttgttgatagtgatgataatgtaatataccactaacatgttaaatgtgtttctgaatgcatgacctcagaatatatgtcaaatatat

SEQ ID NO: 62023 - DNA, 601 bp, Human
atgtaatataccactaacatgttaaatgtgtttctgaatgcatgacctcagaatatatgtcaaatatatacactggttcctttttacaaaagcaagtgttaatgaatgagtgtaaaactccttagcttaaaaagtccactttacacatctataggtagtgatttgagaagttcctagaggacagttgatatggtgtgttagataaccacagattggaaatgctagccctctggacactcaaactttaactctggaaactgggttacactggaaagaatctacaataaactgaccttccackggacacgtggagtattctaactaatgcagaaatccgaagcagactagagtatccctgatctccttagtggtgtagaatctcacactgtattatttatttatttatttatttatttatttatttatttatttatttattttgagacggagtctcgctctgtcgcccaggctggagtgcagtggcgggatctcggctcactgcaagctccgcctcccgggttcacgccattctcctgcctcagcctcccaggtagctgggactacaggcgcccgccactacgcccggctaattttttgtatt

SEQ ID NO: 62024 - DNA, 601 bp, Human
aaatgctagccctctggacactcaaactttaactctggaaactgggttacactggaaagaatctacaataaactgaccttccacgggacacgtggagtattctaactaatgcagaaatccgaagcagactagagtatccctgatctccttagtggtgtagaatctcacactgtattatttatttatttatttatttatttatttatttatttatttatttattttgagacggagtctcgctctgtcgcccaggctggagtgcagtggcgggatctcggctcactgcaagctccgcctcccrggttcacgccattctcctgcctcagcctcccaggtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatttttttttttttcagaacatgttggcttagtattctctgggcaggaggccatgccaaggaaagtttttgacctttcaaaacctcccaaaggt

SEQ ID NO: 62025 - DNA, 601 bp, Human
tctggaaactgggttacactggaaagaatctacaataaactgaccttccacgggacacgtggagtattctaactaatgcagaaatccgaagcagactagagtatccctgatctccttagtggtgtagaatctcacactgtattatttatttatttatttatttatttatttatttatttatttatttattttgagacggagtctcgctctgtcgcccaggctggagtgcagtggcgggatctcggctcactgcaagctccgcctcccgggttcacgccattctcctgcctcagcctcccargtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatttttttttttttcagaacatgttggcttagtattctctgggcaggaggccatgccaaggaaagtttttgacctttcaaaacctcccaaaggtaatgggagaagtgataattattacggaaaatgt

SEQ ID NO: 62026 - DNA, 601 bp, Human
ttgtcaaattagaatgtgcacaccaatctctcgctaacttgacaaatgcacattcctaggtcccaaccttaggattatgacttaataagcctgggatcctgaatgtagcccacagaaatccacttagtaacacccgtttacaaagagactcctaatctgcgtggtccaaggcacattttgagaaacactgactgtgctatgttcttttctggagacagacagggactcatgtctccctccttggcaacagctattctttcatgggtaattcctatgtactatttgaatatcaaaatatttwtatctccctaagaatggggagacacaacgtatttgccccataagggtaaattgcaaacaaattgctccagtgcttcagaaaggactggttattcattcctgggactgctttataaagagagatcttctcaatattcaaatgtattacaggcatagaaaattttttgcatgaatatataaagactaagaatcagttctgttttttacagcctgagaggacatattttgaaagctttctaatccttgctatgacaatgactgaacttttagagggctcagagttagagcttcaaagatattt

SEQ ID NO: 62027 - DNA, 601 bp, Human
aactggggagtcatggtcatataaatggtattttaaaaaactagttagcctgagatcaccaagggaatgaatgcacatggaggaggtctaaataccaagtcctggggtatacctggggggtggggtgggtggcattaggctaaagatagtgaaaattctaatgaatgataagtaatattttgctatgttgatcttgagattgatatgttgaaatggcagcatcctagaccaatcccaagtttaatgccttccttgaagttgccatgtttctgtttcggagtccttggtgccacaggtcccycttgactttcacaggccagggcttcttgccatacaggtaagtgttctcccttcccagcttatgggatccagactcatcagctgcccgctgtaggttgtccttaaaacttagagaatatgcagagagcatacacaattctgcttagaggaggagcactctccttttcctcttgtctcagttgtgatcttgtcttctttctctaatttccttttcctctattgaactttcaacaggcaaattctttggtctgcagagccaaaagaataattgtctttctttttaagttaatagtacttagat

SEQ ID NO: 62028 - DNA, 601 bp, Human
cttgatattttctgatttgaataccctgagctgttgaccaaagcaacaatgaaatttataatttcttaacgggtgtgtgattcttgggatttctttcagaaaacaatacttccctgatgtaggaatgtatcacttaaagtaaaaaatgtttttaaaatttgaattatagaagagaataatcagtggatgattcacttcgtagaaaagttctttgctttaaaatgactcatcaagtgctattgggaacatttaaaatgttatttcaattgcacatactctttaggaagatacaagtttattrctttatatgtgtgtatcactgataaaaggtattttcatatatttaacaaaaatttaaagggaggaatggttaaatgactgtctaaggactcatacctctttagtgggcaaccaagtcttgaaccctagttaccagttgtcatgtttacttgtagaactaccatcacggccccaggggaacagcttaagaaagggataggaggaataaaatggaagcactctatagaataagtcttcatctgtactcctgatttaacaaattctgatattacccactgtgtttaggtttcagtgacaagtt

SEQ ID NO: 62029 - DNA, 601 bp, Human
agcacatataacatatatagtattacatatgcatatcatttaaaaatattttatatatagctatatatcttatgtatgttatttttactataagaataataataaaatataaaatgaacacacaggcatcaaccattgagtctaagaagtaaccattccacaatcttggaaagcccctgtgggtccctaatctgtctcaccccattccttgccctcagaggtaacctctgtgcactaccctcttgtggttagaagatggagctaggccgggctcggtggctcacgcctgtaatcccagcaytttgggagactgaggcgggtggatcacctgaggttggtagttcaagaccagcctgaccaacacggagaaaccccgtctctgctaaaaatacaaaaagccagacatggtggtgcatgcctgtaatctcagctacttgggaggctgaggcaggagaatcgcttgaacccaggaggcggaggttgtggtgagccgagatccaccattgcactccagcctgggcaacaagagtgaaactctgtctccaacaaaaaagaagatggagctacattactgctccggagccttgggcaagttattatt

SEQ ID NO: 62030 - DNA, 601 bp, Human
tcaagaccagcctgaccaacacggagaaaccccgtctctgctaaaaatacaaaaagccagacatggtggtgcatgcctgtaatctcagctacttgggaggctgaggcaggagaatcgcttgaacccaggaggcggaggttgtggtgagccgagatccaccattgcactccagcctgggcaacaagagtgaaactctgtctccaacaaaaaagaagatggagctacattactgctccggagccttgggcaagttattattctccctgtgcgtcagtttcctcatctgtataaaaggaatagyaatatatgtgttgtgaggactgaatgaggtcacccaggaagtgtgcttacaaaaatatgttgtgtagtcatcatcgtttactattcttgttactatcatcatgttcagttttacatttgaaggacttgtaatgttgccaacaagatggagtttgagggactaaaattgattttaagaataataatgttgttgttcctttttcaaatcttttaacatggaaacattctgatttggttgggggggggggcttttgacatcatctgtttcaccttatcactgtgtactttcaaaatatcttca

SEQ ID NO: 62031 - DNA, 601 bp, Human
ccggagccttgggcaagttattattctccctgtgcgtcagtttcctcatctgtataaaaggaatagtaatatatgtgttgtgaggactgaatgaggtcacccaggaagtgtgcttacaaaaatatgttgtgtagtcatcatcgtttactattcttgttactatcatcatgttcagttttacatttgaaggacttgtaatgttgccaacaagatggagtttgagggactaaaattgattttaagaataataatgttgttgttcctttttcaaatcttttaacatggaaacattctgatttgrttgggggggggggcttttgacatcatctgtttcaccttatcactgtgtactttcaaaatatcttcaagatgctttcattgaagcaacaagaaaattgttttgaacaaagaccctttagtgtcagtcactatttcagaatataacaccagtcattgtttatatgatttactcttaataggattttgatattctgctgtgtaacgttgctgctgactgaatgtctttgaagacagtaaaatttgaccgactacaaaatattacttcatttttggggggtttagtctgtttggtaaggttact

SEQ ID NO: 62032 - DNA, 601 bp, Human
aggactgaatgaggtcacccaggaagtgtgcttacaaaaatatgttgtgtagtcatcatcgtttactattcttgttactatcatcatgttcagttttacatttgaaggacttgtaatgttgccaacaagatggagtttgagggactaaaattgattttaagaataataatgttgttgttcctttttcaaatcttttaacatggaaacattctgatttggttgggggggggggcttttgacatcatctgtttcaccttatcactgtgtactttcaaaatatcttcaagatgctttcattgargcaacaagaaaattgttttgaacaaagaccctttagtgtcagtcactatttcagaatataacaccagtcattgtttatatgatttactcttaataggattttgatattctgctgtgtaacgttgctgctgactgaatgtctttgaagacagtaaaatttgaccgactacaaaatattacttcatttttggggggtttagtctgtttggtaaggttactaaagagtacttctaaaagtatgagaggataaaggattgagatataagagaaaagttgacaaaatcagaaaactgtgcaatga

SEQ ID NO: 62033 - DNA, 601 bp, Human
aaatatgttgtgtagtcatcatcgtttactattcttgttactatcatcatgttcagttttacatttgaaggacttgtaatgttgccaacaagatggagtttgagggactaaaattgattttaagaataataatgttgttgttcctttttcaaatcttttaacatggaaacattctgatttggttgggggggggggcttttgacatcatctgtttcaccttatcactgtgtactttcaaaatatcttcaagatgctttcattgaagcaacaagaaaattgttttgaacaaagaccctttagygtcagtcactatttcagaatataacaccagtcattgtttatatgatttactcttaataggattttgatattctgctgtgtaacgttgctgctgactgaatgtctttgaagacagtaaaatttgaccgactacaaaatattacttcatttttggggggtttagtctgtttggtaaggttactaaagagtacttctaaaagtatgagaggataaaggattgagatataagagaaaagttgacaaaatcagaaaactgtgcaatgaggtaatgagtaaccaaaacttgctatcttatcagtac

SEQ ID NO: 62034 - DNA, 601 bp, Human
ttgcctgtgattaaatttttgaacaatgtctgggatctaaaaactcacttgaaaatcattttttaaatcaaatttttttaaaaaagtgttacaattatagcaagtcatcatggaaaaataaagtaatatgggtatgtataatatgccttctaaacctctaagcatctggaagcagagatccatgttctgtgaatgacctactaatcttcttaatgagttcatagcaaggcatgtggtatttgcgatagaaaagactcagtaaaagctgtcttccattcagtttttgaaaagtgaatggatrccagtttatgttatttcctatagtgcctatcttaaactgatttttttttttttacttgctgaatctcatttcatgtcaatatgagttttgtattggtaatatagtgtttgtaattgatgatgtagccaactcctttattgaagtaaactgtgaagctaataaaacatcttcatgttttaaggccattaggagacatttttttctgtgtgtgtgtgtgtgtgtgtgtgtgtgtgtgtgtgtgtgtgtgtttgagaccaagtctcactcttgtcccccaggctggagtgcaatggcgcgatc

SEQ ID NO: 62035 - DNA, 601 bp, Human
tggccaggctggtctccaactcctgagctcaggtgatctgcctgcctcggattacaggggtgagccactgtgcccggccgtgtttttttgttttgtttttgtttgtttgttttttaacataatgaatactacaacagaaacataattaaatagcttctaaacatttgagaagatgaatggatcactcgtttctaaatggatagccaggagagttagttaagtatttctgatcttatagtgaatgataatgtttgtacaacctaatagttgccccttttcctttctttttcttctctaatartaatagcaaaaacattgtttctggcattcagtgagtgccagataaatagaaaggctatgagcttgatgcacagtttcttttctttttcctgggtcctctctcctcccaacctacatttcttggcatctttccgctgtctgtttgttagagttctgactctgacgtcaaggactcacagtgagtgacccccgtggcaaacctgtaaaacattatacaacatgaataagaactttcttattagatctgcagctggctgagtacagacatatggcagcaaggatgttttggaagaaaggcatt

SEQ ID NO: 62036 - DNA, 601 bp, Human
aaatctttgatgaggccattgtcttcctagtacttactgcatctacaataatttagtcataagatattgataaataaggtatgcccattggacatgcctgatgggattttaattaacatctgcctttgacaactgaaacaactgaagggagggagaggtacatgacttttgcagagcacatattatgacagacgctaggggtataacatctagcaaataggtacttgatgacatttttatgaatactatgatttatcaaaataagtatatcctgagaagtatatatttatagatgaaacagtatttacagagaatagactctagtttagagaaactgaagagcattagtaaaagtgttaataagaataatattttaagtactatgagggacttttttcctggtttttaggttttcatgttaaaaattcatgagcaggacagatatgtttgtcttgttgattttatctctataacgggaattcaaattttaaatatgttctagaatcatgaaagtcatggctagaaaggtcttggagattatctaattgaggagtcccaaatctctaaataaaatctaccagaagaatcataggtcaattac

SEQ ID NO: 62037 - DNA, 601 bp, Human
ctttttctttgcttagcgtaaacactcaaactataagttatagctgataacactcaaattataacttataagctgtaccataattcatagtagtcaatgaattagtcagctaaacttgaacatattactacaacttatgggcatacccaactccagatagtagaaataagactcagagtatacatttcatgagataaatctaatgtgagtatccaataatagattcaaatatttttcaagaattgactatgagtctgtgaatatatattaatgactatacaatacttttttttttttttttaagagatggggtctcactgtgtaactcaggctggactctagctcctgagctcaaatgattttcccactcttagctcagccacactctgcgtagctggaactataggtgtatgccatcacgcctagcttaaaatatattttattaagaattggtgctatggaaaagtattgcttcaaccatttcccccttttcaagctaaaattaattagtaatttaaaaagagacatgaacatcaacaaattaaacaatggaacaaggatcattcaagtcctcctataggcctcttgatctgtacattaa

SEQ ID NO: 62038 - DNA, 601 bp, Human
gaaatttattctgttggaaaaaaaaattgcactgtaactatttctttgaactttgggaagtatatccttattagagaattacagtgtcaagacattgcgctattattaaacaaatgataccactattttgacaagagtggtactttccaaaatacctaagaagttaattgaagacttggaattatcagaggatttattttatgttgaaaattctgacttatttttaaattgtttattccatctcataaacttctatttgttatttaattttaggaactttgaaataaaagtttttttttttaatatatcttatgtcctgtgtgcaagtctaatggatagatctgtaccttgaagttccaacttctgccctcagagatgaaagtgacaaacagcaaaatatggagcagatacattgaaaactttaagaaacttaatttttatttagtttgtgcttatttactaatatgttctctgaatgcaaagtaagtatacatgtagagtcatctttatgaaaagctatataaagagctataaataaaagggatagataggtaagacaaaaaaaggcacactgacaaaatctgcggtaagaaatataatg

SEQ ID NO: 62039 - DNA, 601 bp, Human
ttaaggagtttgcatttttttcaagatagttatttatagtacagtatgaaaagtacacaaattttgagcagtattttccttttttcatggcttcccttattcaacttctttaagtaagtaaaattccacctcagaaatggttatccatgttccctatctcctccattcctattgtctctgccttgactcaagacctccttatctcttgcctggattatagaactgtgtcataacaggtctttctgcttggagttacccaccttcacttgaccacaatctgtgatacccagtttctttttctttttttttttttttgttttgagacgtggtctcgtcctgtcacccaggctggagtgcagtggcgccatttcggctcactgcaagctccgcctcccgggttcccgccattctcctgcctcagcctcccgagtagctgggagtacaggcgccaccaccacacccagctaatttttcgtatttttagtagagatggggtttcaccgtgttagccaggatggtctcgatctcctgacctcatgatccgccccgcccccctttggactcccaaagtgctgggattacaagcatgagccaccgcgcc

SEQ ID NO: 62040 - DNA, 601 bp, Human
tacccagtttctttttctttttttttttttttgttttgagacgtggtctcgtcctgtcacccaggctggagtgcagtggcgccatttcggctcactgcaagctccgcctcccgggttcccgccattctcctgcctcagcctcccgagtagctgggagtacaggcgccaccaccacacccagctaatttttcgtatttttagtagagatggggtttcaccgtgttagccaggatggtctcgatctcctgacctcatgatccgccccgcccccctttggactcccaaagtgctgggattacargcatgagccaccgcgcccggcccccactttcttacactgtatctttctaaagaataagtctgaacaaagtagtgactattttaaaccaatagtatacatttactaaattcttagcctgcctttcaaaattacattcagatttttccaccattttctttttagtgcatcttaagtacaggtcatccgtgcgcccgtcttttttctgagcaaatcacctgtgtactttcacattccttagcatactgccaggggtgttccatatacctggcatgatcctccagcccccactacccgacctac

SEQ ID NO: 62041 - DNA, 601 bp, Human
ttattgaaatatgattcacataccatgtgatttatccacttaaagtatacaattcattgttttttagtatattcacaaagttatggagctatcgccactaatccagaacattttcatcatgtcccctaaaacacctatgcctgttaacagccacttctcatttcacctacctctctactacttccaggcttaatcaatgactaatctattttctatctttatagatttgcctattccagacttttcttataaaagtaatcaaaatatttgcagtcttttgtaattaccatctttcacttakcataatgttttgaaggtttatccatggtgaagtatgtatcagtactacttcatttctttttgttgccaaataatattccattgtatggatataccatttttgtttatccattgattagttagtagacattttagttgtttttgctttttggctattatgaataatgctgctatgaacatttgtgttcaaatttttgtgtggatatttgttttcatttctctggaatatacatctagaagtgaaattgctggatcatatggtaaatccttgtttataagtttgagaaactgtcaaatggtt

SEQ ID NO: 62042 - DNA, 601 bp, Human
ttcttaattttagtgttttccaaaccgtgctctgtggtacacaagatgctccatgactaaggtagattgagagatgttgtttgctttatttcttactctgagcacacaatattaaaggccatatgatattctattttaaaaataacatgtctagcccagcatttccaaaagccgttttaatctttttccctgaaacagctattaaacccaagttctgtaatatatacttcagaaatattgttttaatctattctctgaactagttttacctggcttgtaggactatctgcctttgttcttaaaaaaaaaaaaaaaaacttgtgagagtctttttaaaattctatagtcagatctatgacaacaaaagagactgagacatccacaagttatttctaccatgtttgtttaactcaggagattgaatttgatgtgttatatacatggtatgaaccaaacgcataatagaaattgggtcttctctaccaatcagatagttagaaagatatgcttttacttcagagaaaattcaaagtcagctaaagtgtgtaggtctgtttcttttcaatttccagggccttttccattatgtatttgctgccta

SEQ ID NO: 62043 - DNA, 601 bp, Human
gtttgctttatttcttactctgagcacacaatattaaaggccatatgatattctattttaaaaataacatgtctagcccagcatttccaaaagccgttttaatctttttccctgaaacagctattaaacccaagttctgtaatatatacttcagaaatattgttttaatctattctctgaactagttttacctggcttgtaggactatctgcctttgttcttaaaaaaaaaaaaaaaaacttgtgagagtctttttaaaattctatagtcagatctatgacaacaaaagagactgagacawccacaagttatttctaccatgtttgtttaactcaggagattgaatttgatgtgttatatacatggtatgaaccaaacgcataatagaaattgggtcttctctaccaatcagatagttagaaagatatgcttttacttcagagaaaattcaaagtcagctaaagtgtgtaggtctgtttcttttcaatttccagggccttttccattatgtatttgctgcctaccattattgctactattccatgaaaaatcgcactctgtgtgtgtgtgtttagatttgtatatgtctgctcaaatagag

SEQ ID NO: 62044 - DNA, 601 bp, Human
tagtttctggttctaatgaacgctgaaatatggaattgctaaaaagtaaatttagttagaataacaatagcttgatagaggaaaatcattacaaactcaagcggagaattccagtttagctatgcccttgaagttgttattatactttgcatataatttattgattctgaaaagttggatttgccatcttctgagaatattatcttgggcatatggggcacaccctgcaaccagaaacagcacaggaatagtcattccttcatgacaacttctacgaaagtgtaaattgaggctaacaggraaatcaccctattactcctgtaaagtgacgatagctttcagttttcaaatgcgactttctgatcatgtttgaatgtgtttctgttcatgtttatggagaaatttaagaattagaattgtgattcttaattctaattcttaaatttctccacaagtaataggaaactaaagaatttttctgtggtaatttcattaggaaaactttggctaggacatggtgataatgtgcagatattttgtttgccatgtcacattcttccccttcttttctggaatgcaatcaatggtgaaacatgtttta

SEQ ID NO: 62045 - DNA, 601 bp, Human
tttctgatcatgtttgaatgtgtttctgttcatgtttatggagaaatttaagaattagaattgtgattcttaattctaattcttaaatttctccacaagtaataggaaactaaagaatttttctgtggtaatttcattaggaaaactttggctaggacatggtgataatgtgcagatattttgtttgccatgtcacattcttccccttcttttctggaatgcaatcaatggtgaaacatgttttacggtaaaacatttaatactccaaattgtgaataaagcaaagagaatgtgtttaatrtattttttaaatcatatactttctttaagaccctctcactcctaacataagctagagttttccgtttcaatatataatcaaaaaaccaagtatcctattaagtgtatattgttgactcaaattgacaaggacattggtaaccttccttttttttttttttttttttttttttttttttgagacagggtctccctctgttatccaggctggagtgcagtagtgcaatcgtagctcactatagcctcgaactcctgggctcaagcaatcctcttgcctcagcatctagaatagctaggacta

SEQ ID NO: 62046 - DNA, 601 bp, Human
aaagaatttttctgtggtaatttcattaggaaaactttggctaggacatggtgataatgtgcagatattttgtttgccatgtcacattcttccccttcttttctggaatgcaatcaatggtgaaacatgttttacggtaaaacatttaatactccaaattgtgaataaagcaaagagaatgtgtttaatatattttttaaatcatatactttctttaagaccctctcactcctaacataagctagagttttccgtttcaatatataatcaaaaaaccaagtatcctattaagtgtatattrttgactcaaattgacaaggacattggtaaccttccttttttttttttttttttttttttttttttttgagacagggtctccctctgttatccaggctggagtgcagtagtgcaatcgtagctcactatagcctcgaactcctgggctcaagcaatcctcttgcctcagcatctagaatagctaggactaccaggtgcacaacaccacacctggctaatttttaaaatattttttgtagagactgaggtctcactatgttgcccaggattgtctcaaactgctggcctcctcaactgatcc

SEQ ID NO: 62047 - DNA, 601 bp, Human
caaaatgcacatgtcttgttaaaatctaattgaaagtggaactaaagtaatttttggcacaaatcggctttagaggacaaataagaaagccaagggtcgcgtaatggggctagtatatattgtagtccgtctatgcttttctcaacaacctcccaaagtctagctgattggggagtaagaaataagtagcagggaaaatgtttggaattttgtcttttgctgaaggtttcttggcacttatgaaaacttcattgaatgaaataagactttaaaaattttgtaaaagactttttggaaaaasgtaactttcacattaaaattatataaaaaccaattcagtatttttctcatttataagacttaaaaatgaattcaatgttttaagtcacaccaattactgagatatattttttaaaattacctatttatcaattttaaagaccatttctaaaaaaggagtttaagtagagaatattcctttgagttagatagtttttggtatacgtaacagcatacacacacacacacacatacacttttaattttcttggacttatatattttaggcccataaatgtaaaccatttggatatcaaagcaa

SEQ ID NO: 62048 - DNA, 601 bp, Human
aaggtacttcaagactcctgtggtgcctttgggttggcagtttcagtattttttatgcttacatagagcataagatatataaatataaaacattatatataatatatattcaaatatatattttatatgtgtatatatatttccctaataaatattgaaagaatgcacacatgaatgagtggatgggtgaatacagaaatgaaaaatttgtattgagatgtgctaatagagaatttggtataactaaacatctgatatataatttatattttgaggtaactctttagccaacattttaaartatgattaatttatagtacttacgaaggattttcagagacattacatttttctgttatttcactgttttaaacaagatggagattagagggtggaaaatggattctggagaaataaacccatcatattaactataaccatgagttccttgaagacaaatcaaatctgatgtcttttctttttccttatgaatatacttcagtacgaaggacctgatacttagtttggacccagtaattatttattgttgtaagtagcacagtaagaataaaaacgtttatgatttgcaaccagccaacct

SEQ ID NO: 62049 - DNA, 601 bp, Human
gatgggtgaatacagaaatgaaaaatttgtattgagatgtgctaatagagaatttggtataactaaacatctgatatataatttatattttgaggtaactctttagccaacattttaaaatatgattaatttatagtacttacgaaggattttcagagacattacatttttctgttatttcactgttttaaacaagatggagattagagggtggaaaatggattctggagaaataaacccatcatattaactataaccatgagttccttgaagacaaatcaaatctgatgtcttttctttytccttatgaatatacttcagtacgaaggacctgatacttagtttggacccagtaattatttattgttgtaagtagcacagtaagaataaaaacgtttatgatttgcaaccagccaacctatattttaatccatatttaaccactggctgggttatgttacatttctcctctcttaactcatttccatatccataaaatatggagcatatgcctctatggtttcttggtgatgaaattatgtattaaaaattataaaactgtaaaaaatatatctcaaaatgtgtttgtgttccatggaaa

SEQ ID NO: 62050 - DNA, 601 bp, Human
attgtagtagagaggctagaatttcaaactccagaatatctgaatttgcctctatctgaagccttctcattcccagtgcttatgaaatttacactggctgctatattgaaatgctaagaatcagaatcagggatttagtatcaatcaagtggatggaatttagctagttatcaccaactgtgaaaggaaaaatatccgttaaattcagtcacaatgctatatatcaggctctcagtgattttttaaaggagggtcaattttaagaattctaaggaatctctttgttcctgctaatttgtcygaaggtttacgaggaatacaggagaaagctaaattgtttggggaacagtaagagatttagattctgagaaagatcctggaggaaaagctggggccagtatgctgaaaaagacacagtcctcttgccctaccccaagagtaaagggcaagaggtagtggctgccaaaaaaaaaaaaaacaaaacaaaacaaaacaaaaaaacctgaaaaaacaaaaaagttttgtggagagatatcgaatggatatttatatggctttttgctgtattttgtataatgtaatgatgtcctcttgtctcccc

SEQ ID NO: 62051 - DNA, 601 bp, Human
tagaaagtggactgtgtggtaacctttacatccttatatgtatattagttttatatgtcttcagaaatatgttttagccatcttcagctgctgtaaaagaatagttttcttgagagtagtgcaaagataactgtggtgactattactttccatcgttatcctctttttttcatatctaaaacttctcacctctttaaggtacacacaaataataattttttatttcccatctagttacagtcctccttcagctttcatccctttagtaatagttgtggtgaattttttctcccgagaagcycctaaaaaggcgttcatttttacgtaaacaaacaacaggagaaaaacatataaacatgaaagcaaaatattttacctacagaaatatattttcagcaatctatttctcatgctattgttaaaaatatctctacttggatagaacctttttgtttccatgctgacttcttctttgcttctcctgtgaactttttaaattctgtgtttggcagcagttttgttttccttggagctaagtactgtgtaacatactgttagctgaaggctgtgatgtagaaatttattattaaaaataaaagac

SEQ ID NO: 62052 - DNA, 601 bp, Human
gtggtgactattactttccatcgttatcctctttttttcatatctaaaacttctcacctctttaaggtacacacaaataataattttttatttcccatctagttacagtcctccttcagctttcatccctttagtaatagttgtggtgaattttttctcccgagaagcccctaaaaaggcgttcatttttacgtaaacaaacaacaggagaaaaacatataaacatgaaagcaaaatattttacctacagaaatatattttcagcaatctatttctcatgctattgttaaaaatatctctrcttggatagaacctttttgtttccatgctgacttcttctttgcttctcctgtgaactttttaaattctgtgtttggcagcagttttgttttccttggagctaagtactgtgtaacatactgttagctgaaggctgtgatgtagaaatttattattaaaaataaaagacggagagaagaatttattccataaggatcaaaatgacttagtgtcaaagcagttaggattttcaaaatgctttctataacagattgtgtttcttttcaaggaagtttactttgtttgccaggaataaatttaa

SEQ ID NO: 62053 - DNA, 601 bp, Human
taagtactgtgtaacatactgttagctgaaggctgtgatgtagaaatttattattaaaaataaaagacggagagaagaatttattccataaggatcaaaatgacttagtgtcaaagcagttaggattttcaaaatgctttctataacagattgtgtttcttttcaaggaagtttactttgtttgccaggaataaatttaagggtcttcattgtgcctatcttggttaatgagaactgagaagagaagaaacattctcttttaaaaaaaattttttttagagaatttcttcatcagacggaragattttatttgccatttgcaggcataaccttggtgacctatatatccccagaccttctggtaagatgcttattaaaatgtcattacccagaggagtaatcataaactagccagagggtattttttatagatggtgagagacaaacattttttttctccctgaattaagtagttatgtactcttatcaactagaatatatttaaacttacttttatttatttttccagtctcaatctctccctctctgttttatgtttctagcaactttatgtaactaatcttaaaatcattagcattcc

SEQ ID NO: 62054 - DNA, 601 bp, Human
gaggagtaatcataaactagccagagggtattttttatagatggtgagagacaaacattttttttctccctgaattaagtagttatgtactcttatcaactagaatatatttaaacttacttttatttatttttccagtctcaatctctccctctctgttttatgtttctagcaactttatgtaactaatcttaaaatcattagcattccttctccaaaaagagtatcatatcatcttaataaagtttctcttttcccagaattgcttaagtagcatgctgctattcatttctcttgaaaktttagtcaaaatgaattattttgcaaaaaggaaaattccacagtttctatttcttttcctcattgtctgtggcccattaacgtcttttatctgctactatgataatgtcaaatgattactttggtcatctgcaacttaacactaatcttatctgtttaattgaaaggatgttttgactttctctttgaaataatatcaacatcattttgcacttaattctgaaattcattgacctcaatgtgcaagctgtcttctttactatttattgtgaataaccatttttttttatttgttgtaatc

SEQ ID NO: 62055 - DNA, 601 bp, Human
aaatgaattattttgcaaaaaggaaaattccacagtttctatttcttttcctcattgtctgtggcccattaacgtcttttatctgctactatgataatgtcaaatgattactttggtcatctgcaacttaacactaatcttatctgtttaattgaaaggatgttttgactttctctttgaaataatatcaacatcattttgcacttaattctgaaattcattgacctcaatgtgcaagctgtcttctttactatttattgtgaataaccatttttttttatttgttgtaatcacacatcargaaagggctagggagatgtctttgtgaaacatttatccctatggttctgtttaataggagtacttaccagtagctaaatgcctcattttattttaaataatctgtaatattaagtcagtttatcacactatgagtagttttttttaatggattctgacaatatgctgcttattgtagtctttcatcctttatctgagaactatgtttttatgacagtaaaatattttttatacaaataggataaaaattcatatgctgtcatgcgctaatatgaagtttatccttacatctcccactctc

SEQ ID NO: 62056 - DNA, 601 bp, Human
cacttaattctgaaattcattgacctcaatgtgcaagctgtcttctttactatttattgtgaataaccatttttttttatttgttgtaatcacacatcaggaaagggctagggagatgtctttgtgaaacatttatccctatggttctgtttaataggagtacttaccagtagctaaatgcctcattttattttaaataatctgtaatattaagtcagtttatcacactatgagtagttttttttaatggattctgacaatatgctgcttattgtagtctttcatcctttatctgagaacwatgtttttatgacagtaaaatattttttatacaaataggataaaaattcatatgctgtcatgcgctaatatgaagtttatccttacatctcccactctccaccccatgccccatctagtggccagaatgctgtaatcgtgggaaggaataaagctctgacactacgcagtccctacccccatcattgcctctttctttgcattaaaaaaaaaaaaaagaaaatacactgaaataataaatgctaaattttggctcagattattttaattagaaatggaagtttaatgataaacactttgt

SEQ ID NO: 62057 - DNA, 601 bp, Human
acagtgttaatagtcagcattttgtaaatcttccagaagattttgataaatcatttcactagaagcctattgctcaatttattgccactttaaagttgccaaaaataatgagctcatcttcctattttaatgtaaggtattgtcaatgtttgaaatgtgtcaagaattgtttttgatagttctagtgaacaactaatgtttctaaatcatactacttatttcattagttaattattgcttgtgaaccatattataatcatctttagtatcaataaatatttttgagatgatataatgccartaaatccataaattaaaaaattaaagcattaaagaaatatctactatgtaagcattcaattttatataatgattatctgggtcagtgtacccaaaattgtgtgctagccaaactacaattaaatcatcatgataattccaaggcttaaaacaattgactatgtctgttaaaaatgagtagcttaaaattcattaaattactttgttatgttttttacctattatactgtgaacatttcacatgttcttttttataaaggccttggaagccaaattttaattgctctatggtatcattttg

SEQ ID NO: 62058 - DNA, 601 bp, Human
agtgcagtggcgtgcgatcttgggtcactgcaacctctgcctcccaggttcaagcaattcccccgcctcaacctcccaagtagctggggctacaggtgcacactaccacgcctggctaatttttgtacttttagtagagacagggttgacccgtctggtctcgaactcctcaccacaggaaatccgcccgccttggcttccctaaatactaggattacaggcataagccactgcgccccggcctctaatggattcttttttattgtatatacttgaggtgtacaacataatattttgatgyatatttacaatgtaaagtaattactaaggtcaagtaaattaacatcgatcgtctctcatagttttaactttgtgtttggtgaaatcaccgaaaatctaccctcttagcaaacttcagcacactgtataacatcatgaggtatagttctcatattctgcgttgtatcgctacacttattcatctgacataactgattatatatgtttatactctccaatgaaatttatattctttcaaaattaaaaatactgttagcttttgattgaaatctagttaaacctgaaatctagttaaatttgt

SEQ ID NO: 62059 - DNA, 601 bp, Human
tacaggtgcacactaccacgcctggctaatttttgtacttttagtagagacagggttgacccgtctggtctcgaactcctcaccacaggaaatccgcccgccttggcttccctaaatactaggattacaggcataagccactgcgccccggcctctaatggattcttttttattgtatatacttgaggtgtacaacataatattttgatgtatatttacaatgtaaagtaattactaaggtcaagtaaattaacatcgatcgtctctcatagttttaactttgtgtttggtgaaatcacckaaaatctaccctcttagcaaacttcagcacactgtataacatcatgaggtatagttctcatattctgcgttgtatcgctacacttattcatctgacataactgattatatatgtttatactctccaatgaaatttatattctttcaaaattaaaaatactgttagcttttgattgaaatctagttaaacctgaaatctagttaaatttgtttgagtagaattgagcactcaatagtttatagaattaagtcttctttaccagtagcactgtatgtcttcagtaaacttttaccattttct

SEQ ID NO: 62060 - DNA, 601 bp, Human
ctcgaactcctcaccacaggaaatccgcccgccttggcttccctaaatactaggattacaggcataagccactgcgccccggcctctaatggattcttttttattgtatatacttgaggtgtacaacataatattttgatgtatatttacaatgtaaagtaattactaaggtcaagtaaattaacatcgatcgtctctcatagttttaactttgtgtttggtgaaatcaccgaaaatctaccctcttagcaaacttcagcacactgtataacatcatgaggtatagttctcatattctgcrttgtatcgctacacttattcatctgacataactgattatatatgtttatactctccaatgaaatttatattctttcaaaattaaaaatactgttagcttttgattgaaatctagttaaacctgaaatctagttaaatttgtttgagtagaattgagcactcaatagtttatagaattaagtcttctttaccagtagcactgtatgtcttcagtaaacttttaccattttctgtatatggttatcaaacatttcttgataatattcaaaggcatattatttttgttgctattgtgaacagt

SEQ ID NO: 62061 - DNA, 601 bp, Human
ctttctggtatcccagattggttgtgtttatatgaatatagattttatattcatcttgtctcggcagaatacattttgatcagcaacccactctctttattcatttcctttgacaatttttccgtgtattttcttttttcttcagcttcctgtttttggttaaatattttgaaatataatcagactaaactctgaactaattacaagattttgtctctaaattaactctcttcatctgagggaaacagaaagatgaaaggacctattatttttgaaaagaaacaaattctaagtctttctrtattaccagagtgttttcattgtcttgctttatgtcttaggcaaagagaaaagcttccatgacgcatttatgctttttaatgacctaattagacaatgtggatttgttttgctttcataattactttccctgatggaataaaggctgagctttacactgagaaaattatttctcctcctagagcactttgtgaagaaatgtaaaaataatttctctcatggcaggctatggttacctgactgtaaacatgcaaaataaaaattaagtgggtggaaatttttgcttctattgcacacattt

SEQ ID NO: 62062 - DNA, 601 bp, Human
gaaaattatttctcctcctagagcactttgtgaagaaatgtaaaaataatttctctcatggcaggctatggttacctgactgtaaacatgcaaaataaaaattaagtgggtggaaatttttgcttctattgcacacattttgcatttgctactaaaaaatatataaattacaaagggcagttgaatgtgcaatactgtaaatgaaagttcattggaaagtgggggcttctcccaagtgtttacaaagctgatttgttcttgtgttgtcattaaacttgtgtgaataactctatttaattcyggtcactaggaaaacaaaaccaagtcaatcaattgttttagttcacattttaatgactgattttatttctgtccagtatcaatttgattagtaaataatgtaaaccaattaaattaggatcatctaaaagaatttatgccttactttatttccctcattcttatctccccttcattttctctgaaaactcttcctctgtacacatctataaaattttaaatcaaaatttgctgcaaggtcagtaatgaagggattaaattaacatagagtaaattcttcatgattcgaaaccagtaaaaa

SEQ ID NO: 62063 - DNA, 601 bp, Human
tggcatttatgcttttattgttttccccatgtttatagattagtagacatgttgtttaatacttattgaatgaccctcttatgttggggcctgtggacatcatttccatgacatgggcactaccttgtgtgtgtttagccaaatcacaacctgtggtactttatttgaaacgaaacaaagcaatcaaataaacaaccactgataatagatgtttctctgcagggactgcagatagtttaagcaatagttaattttactaagtgtacaaaagcatattttgagagagaaataaaaacaaaartaatacctattactttaagccacagtttctgaccactgttgcagttgtgacttttcttatattctttcccccagatagcttatagtacacattaagaaaattaatgcaagtattttgcacgtacgttcttgtaaagcaaatatacacgttctgaaaaatttccagctctcaagttttgccttccacttgagagaataacaggagaaaaatatgctaacttgataacagttaattttatctttgaattgcaatatctgacaaagggaaataatttttatctcacgctgggtgattttatac

SEQ ID NO: 62064 - DNA, 601 bp, Human
gcgatacacacttaaaagggtatttttttttttaagtttaggaggaaaaacctctcagaaaattgtgggtgagacaaacagatggagtagaaatcacaaaaataaactacatcatgatcagtcaggaagatgtagcgcaaacagatataaaagctctagttctcaaaggactgggagcagaggagaggaaagaagttgtctatcaaagatgatgattggaaaatatagaaaagaccatctcatgaagcaaaaagaacatggccattgaagccatgttgaagttagaaacgtgcagtgaatkttttttttgtttgtttgttagtgggaatgaatgatgatttgggtgaccgacaggtcttaactccacttttaccactcattgtccctattcaggtgtacggtgacttagtgccataactttggtgacatttctcttctggtgcctcaaaaatatggtagtatatgcacaattattgcattttcaggcctttgcatgagtttttaaagagtactccaattaactataagtttaggaaatgtaatcctaggacaatttagttttctttttcgtggagaaatacagcatgacttcaaacaagtt

SEQ ID NO: 62065 - DNA, 601 bp, Human
gcttttgtttatggaaaaagacaagagaggaaaaaagcattattttaacttcacatgataaataatcataccaaactgatatttccttaaaaagtatttgttcgtttttcttattacaatgagtattgctagtaattcagtgcaagtttgaaatgatatactggtaatatcttctttaaatagcattataggtttaagtacatcaccaacatcataactttatagagatattgcattagaattcatctagtttctgtacttattcatgaataagagatgcttatgtagatgttatttcttsttgacaaattctattagcataaaataaaagcattaatatttacttttaataaaagtcataacatttagcgttaagttcctttataagtaagtgctttatggacattattaactaatttaaaacatcaactatttttatctggagtgaatttctgccaatattaattaggaaaaatagggatataaataacgtctatggcttctaaatatttaaaagacattctatgttcgtcattttatgcactggtggttgtggaacttttaatcagtggatacagcattggaagtaatatttttggga

SEQ ID NO: 62066 - DNA, 601 bp, Human
tgtagctaatgtatgaatgatagaatacagatttagaaagctttctcattaaccttcagttaaaatactaaactaagaagattcaagaggagaaaataaaattttgcacttaagtttttaataaaacttcagtgtgcaaagtacctgcgtatttgttcataagcaaatgaagaaacaaaaagtaagatttaagaatctggattgacgtcaagcccaatatcatatggcttttctaacagcaagtgccactttgggcttcactaacgtatttatggcatacagaacagaataattaattcartaaattctgcactggccagatgacctctgcagtgttgaattcagttctgagtacataatttcaagaaggatattgaaaagctgatgcactcacataaacaataaatatgtctagaaacagtgtcccagatgaagtggaagtttagcttatgaaagagaacttatgatgaaaagcaagagagggagaaaaattgtgctctcttaagttatcaacacggtggctcacgcctgtaatcccagtgctttgggaggccaggtgggtggatcacttgaggccagtgatttgagaccagcttggcca

SEQ ID NO: 62067 - DNA, 601 bp, Human
caggtgggtggatcacttgaggccagtgatttgagaccagcttggccaatatggtgaaatgccatctctactaaaaatacaaaaaattaactgaatgtgatggtgcatacctgtaatcccagctactcggaaggctgaggcaggagaatctcttgaacccaggaggtggaggttgcaatgaaccaagatcatgccactgcactccagcctgggcaacagaatgcgacgctgtctcaaaaaaaaaaaaaaaaaaaaaaaaaaaaaaaagggtgtaaagggagtgaaatttttctctttgtcwttctgtaaggtgatatttggacaagtgaatagaacacagagcagtcagattttgcttaaatataaggaatacatttctagccattcaaattgatttaaaaataaaataaggcagtggttttcctaaatatgaaataggttaaatgattgtgcatagagaagtgtctgttagagtagatgagccaacttcgtaagcattcatttttttgtttctgagcagtcatgaacagaccaagatatgaaaatcttaatctcctaaattattgtgtgtctcagtgtacctcagagaagagtcctgtaa

SEQ ID NO: 62068 - DNA, 601 bp, Human
gtgggaatagtaattttgatgtcctgtatcttatttttatgaaagaaattaagacaaagttgttcttactaaaattggatttactttttaatcgacattcttattagttagcatcaaacaaaatgttacttaagtaaatttcagcttacctaatttatcttatttaactctttcattatggctaatatagtatttggaattaagctataaaattaattaagattaagctgtaagaaaaagttctgactaaaattaggagggaaaaataaagctctgattaaataaacaattacagaaaacyaaattttaactctaagataaatttgccttgcaacttggttttgatgtacaatttgtgtattagctgattaggtaacttcaaaagtcatcagctgtctactggttacaatacagggaacatttgggaatctaacctattaacacataatttaataggtaacacatattactctctaagattgtttgggatcatctacagactttcatccaagtgaaaaagagttctacttcattctgagttaggtcacaaggtcctgttaattttagctgtttataaattttcactgagaagctgttcttt

SEQ ID NO: 62069 - DNA, 601 bp, Human
ccagtagataataaagaacaatcaaaggattttaagtaaagaaggtttgctacatttaatgcccctctcctcacagtgttattgaactgtcaataatatcaacacacattaaactgaaccgcatattcagtttaatgtgtgtttttgtataatttgaacaaggctggaaaccaggagacctgaactcagattccagctggcttagccccaaatgagctgggtaatcttggaccagtcaaataatctctttatgttcattatgttgaactagtcaaataacatctttatgttccagttttgytaattttaaaaaagaatgaatctagcttggattacctctactatctcttcttcttttattttgtggttgtgttctgtggcacagaaatggaatttaacacatacaggaaatgtgcagtcattttatttaccaaacacgggacgggccaggggagaagcatttgttttcttgtataattaagagaaagctgttgaaaatataaagacaattgaagtagtagttttcaaaagatgggaaggaagtagaggtgtgaattcggaaacaagctagtaacaaacgtaggtttgaaaaatttaccag

SEQ ID NO: 62070 - DNA, 601 bp, Human
tataaactggtggctttaaaggataaataaaagttgtttggggtggaagagaagaaaaggctatttcaaaattcaaaagtcataaccacactggtaatattaaaaatattctcaggtccaaaagcatttagtcaaattaggactgtgatcatagcaatcaatgaactagtgtgcattttgacaagcaaaggctttctgattcttttctgtttctctttctattgatcatggggctaggaaaattgctacaaattatattttgctatttattttttgtgacatcaagagcaataatgtgtgytaagtcagaggaataaatgtacagcctagtattaaagtaatgctcctttaccccctctgcacactcgcatgttgctttcctaacaaacacgcaaatatgcaagcgtttcctagaagtgacagctaatggtataaattaacctcttgaatctggcattttcaaaactactgtagcacataaaagatagtggtgaaatatgaatagtaaatggaagaatgacatgtcctccgcctgctttcagaagcaaatagagggtttcactatcaagaaaattataggctctaggtttgtttaattact

SEQ ID NO: 62071 - DNA, 601 bp, Human
gtattttcaacattatagacgttacgactttttctttgtttgaaattgagcatgtagtatgtacatgtacatagatttcttttcttttttttttttttttttgagacggagtctcgctctgtcgcccaggctggagtacagtggcacgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatgrtctcgatctcctgacctcgtgatccgcccgcctcggcctcccaaagtggtacatagatttctaaatgtaaaatctatagagaaactgtggaacaccagaattataaaattgggcatagcttcattgactaccagtataatgaaaagaagctcctttcaaagatttaattctacgttctaaaatatgtattgtgttatttaggttgggatttttttttaattttccaaactcttagcaagtttttgttttctgattcagattcctctaaaaagaacttttaataaaaagacatttgtctcc

SEQ ID NO: 62072 - DNA, 601 bp, Human
tagaaatagcattctcccacaatcttaatatgcagagggaaaaatagttaattttagaaataactgaaacttagctgttcttgaaaaactacccctcaaatgaactcttgaattccaaggaacaatttaaaaattacagactgattcccttatccttcactttttcccttcccccaattgtctgatgtctggctttctactcaaattctactcagttcagtcaagcccctgcccagaaacctggttagctggtttgttttccctcagaactcagattctgaaatactcccctctactttgyctcattcatagagtaagtttttgaatataaataaaaaactacacactgggtacagtatacactgctctggtgatgggtgcaccaaaatctaataaaaattcaattttattttaaaaactttattttttaaatcattttaaatctctcacaatgtctgtagtttcagtgaataaagagtttggaattaggaggtcatgaaatttaactatataatcttcccagtgatttctatactgacctcaagtagttgtttcatttgccctatcttaattcctactggtgatttcattaggaataagg

SEQ ID NO: 62073 - DNA, 601 bp, Human
tatgctagacactgcggatacaaaggtgaatgatactgtttgatggagttcacggttttatgggagcatggatatgcacaatcaaatgtagaatttaaaatgaggacaagtgtactgggcatttgcaaagcaaaacaggttagcaaaggcctcctggaggagggtaatagctggagtaaaccttcaagggtgggactaaaccagtgcacaagggggtgtgtcttctgtgtaaagggaacatgttccaaaagcaaaaaggcaagaaacaatctgttaagaagaaaccacaaagatttcctargaagagagaatggcatgagttgagatggaaatgattgggaaaggagagttaagtcatagagggtctgggtttagatatgacaccctcccctttaaagttagtctgagcaaactttcaaattatacagcactcttattatttcttctgacctccgccaaacctctcacgtgccctttactaccttagctatttctcctagtgggactgcgtcatattcctcatgtaagttggagtaggattaaaagtttattagataaaagggagctcttaaaaaagatttagtcttaaagtgacatagtc

SEQ ID NO: 62074 - DNA, 601 bp, Human
attcatttcattctgatttctctttctgattcggcttcagggtttggggagatttaggagatgatggtgaagattataaaatttcaagaagcaccttccaacttcctctgaccccttttcttctctcaactgcaggggaaaggggcacaatcagtatctcgtatgtatgagcaagttccagacctgagtgagaggtggcatgtggtcagtttcaaggaacgagagaccaacatccaagaatagtctggaggagaaaggacatatcaagaaacacaactcaagctgggtgtagtggctcacrcttctaatcgcagcactttgagaggctaagttgggaggatcacttgagcccaggagtttgagaccagcctaggcaatataaagagccctcatcttaaccagaagaaaggaaagaggaaaggaaaggagaggaaaaggaaaaggaaagaaagaaaacaatctaaatggtcagagtgatgggaattttaaaaggcagcaggcacacatttaaattatacattcccaccctagacagtacaaagatatgcagatagaatggaaattagaaatgaattcatgaataaatgtttcacctcgggta

SEQ ID NO: 62075 - DNA, 601 bp, Human
ggaacagagagattgactctagattttcagaattacctttctttaaaggtataaattgtcatcctgcagtaaataaaaggaattcgaacaccatatccaatcattatgtttttaaaaactataatatcaaacgactatgctagcaataagtcaaaatttgttcactctatttttttccttcagtgttctagtgttttccaatgatgtatgtgtgctgttattataacgaaagccactttctgtgaagtgtccacctatgcttgagtactaatcatagaaaggagctctgaaaataagcagygggcctgtagtcagggactgctgaaaatgagggagagcatcagggaaattagtgcactgtgcctcttctttcttcagtactcctttatgttcattgctcatggggatctgtgtttgcctgttaattgagtgtgtttattgcaggcagttgccttaagtgacatgatactcagtaggaggttgtgaggactagaaggaggtcttgtttgaatacaaggggtgggggagtcacacttttcagaccgattagaataatgagattctctaaacagttgagaaccatttgtaagaatagcacgtt

SEQ ID NO: 62076 - DNA, 601 bp, Human
caccatatccaatcattatgtttttaaaaactataatatcaaacgactatgctagcaataagtcaaaatttgttcactctatttttttccttcagtgttctagtgttttccaatgatgtatgtgtgctgttattataacgaaagccactttctgtgaagtgtccacctatgcttgagtactaatcatagaaaggagctctgaaaataagcagcgggcctgtagtcagggactgctgaaaatgagggagagcatcagggaaattagtgcactgtgcctcttctttcttcagtactcctttaygttcattgctcatggggatctgtgtttgcctgttaattgagtgtgtttattgcaggcagttgccttaagtgacatgatactcagtaggaggttgtgaggactagaaggaggtcttgtttgaatacaaggggtgggggagtcacacttttcagaccgattagaataatgagattctctaaacagttgagaaccatttgtaagaatagcacgttgtgttagaaggcaattagagctcattcttttaataattaggttttttgagttcttacagtatgctgagtactaagattataaaaatga

SEQ ID NO: 62077 - DNA, 601 bp, Human
agcgggcctgtagtcagggactgctgaaaatgagggagagcatcagggaaattagtgcactgtgcctcttctttcttcagtactcctttatgttcattgctcatggggatctgtgtttgcctgttaattgagtgtgtttattgcaggcagttgccttaagtgacatgatactcagtaggaggttgtgaggactagaaggaggtcttgtttgaatacaaggggtgggggagtcacacttttcagaccgattagaataatgagattctctaaacagttgagaaccatttgtaagaatagcacrttgtgttagaaggcaattagagctcattcttttaataattaggttttttgagttcttacagtatgctgagtactaagattataaaaatgaacaaaaattgttctcaaatgcataatctggcaaggaatttagtcataattagcaatacaacaatatcataatagatgttgaacaaagtactatggagacttcgaggctgaagcgattaatttggtgtcagtttgagaatgaagctggaatgtttttatatattaaagttgaatcttgataatcaatactaaataaaagaaatgaagtggt

SEQ ID NO: 62078 - DNA, 601 bp, Human
gatgttattatttctcatgaatagaaggccaaaggagggaagccttcaggattagtgcatttagtgaattcagcaatgttataacgcacctaggttttttattctctctactctgctactgtctatagtattggtctcatcctaatgccgattctacttgtgatccaaaaatggctgctggcagcaacaaactttcttctgaagaaaaaggatttccttttctagaagcatgaagctaagttcccctcatatctcattgactcacattgacttggcctacccattcttgatcaaatccctrgctttggagttgaaattatcatgattggcacagagagtcaatcatgatagccactgcatatgctttgaagacagtttagaattagacatttccaaatgtctttggacctatttgtcttaatatcagaatgttatcatagtccataggaaatttaatgaggctgtcaattggtccagcagccacaagacatgcttgatggatattcaagaagctcttataatcttttgagccagagtagaatgtagctgatgatagagataatatagcaagtttaaagtatttgtttgaagtattgaaact

SEQ ID NO: 62079 - DNA, 601 bp, Human
aatagtgggacctttcctaatacttagttctgggaagagtctaatttgacattttcaaagaagatgtgaaagaagggagtcaaccatgaaatcttggagtttactgatgatgttaacaagttccccttaataatctttatctacttaggctctcattaattggaggaagtgtttatttaaaaaaaataccgtatagcaaattggcaaggatattttcatatcattgaaggtaaatgactgtacataggaacggtacccagtatttagcattgtgaatagcgtagggcttcggatccagacyacctgggttggaatgtcatctctgcagcttaagatctttgtaaccttgggcaaattacataaccttttgtgtgcactgctttcaaatgttgaaagtcactccctttacaatgtcattgtttagatctcttgagttgcatcttagaaaatcaagaaattatattacaaactgtagtgtattacacctacctgccctatatgtaaaatgacttacagataagcttactccattctcaaaaaccagtaagcaagaaggaaccctcaggtattctgagagggaagggagtttcaagttcccaac

SEQ ID NO: 62080 - DNA, 601 bp, Human
tgttacgtgagttcgctagtgtctggaaagtagttagaaaatataaacaagacagaatttttcaccaatttttgacttgtttgctgatagcttgcagggacttgtataaggacagaggccatgtattccatctcatttggtgacttgcagtgctctttgaacatcaaaagagaaggatgttaagaattctggtaactaatgaagtttgttatgtttcacatctcacatggaacctgcccacagacatgttgggaagcagtttgatgaagggccctataggttttcctcctactgtacatayatattatcttaaggaaaaaatccaaatgtaaactcatattccctgccagaaaattaaaatacgcaaacatctgcttccttaggatggcctttagccaaggttcagcctacaatgagttactgcaaaattttcacatgatttcattttttaaaaatttcccaaccaacttcaagtctaaaattataaatgggtcctatgaaagtataaacacatatgcaattttgctgtctctgaggtcagaaccagtaatgcaccaaagatcattgtatcaaatccagctcatcttctaaattaatgtag

SEQ ID NO: 62081 - DNA, 601 bp, Human
tattccctgccagaaaattaaaatacgcaaacatctgcttccttaggatggcctttagccaaggttcagcctacaatgagttactgcaaaattttcacatgatttcattttttaaaaatttcccaaccaacttcaagtctaaaattataaatgggtcctatgaaagtataaacacatatgcaattttgctgtctctgaggtcagaaccagtaatgcaccaaagatcattgtatcaaatccagctcatcttctaaattaatgtagtacattaaagaccaagataccatttcctagtatcacrgacagcctcccagagaaagagttggagggatggagtggcacgtagtgctacagagatgtaggaggagacagcttccaaaaactcatcacacatcttttcccagcattgaggaccaaagttggatgagaaaagccccagtgactatttcctttttatgtgtcatctcttacactgtttattcgtctcttatcccaactccctttccaccctaagaatattcctcccatgctgtgtttgcctcccagggtgcctcccaggatgactaaatagaaagaaaaaaatacttccaacaatggagct

SEQ ID NO: 62082 - DNA, 601 bp, Human
caatggagctatgatgcctgcttttagaattcttttcacatcctgtgttataaatcattccaatgcaatcaaccatattaactgaaaccaggacttctgtacaatcactttttaagaacttaaaattaaaatcaggactattatgagtattttgcagtagggagtacaatatatctgactgcatttacctagagtaagaagtggaaataggtttttgtttttattgttttatttatttatttaatttatttatttattttggtagagaaatcatatctctgtgctatcttcatttataaargaactactggcccagttcatgtaggggacaaacacccacgtgcacaacatacatttctttgcacacacaatctttctcaacaacaatgtttcaccaacaataatgataatgttggtgatgtataatacttatcaaacatatattttggaccacgcactctcacaagtctttatgtttatgatctcatttaatcatcaattacactatacagtcgatattactattaatccctttttagagaggagacaagagctaaagaaataaaatgagccaggcatggtggctcacgcctgtaatccc

SEQ ID NO: 62083 - DNA, 601 bp, Human
cacctttaatttcaacactttgggaggccaaggtgggaggattgcttgaacccaggagttcaagaccagcctgggcaaaatagcaaaaccccatctgtaccaaaaatacaaaaaaattaggcatggtggtgtgagtctctagtatcagctgctagggaggctgaggttggaggattacttgagcccaggaggctgaggttgcagtgagctgagatcgtgccagtgcacttcagcctgggtgacagagtgagactccgtctcaaaaaaaaaaaaaaagaaaaaagaaaaaaaaacacattgraaaatggtgaatttaccaaaagtatcagttatttttggcttgatatataaaaccgcactttcctccactgtttatcgtactgaaatgccacattttctatttaaaggtggcaatccaaatttggttgccatttaaatagtgtctagggaaatacacttgcattttctgaaatgttaaatataaatatttctattacaaggagagtctgtgaagtagaatgttttatattgcttggtaactttttttttttaaaggaaaagatttgtttgatcatctgcaccataagaagactcaactgcg

SEQ ID NO: 62084 - DNA, 601 bp, Human
atattacaaatctatagtaatcaaaatagcatgctactggcataacaacagaaacctacaccaatagaacaggatagagagcccagaagtaaattcaagcatacatgttcaaataattttacacaagggtgctaggaggacacaggtggaaaggggagtctctttgataaaaggtgctgagaaagctggatttctacatgcaaaagaatgaaatcgtatgtttatcttataccacacacaaaaatcaactcaaaataggtaaagactgaaatgtaacacctgaaaccatgaaacttacttatagaagagaacatgggggaaagctctcggacattgaccttggcaatgaattcttggataacacaccaaaatctcaggccaaaagagaaaaaataagtaaatggggccacatcaaactaaatagcttctgcacaggaagggaaacaatcaacaaaatgaaaaggcaactgacagactgggaaaaaaatattggcaaagcatgtatctgataaggaattaatatccaaactttataaataactcttataacacaataggggaaaaataacctgattaaaaagtgggcaaaggacatgaacag

SEQ ID NO: 62085 - DNA, 601 bp, Human
tggatttctacatgcaaaagaatgaaatcgtatgtttatcttataccacacacaaaaatcaactcaaaataggtaaagactgaaatgtaacacctgaaaccatgaaacttacttatagaagagaacatgggggaaagctctcggacattgaccttggcaatgaattcttggataacacaccaaaatctcaggccaaaagagaaaaaataagtaaatggggccacatcaaactaaatagcttctgcacaggaagggaaacaatcaacaaaatgaaaaggcaactgacagactgggaaaaaaatattggcaaagcatgtatctgataaggaattaatatccaaactttataaataactcttataacacaataggggaaaaataacctgattaaaaagtgggcaaaggacatgaacagacatttctccaaagaagacatgaaagtggccaacatatatgtatggaaaagtgtttaacatcactaagcatcaggaaatggaaattaaaaccactataagatatcacttcactcctgttaggatggctattattaaaaagacaagatataacaaatgttggcaagggtgtagagaaaagggaaccc

SEQ ID NO: 62086 - DNA, 601 bp, Human
aaatattgcattatctcacttaagtgtagaatcttaatttttaaaaaaggtcgaatattcagagatagagaataaaacagtcgttaccctgggcagagtcaggggaagggtcaggaaatggggagatgtaggacaaaagatacaaagtagcagatatataggatgtataagtctagggtatctaatgtacatgaggattacagttaacgaaattgtattgtattacagatttttgttaaataaggagatttcagctgctcttgtcacaaaaatactatgcaagacgctagataatgttaayctgtctcactatagtaaccatttgactatctgtacatatacacataacatgttgtaagcctcaagtatacacaatgcaaattatttttaaaataagtaaataaaataaaattctacttttagctcagaaaaataaaattaaccctatagataacaaatatgacatatgcatgactatgtatcctaaaattattaatattacacttaaattttcatattggttcataagagatatttatgcctgtgatcagagaacatgggtactagtattaaattatgcattaagtaattacagatatat

SEQ ID NO: 62087 - DNA, 601 bp, Human
acagtcgttaccctgggcagagtcaggggaagggtcaggaaatggggagatgtaggacaaaagatacaaagtagcagatatataggatgtataagtctagggtatctaatgtacatgaggattacagttaacgaaattgtattgtattacagatttttgttaaataaggagatttcagctgctcttgtcacaaaaatactatgcaagacgctagataatgttaatctgtctcactatagtaaccatttgactatctgtacatatacacataacatgttgtaagcctcaagtatacacaatrcaaattatttttaaaataagtaaataaaataaaattctacttttagctcagaaaaataaaattaaccctatagataacaaatatgacatatgcatgactatgtatcctaaaattattaatattacacttaaattttcatattggttcataagagatatttatgcctgtgatcagagaacatgggtactagtattaaattatgcattaagtaattacagatatatttaagcacataaaattaagattttctgtttttgtttttttgtttttcaccgtactggttcaacacttgagctatgg

SEQ ID NO: 62088 - DNA, 601 bp, Human
atatataggatgtataagtctagggtatctaatgtacatgaggattacagttaacgaaattgtattgtattacagatttttgttaaataaggagatttcagctgctcttgtcacaaaaatactatgcaagacgctagataatgttaatctgtctcactatagtaaccatttgactatctgtacatatacacataacatgttgtaagcctcaagtatacacaatgcaaattatttttaaaataagtaaataaaataaaattctacttttagctcagaaaaataaaattaaccctatagataacaaatatgacatatgcatgactatgtatcctaaaattattaatattacacttaaattttcatattggttcataagagatatttatgcctgtgatcagagaacatgggtactagtattaaattatgcattaagtaattacagatatatttaagcacataaaattaagattttctgtttttgtttttttgtttttcaccgtactggttcaacacttgagctatggaatgaagctatttttctttgcagcctgatatttccactttccacctgtctgattttggcaagttatttgtgtctaat

SEQ ID NO: 62089 - DNA, 601 bp, Human
accattattattatagttattgtaattctagcagtaaaagacataacttttctgtatgataattttacagagtaatttattcattacttacaggtattgcaggactagatatctttatggatgttaggtgtcatgatatttttctaattacaagaataatatatattcactttttctataacatacttttccaacccactgaacaatattttctagacaataatttatgaatctacccacatcttttaaacaaggatagacaactttataatacagatataatgaaatttaaaaaaaaaaatttatctacttatatgtatctcggttgtcgttgccagaacactgctataccctttgtgttattgtttttatatgtttagatatttgtagaagtatttctttcgaccagatatgtatgttgttttgctggatcatagaatatatacatttaagctactaattgataggcttagcaaagtttcctgccaaacattttggattgtttttcctcactactcgtttacccaaaccattactaatgcttggtgttataaatcttttactgttttgccaattttgtaaatgaaagttgtttttatta

SEQ ID NO: 62090 - DNA, 601 bp, Human
cccacaagaccagctgtcttagcgttgtacaaaagacaaaagagcaaatcaaaagtagatcatcctaagaacacctagatatgttcaaacatttggtaatttaaacttttctgaggatattaattccaatttttgaaagcaacttaaaagccagaattatcaaaactaaagaaaaggttatattaacatctaaaaagaatcttgaagaaaatagctaaggaaagtgcatttagagggagatactgtgtccttttctatttagaataaaaatattatacttatcttactttattcaaattcrttaattgtgagaacatttaccgtatgatttcaggtttttgaaacacatgtataagttttatcaatgacctaatgaatgaaaaaatatccacatctatgtcgtattatatgacagcaatatcagaagtaattttctcctgatcgttagcctgggatataaataaaccaccatactgagactaatagaaatatttcagatgataagaatttaatgactgctgacctttcttttttgattaaaaatttttaattggtttcttccatattatttgtattctaagacatctatagaattggaaac

SEQ ID NO: 62091 - DNA, 601 bp, Human
agtataggtaatgcttcatgatttccttcccatagaatgactctatgaaaaatccactcatgccttctcaaatgccttttattctgttattctttgttacttgtagtcaaatcctatctcccctgcttttctcttctcttagtcaattaaatgaacttgagggtttaaattgaaatgatgacaaggaaggaagttccaaggacttttaagaacttaacgcccaaggatcttgtcattcttctttgtaaaatggatcatccaaatatttacaatagaaataaggaaaatacttacaatagamataaggaatagcatacaattccattcattctcattctctcattcctgaaaatactcgtagatgtcttgtctggacattcattttcctcactgcctaatatactatctcataatctcactgtcctatgaaaagtactgatgtaaaaatctgaaagcaatataattccttcatcattgtgaagaaaggaaattcattctgaatagaatttgatccctttaagggaaaactatttataagtaagtggcagtagtaccaccactaaatacagctagttttggcttgattataaatcacagtcaa

SEQ ID NO: 62092 - DNA, 601 bp, Human
ttaaggacttagaatggagtcattacggggataataagagcataagaccacctttgggaagaagattgagatcttccatcacaggcacatagataattttcctctgctgtgccagcatgagaaaaccgtgtaaagcctttcctaagctgttctgctttacagaatccaaattatttcatattcatgaaatttaaacaggaatcaggaaataaaggacagcgatgaaaagctgaaaactgtgagggtctcacacagcaatatatgaaagcacctgtgaactataatgcatttatatataattcattgatttattgtattaatagtaaaatacaattatttagtgtattaagaatgtgatatgactaggatgttatttatcttgagttcattaaatctgcatttattaaagatactctagtgtattttgcaaacttgaaaatgaacacattttaaatgtttttatttgaaaaaaatagtaaattgttgagatagccttcataatatatctttctgatatattaaaacattcagttactgtaaggcattgtctttaaaaaggctacttagaaaagtaaaagtaataacctattcactgtattat

SEQ ID NO: 62093 - DNA, 601 bp, Human
tccatgagcccataattctatcaattttaggtttatttacaataggctacccagacagaccaagcacatcctgcttacattgccaatctaagattggcaaaagatcaaattgtcaaatcatatttacgtaaattatagattgtacccagtaccaaatttactagtgcttgaaaggacacaggtgttagcaaaacacagaccaagcacttttcccttggagcagtccaagattgtcaacacaactttcgaaattcccttctctcccacattaggatggagtctatttcagattcaacatgtrtaagttttaagcaacacatgcagagaaattttgtcttggaatacctccaaaatttatatcacaatcattgcatgacttacataacattctctagttcagtcttccatgaatctattaattccacatttatttgcaataagcaacctaggcagaccaagtacatcttggtaaaagcatttgctagaggaagattctccattgcctttctcctagttcctatcatcagtgtgtttagcatcagctccattgttggcatgtccctttttacaaattcccttgtaaaaaggtaatttgactaga

SEQ ID NO: 62094 - DNA, 601 bp, Human
gttatttaaatttctaccttatgtgatgatacagattccttcaaagttgttgtatcagatttcctatcttgaactaattagatgcataggaaatcacttttaccatcaaggatcatctgtggtagcatcatctcataatagaaattccaattttttagtgtctgttaaaattatttttcaggagtatgatatatatgaattcaagaaagtgttttatttactacacatgagctatgataaggaatttagatatcaaaattaagaataataaagctttaaatgggaacatgaaatgatatcrgggaagactacctcatttgttcagggtccttgctcacccaaaactgtaaaaggagtttttgtcagattccgtctctgaattgcctttcccctagaagcccaattaagaacctgggagatttcctctgacctttcctttttggaatctaacttcatggtttcacttctcagtattacagaaaatatcaatgagattttcagtaacttcctgcttagtttcttaatcttctgcctttagcagtttaagagttcatcaaatggttaaaaggaaaactgcccacttcccactgagatatgaaac

SEQ ID NO: 62095 - DNA, 601 bp, Human
gaactaattagatgcataggaaatcacttttaccatcaaggatcatctgtggtagcatcatctcataatagaaattccaattttttagtgtctgttaaaattatttttcaggagtatgatatatatgaattcaagaaagtgttttatttactacacatgagctatgataaggaatttagatatcaaaattaagaataataaagctttaaatgggaacatgaaatgatatcggggaagactacctcatttgttcagggtccttgctcacccaaaactgtaaaaggagtttttgtcagattcygtctctgaattgcctttcccctagaagcccaattaagaacctgggagatttcctctgacctttcctttttggaatctaacttcatggtttcacttctcagtattacagaaaatatcaatgagattttcagtaacttcctgcttagtttcttaatcttctgcctttagcagtttaagagttcatcaaatggttaaaaggaaaactgcccacttcccactgagatatgaaacattcaagttctggcttccatggcaaccccaaactccaatttttatgtcaccagcctcatgacattgctag

SEQ ID NO: 62096 - DNA, 601 bp, Human
catcaaggatcatctgtggtagcatcatctcataatagaaattccaattttttagtgtctgttaaaattatttttcaggagtatgatatatatgaattcaagaaagtgttttatttactacacatgagctatgataaggaatttagatatcaaaattaagaataataaagctttaaatgggaacatgaaatgatatcggggaagactacctcatttgttcagggtccttgctcacccaaaactgtaaaaggagtttttgtcagattccgtctctgaattgcctttcccctagaagcccaaytaagaacctgggagatttcctctgacctttcctttttggaatctaacttcatggtttcacttctcagtattacagaaaatatcaatgagattttcagtaacttcctgcttagtttcttaatcttctgcctttagcagtttaagagttcatcaaatggttaaaaggaaaactgcccacttcccactgagatatgaaacattcaagttctggcttccatggcaaccccaaactccaatttttatgtcaccagcctcatgacattgctagaagctctgctggcttgcctcccaaatagctgca

SEQ ID NO: 62097 - DNA, 601 bp, Human
cctcatttgttcagggtccttgctcacccaaaactgtaaaaggagtttttgtcagattccgtctctgaattgcctttcccctagaagcccaattaagaacctgggagatttcctctgacctttcctttttggaatctaacttcatggtttcacttctcagtattacagaaaatatcaatgagattttcagtaacttcctgcttagtttcttaatcttctgcctttagcagtttaagagttcatcaaatggttaaaaggaaaactgcccacttcccactgagatatgaaacattcaagttcwggcttccatggcaaccccaaactccaatttttatgtcaccagcctcatgacattgctagaagctctgctggcttgcctcccaaatagctgcacccctctgtctggatccttcacttcttactccatgccaatagtcagtaaatcatgctatgaaggcaagaacaatttgcaggattttggctcacctttctgaggttctcttctttatgggaacctagtccctcagaattgtgtgctttgcctcgatagcttttttgtaccattttattggaattacatcagtaaaatagaccattaagg

SEQ ID NO: 62098 - DNA, 601 bp, Human
cagtattacagaaaatatcaatgagattttcagtaacttcctgcttagtttcttaatcttctgcctttagcagtttaagagttcatcaaatggttaaaaggaaaactgcccacttcccactgagatatgaaacattcaagttctggcttccatggcaaccccaaactccaatttttatgtcaccagcctcatgacattgctagaagctctgctggcttgcctcccaaatagctgcacccctctgtctggatccttcacttcttactccatgccaatagtcagtaaatcatgctatgaaggsaagaacaatttgcaggattttggctcacctttctgaggttctcttctttatgggaacctagtccctcagaattgtgtgctttgcctcgatagcttttttgtaccattttattggaattacatcagtaaaatagaccattaaggtaatctacttttccaacaactaatctggtcctctctgctctttagaaatgttcattaaattttgtcacttagaagtcattattgacctgctaataaaattgagctttcatcagggccaggcaatgtaggctaatgtaggcaaatacttaaattgaga

SEQ ID NO: 62099 - DNA, 601 bp, Human
aaaatagaccattaaggtaatctacttttccaacaactaatctggtcctctctgctctttagaaatgttcattaaattttgtcacttagaagtcattattgacctgctaataaaattgagctttcatcagggccaggcaatgtaggctaatgtaggcaaatacttaaattgagatattcctgaaggcaaatacggatttgctcagtaataaggagaatcatctgggaccccagcaaggtagagaaactgcatttgagaattccacattaaacccaagactcttaaaggggtgctaaagtgrttttaggtatgtaggaccccttggctccctacaaaaatatatatggatacttttggaagggaagcatcaccagttaagggccatgagattttatcagatcagattcaaacatggagcttacaaccaggatcactaattgcacaaagaaacaccatgagtttgagttaacagaaacaaaaatacaactttctagatctgtaaaagggttaaaatatttaaattaaaatttaatttaaaaatttacatatttaaggaaaaataatagcaatgagaaaagacataactgcagagcagctaaat

SEQ ID NO: 62100 - DNA, 601 bp, Human
aggcaaatacggatttgctcagtaataaggagaatcatctgggaccccagcaaggtagagaaactgcatttgagaattccacattaaacccaagactcttaaaggggtgctaaagtggttttaggtatgtaggaccccttggctccctacaaaaatatatatggatacttttggaagggaagcatcaccagttaagggccatgagattttatcagatcagattcaaacatggagcttacaaccaggatcactaattgcacaaagaaacaccatgagtttgagttaacagaaacaaaaatayaactttctagatctgtaaaagggttaaaatatttaaattaaaatttaatttaaaaatttacatatttaaggaaaaataatagcaatgagaaaagacataactgcagagcagctaaatgtaacttttggaaatgtagtcaaggaaatattaaatagcatagtagactactgaagaaagaattattaaactgggtagagaaagatcggaagaaattatccagaaagcaacacagatgaagaattgggaagtataatagattttaggagatatagaaaaatgagtctaatgtacatgatatat

SEQ ID NO: 62101 - DNA, 601 bp, Human
ctgggaccccagcaaggtagagaaactgcatttgagaattccacattaaacccaagactcttaaaggggtgctaaagtggttttaggtatgtaggaccccttggctccctacaaaaatatatatggatacttttggaagggaagcatcaccagttaagggccatgagattttatcagatcagattcaaacatggagcttacaaccaggatcactaattgcacaaagaaacaccatgagtttgagttaacagaaacaaaaatacaactttctagatctgtaaaagggttaaaatatttaaaytaaaatttaatttaaaaatttacatatttaaggaaaaataatagcaatgagaaaagacataactgcagagcagctaaatgtaacttttggaaatgtagtcaaggaaatattaaatagcatagtagactactgaagaaagaattattaaactgggtagagaaagatcggaagaaattatccagaaagcaacacagatgaagaattgggaagtataatagattttaggagatatagaaaaatgagtctaatgtacatgatatatgtaatcatagttttagtagcagatagaagacaaaaaat

SEQ ID NO: 62102 - DNA, 601 bp, Human
attaaaatttaatttaaaaatttacatatttaaggaaaaataatagcaatgagaaaagacataactgcagagcagctaaatgtaacttttggaaatgtagtcaaggaaatattaaatagcatagtagactactgaagaaagaattattaaactgggtagagaaagatcggaagaaattatccagaaagcaacacagatgaagaattgggaagtataatagattttaggagatatagaaaaatgagtctaatgtacatgatatatgtaatcatagttttagtagcagatagaagacaaaaaatacttaggtgaagcctagtaaatggaaagaaactcacacgtagatacaaaatagtgaaactacacaacaccaaagatatacacaaacaaaaatcctaaggtctaccagagaaaagacaaatttccttttcagaaaaggcagtcaggctgagagcagagttgtcagaaatactggcagtcagaacacagcagaatattttcttcaaatttctgaaacaatatggtaacctaaaattttgtgcctggcagatgcatcttacaagaataggagtgaactaaagacaatttgaaagaagtcaaa

SEQ ID NO: 62103 - DNA, 601 bp, Human
aatcctgaatactttcttttgtcctaatgacttcatactagaaaaaaatgaggatgacaaattgtcataatttaaaactaggatattttgggttctgtccttgggtgggtacaagataatggaagggtttggttttctcttcctgtttcttcggttaagtaataacataaaaaatattgaataaccaacatgataagatcaagaagctgaaaattatggttagggcagaccctggaaatatcagatcaagtgatggaacagcctcatattcctgtgtcctgatccccagtttgtatgactkcactctagaagaaagagcaaaggagcaaaatgtaaaagggaaggaatgtccacataagataccacatgggcaggtggtaggaatgagagccacaggcatagcaagagcccccttccattcttgccatcaagtgcataaggcatttctatcatgatcattttggagcggattttgcattgtggcatctttagacagctgtcacagcacagctaaaagtttataaaataacctatatcccaggcatgctgaatccaactaattaaattcctaaagttcagccaaaagagacaaacacatcta

SEQ ID NO: 62104 - DNA, 601 bp, Human
ccttccattcttgccatcaagtgcataaggcatttctatcatgatcattttggagcggattttgcattgtggcatctttagacagctgtcacagcacagctaaaagtttataaaataacctatatcccaggcatgctgaatccaactaattaaattcctaaagttcagccaaaagagacaaacacatctatcaagaatcagagagcctaaagagattacaaccctccctaatcagatgggcccttctgctttaaaatccttgcttccctgtttgggttgatggagctaagtggttgtgacwtgtttgatgcagttgactgtgatgcatcctggttttccataaactccatggaaagaagctgggaagagccccctcgtggcaaagagtgtaagcaaatggaatcaaatgaaatgtgaagagagtctgaggaaacatgtagcagcaataggcaatgaggcggagagaaagcgagtatgaagtaagaagaggcatacagaaagataaataccctgtttccagagagggctaatgaaatctgttctttgcgcaaatcaagtaaacagcgtgtcctctagttcagtcaatcaatgttaattttaa

SEQ ID NO: 62105 - DNA, 601 bp, Human
gaaatcacataggactcctttaataaaagcttaaaagcaggagattcaaatataatttgtattttcaattttgctcttctagtatgagtcactgacattgtggagctaccatgatattattctgctttaaaaattccttgaatttatcgttactgtatttgcagtagtcctttcccggattcttgtaagtttggctgccgactgcagtgataagagatatctctacacctataatctagactctgtttttcctatacaaaatttgaaaatatagagaactttaatcatggtattgtgattmttcttctttggcattctctttagatgcaatttctgctttggaaaaaatattcgggctatccattttcacctgggcatggaaaaaaagagatgtctttatcagacaagctggttccttttttgttccattaaaattaaactgagagagttttatagcacaaaacagatggattcacttaaataattcccctgtagtattgtttattttctctctttgattgcccaaaattccttgtgtcttgacacacattttctcatgccctcaggaacaaggaattaaaggccgaattactcaaaggag

SEQ ID NO: 62106 - DNA, 601 bp, Human
atcacataggactcctttaataaaagcttaaaagcaggagattcaaatataatttgtattttcaattttgctcttctagtatgagtcactgacattgtggagctaccatgatattattctgctttaaaaattccttgaatttatcgttactgtatttgcagtagtcctttcccggattcttgtaagtttggctgccgactgcagtgataagagatatctctacacctataatctagactctgtttttcctatacaaaatttgaaaatatagagaactttaatcatggtattgtgattcttyttctttggcattctctttagatgcaatttctgctttggaaaaaatattcgggctatccattttcacctgggcatggaaaaaaagagatgtctttatcagacaagctggttccttttttgttccattaaaattaaactgagagagttttatagcacaaaacagatggattcacttaaataattcccctgtagtattgtttattttctctctttgattgcccaaaattccttgtgtcttgacacacattttctcatgccctcaggaacaaggaattaaaggccgaattactcaaaggagttg

SEQ ID NO: 62107 - DNA, 601 bp, Human
atttgaaaatatagagaactttaatcatggtattgtgattcttcttctttggcattctctttagatgcaatttctgctttggaaaaaatattcgggctatccattttcacctgggcatggaaaaaaagagatgtctttatcagacaagctggttccttttttgttccattaaaattaaactgagagagttttatagcacaaaacagatggattcacttaaataattcccctgtagtattgtttattttctctctttgattgcccaaaattccttgtgtcttgacacacattttctcatgcyctcaggaacaaggaattaaaggccgaattactcaaaggagttggcattttagactttatttttaaaattatatttttaattttttgtttttaaatgttttgattttaagtatttcacattaggacagtttgaatcattcaaaaatttatatttcatgagctatgtcttcttcctggaatctgctaaaattactcaaatatgaagtgaagataaacattaatatacttgagagaatgcatgtttatcggaatctcttcactcatgggtgagtgtgtaaatgtgtgagtgtgcgatgtaaaa

SEQ ID NO: 62108 - DNA, 601 bp, Human
aacagatggattcacttaaataattcccctgtagtattgtttattttctctctttgattgcccaaaattccttgtgtcttgacacacattttctcatgccctcaggaacaaggaattaaaggccgaattactcaaaggagttggcattttagactttatttttaaaattatatttttaattttttgtttttaaatgttttgattttaagtatttcacattaggacagtttgaatcattcaaaaatttatatttcatgagctatgtcttcttcctggaatctgctaaaattactcaaatatraagtgaagataaacattaatatacttgagagaatgcatgtttatcggaatctcttcactcatgggtgagtgtgtaaatgtgtgagtgtgcgatgtaaaattagatgagattttcaaaggttttaacggtcatccctctaactttagacatgattacattgaaagcattttagaaaattttaaaaacttccaaaggttattcatccctattccttagactgtcctctttctgtatctgaaataatttatttatagtttatcctttctataaagaaaatttggttattatctgcatttatct

SEQ ID NO: 62109 - DNA, 601 bp, Human
tgtttttaaatgttttgattttaagtatttcacattaggacagtttgaatcattcaaaaatttatatttcatgagctatgtcttcttcctggaatctgctaaaattactcaaatatgaagtgaagataaacattaatatacttgagagaatgcatgtttatcggaatctcttcactcatgggtgagtgtgtaaatgtgtgagtgtgcgatgtaaaattagatgagattttcaaaggttttaacggtcatccctctaactttagacatgattacattgaaagcattttagaaaattttaaaracttccaaaggttattcatccctattccttagactgtcctctttctgtatctgaaataatttatttatagtttatcctttctataaagaaaatttggttattatctgcatttatctccctatctttttgaagaccgatacggtcttcaaaatatgcatgcacatcctaattctttctgtttttaaactttaagtaaactaagataatgcacactaggaaaaatagtagtttggctttggaaaaaaaaaaaagagaacttatacttttataactttagcttctcacctgcagaatagaaat

SEQ ID NO: 62110 - DNA, 601 bp, Human
acctcctgactgctcctctgacatcccccaggtatgtccctctttcctgaacatgctttccccagctacttctctaaatgtcttctgtatttcatgaggcctctattcaaattttacccacccccaccctttcccagccagagaggccttctcagtccatcttatctaaagagcatttctgttcttccctgccttctactctgtgcattgttttcttcctattacttgaatttaagttaattttcttttttattgactttagtttttagtttctgtctcccctaaaaaagtgggagctccrttagagcagggtttttattttataacctactccatccgtggagcaagactcacaataactacttgttggatgaagaaatcattgagatactcagtacagatacctcggtaaactttctaccacatcatactaggattcagctccttaacggctacagtgcctttctaagattatctggagtccctgtctaaatccaaaaagtggtcaaaactagaccaaccctttttaacctttacatcagagcacccatatatgtgtaatagtatttgtgaatatcgtagcattagagaaatgggaagg

SEQ ID NO: 62111 - DNA, 601 bp, Human
tagaggtactggtttataagctgcattttactaagagtagctgggtttactctatattctcccatgtactagtactgtgaccttgggagggttttttaacctctctgggtctaagtggtttcgtttgcttagtataaaggctgggagggggttgagctgctgattaggaactaacaatagatatgttgagaaagaactagaaggggttgctgctcttcacactgaagcaaggggagagtgagatttctcatctttaacaacaacaacgacaaaaagaaataacagcgccaacaagaaattraaaagaaaattacacacgaacacacaaaatcgttcaacaaacttaatattcttttcagtggaccagaaaacctttggtatgacaactcaaacttttgaggaagctggatcctggaagcaaactttgctgtaagccagctgccagctaaccacacacataatttgatgatgtgaaggtggatggctgtaaatgttcctaagtggtgagaaatagacaacgacttttaataatttcatttcatttgccctacattacattgttcagccataaaatcatgaaaaccagtaagcaggttgttag

SEQ ID NO: 62112 - DNA, 601 bp, Human
tgttgaataggctacaataaaaacttatgttttagtagttttctattaatgaagtttagaatccatgcagttcatacagccaatctttagagaggatacaaaactgttagctgtatatgttgcctgtttgctgatggggaatatagaaaatatataactaaaaaatgatatcaagtattctgttgtaattcttcattttgttggaatgtttgtacttgttctccagggaatgggttacattgatattaggcatatttaattgtcagtttgcatttcccatttttgcaattttaaaatgtgwgaataatacattgcacaggatggctggactcaaatagttctctgaatgaaatttaagcaattgtatgtgctattctatcatgttgaaacaaaattacaaagtgttatctatcacagagtttaagaaaaaaatggcctagcatggctggagtaattattttgccaatgttgtcacgaagaaataattatctcttcttactggttaatgtatttttattgttcttcagtaacagcttgaataatttatcttaaagcattatgatattttttaagtagaaaaacagttgagtgtttttaacta

SEQ ID NO: 62113 - DNA, 601 bp, Human
ttgcctgtttgctgatggggaatatagaaaatatataactaaaaaatgatatcaagtattctgttgtaattcttcattttgttggaatgtttgtacttgttctccagggaatgggttacattgatattaggcatatttaattgtcagtttgcatttcccatttttgcaattttaaaatgtgtgaataatacattgcacaggatggctggactcaaatagttctctgaatgaaatttaagcaattgtatgtgctattctatcatgttgaaacaaaattacaaagtgttatctatcacagagkttaagaaaaaaatggcctagcatggctggagtaattattttgccaatgttgtcacgaagaaataattatctcttcttactggttaatgtatttttattgttcttcagtaacagcttgaataatttatcttaaagcattatgatattttttaagtagaaaaacagttgagtgtttttaactatgagagtaccttgaataaaacagtatttcatttctgaggttgatgaggataactatttgaataaatgagtaacttgttggttttctagtatcaaatattacctcatagactcagatttt

SEQ ID NO: 62114 - DNA, 601 bp, Human
gtcagtttgcatttcccatttttgcaattttaaaatgtgtgaataatacattgcacaggatggctggactcaaatagttctctgaatgaaatttaagcaattgtatgtgctattctatcatgttgaaacaaaattacaaagtgttatctatcacagagtttaagaaaaaaatggcctagcatggctggagtaattattttgccaatgttgtcacgaagaaataattatctcttcttactggttaatgtatttttattgttcttcagtaacagcttgaataatttatcttaaagcattatgrtattttttaagtagaaaaacagttgagtgtttttaactatgagagtaccttgaataaaacagtatttcatttctgaggttgatgaggataactatttgaataaatgagtaacttgttggttttctagtatcaaatattacctcatagactcagattttttcattgtattcagctttaagaaatagcaacttatattaagcctcataattttcattttcatattttttactcataagttctgtaaattaaatgaatgttatttataatttttatttttacctcctttatctttaccggcat

SEQ ID NO: 62115 - DNA, 601 bp, Human
gttcagaaaagctctaccactcacgcagcttttttcatcatagtgtattttttttttttttttttttgtattcttagcaggaagaatgtaatgggatttgtataaaaggtttcagagaaaaacaagaggatttcactgtctacttgttcagtaatgtttataaatccagtagtgtgtgttttatttgtttgggctttataaatctgtaattcaaaccaggttttattattgccttaaaggcagccacccatgtaggcacagagagctccagaaacacacaactaattgttgtggtttcccctgctgaacttgaagagtttggcgttgaatcccagtctcttggctgctgtaatgtctatgcaacaagctatttttctggcatgagagctggcatatttgaagtactaatttaaatggtccttttaggtattattttgcaatgaaaaagtttaaggctaataaactcgacttctcctgagcttcgtctgagaatgtaagcctaccaattgcatctcctttcttttccctttttgtcctatcattttctttttattctctaacccaaactgacagatttaataattagaaatattttacaggt

SEQ ID NO: 62116 - DNA, 601 bp, Human
ttggctgctgtaatgtctatgcaacaagctatttttctggcatgagagctggcatatttgaagtactaatttaaatggtccttttaggtattattttgcaatgaaaaagtttaaggctaataaactcgacttctcctgagcttcgtctgagaatgtaagcctaccaattgcatctcctttcttttccctttttgtcctatcattttctttttattctctaacccaaactgacagatttaataattagaaatattttacaggtaacgtttttctatttacactcaagggttgaaaagtaaarttacttagtatgcagatacggtctacctacctcttctcttagtgcacacacgagcacaattcaggaaaaaaaatgatgagttatttaagatattaaacaataagctatcactacttttttcattttagagtgggtagtctgtggttaaataacaaacaaaaaaatcccctgagaccctttgtaatatcagtcagaaggaaagaacccagcagcaaatgcagaatcaaaatctaatcatgaagtttctaaacaagacagaagagggaagagccagtttatggcctgtgccaggccatttgt

SEQ ID NO: 62117 - DNA, 601 bp, Human
tatcaatatattttttctctttccaagcattattggtctcttaatggttctattatctggtgattagaagcataagtatttatagttatacaataattgcagatatttattaacccaatcaaaaagtaaatataggaaaatgtattatttcattccttaaaacaatattttataaagaaagaaaagaaagatgaaggaagggagggaagaagatattcattgtcttagggcatctgctggttttctctagtatctccttgacttagaacatgaaccaatatttgtttttcttgtcatattktcaggcatatattggcactagccacctattaaaatattctttaatgattacttactttgtgtatttaaaaagatccatttaaggaggatggaagcatatatttgagtcagcttcattttggggaggtggcaagtggtagaaaactgttgactctcaagtgatcatcaatggctgctattatcatttttcttttactgtatttactgtttgtatttctaagtcagagagatcgtcaggtaaaataatgtatatgtttccctatcctcattctctttcttcttttttggcaaatgtactctt

SEQ ID NO: 62118 - DNA, 601 bp, Human
tcaatggctgctattatcatttttcttttactgtatttactgtttgtatttctaagtcagagagatcgtcaggtaaaataatgtatatgtttccctatcctcattctctttcttcttttttggcaaatgtactcttaagaacatcctcgtttgggaccaattataaaaaacctttacttttacgtagtacatgtttctcaagaaacagtaggtcacatgaaataaattaaaatccctaaaaaatatggcaattgttattctataggattaatgtccattttaaagcattaatataaacttrattaataatagtaggaatgatcaggtcctactactcatggatttcttttgagagcttaatttaaggagggaaccctcatctcagaaaaatttacatgactatgtagagatataaatttacatgtaatttcagaatattctgaagtctttaaaactttatttaagaaccttgcagtagtcccaaagtagttatactaacttatagaagaaacatccgtgtttttgctggagtgtatatggaccagtgataggcaagcacctaatagtgcaaaatttatatctgaaatggcatttgttcctt

SEQ ID NO: 62119 - DNA, 601 bp, Human
ataatgtatatgtttccctatcctcattctctttcttcttttttggcaaatgtactcttaagaacatcctcgtttgggaccaattataaaaaacctttacttttacgtagtacatgtttctcaagaaacagtaggtcacatgaaataaattaaaatccctaaaaaatatggcaattgttattctataggattaatgtccattttaaagcattaatataaacttaattaataatagtaggaatgatcaggtcctactactcatggatttcttttgagagcttaatttaaggagggaaccctyatctcagaaaaatttacatgactatgtagagatataaatttacatgtaatttcagaatattctgaagtctttaaaactttatttaagaaccttgcagtagtcccaaagtagttatactaacttatagaagaaacatccgtgtttttgctggagtgtatatggaccagtgataggcaagcacctaatagtgcaaaatttatatctgaaatggcatttgttcctttccttcttactttggcgtcaatgtctcgttcatgttgacttttttaagcaaagatcacttattcaccttggagtttt

SEQ ID NO: 62120 - DNA, 601 bp, Human
cctcttgtcatggataacctggactcaattatggagcagctaaatacttggaattttccaatttttgatttagtggaaaatataggaagaaaatgtggccgtattcttagtcaggtaagaaatgcattcattcacactaatttaaatataggaaaaacagttcctttgttgcttaaagctctgtaaattcttgacacttgtggataggtgttatgtggagaaaggaagttttagaacacaacattctgtagattccttgctgtgtgttaacaaaagaaactggaacttcaagtgagtcgartgtcatattctacaattaaaatatgatatatttttaaagacaaagtaggtggggatagagatatatagacaagggacaaacgatctagaattcatagaattaagcaaaagaaaatctgacacaagcctctaaaagaagaaaactgcctatttagagatactaatttattgtctgtaattatttttgatgactttttaaaaacttttgaatattacagagcttaggccttatcaaagataatacattgtgccaaaatgtgtttcctcctagtgttatgaaaaacacatcacatagagttat

SEQ ID NO: 62121 - DNA, 601 bp, Human
gaatataatggcagcccttgcactttgctaggagttgagagtcctgttcctcttcccttcctttcttcttggtgctaagcaatgtctcttacactagctgatcttcaggacagatttaagggtagctgttcagtccaattcaccttagcctcatactttagggatccccctgggagattgtgtattttctttctgaaacccatggaaaactgcaactttgagggagtgatctttcctgcaaataagcctgtaacggtgccacaggatgtggcaatgagtcaggaagcattttctctcttgwttttatttttttgctagggagtgtgttccctggtatagagagacacatctcatctcattttatatttgatgtatatctcacagactctcgaaaacttaatcttcatagtaactttagtgcaggttttttttttaaatatgtattttatagaagaagaaactaaggcttaaaagaggctatgctactcttctaaagtcatatagtaaatattcaacccaggattccaaagcagatttatccatatcagaagcctagggcttttacattcattcaattgcttctcatatcttcataaaacac

SEQ ID NO: 62122 - DNA, 601 bp, Human
ttagcctcatactttagggatccccctgggagattgtgtattttctttctgaaacccatggaaaactgcaactttgagggagtgatctttcctgcaaataagcctgtaacggtgccacaggatgtggcaatgagtcaggaagcattttctctcttgtttttatttttttgctagggagtgtgttccctggtatagagagacacatctcatctcattttatatttgatgtatatctcacagactctcgaaaacttaatcttcatagtaactttagtgcaggttttttttttaaatatgtatyttatagaagaagaaactaaggcttaaaagaggctatgctactcttctaaagtcatatagtaaatattcaacccaggattccaaagcagatttatccatatcagaagcctagggcttttacattcattcaattgcttctcatatcttcataaaacaccttgacttattatgtcttcaagttctccaaatgaggattcatacctagtagaaaagtggttatgatagcagtcagttttacagcacaaatgacagcatacagaatttcattacaggtaccaaccactcccttgaagttctgtga

SEQ ID NO: 62123 - DNA, 601 bp, Human
aaaacaatttgaccaaaattgctacaaaatattttctaagagtcatggataccagtagacaataaaaagattaaggataattaacaattagatccatgcaaaattcaataatgtatcttttgttccaatcatgttccaaaaacagagtaatatattgatatatgatccttattagtcactgtttatgttcctaatttcccagacattaaactttgaacaaatgtagtttcatatgacttgctaagtagaactttttgggatttttccttttatttgagtttataagaacaaaaatcatgarattttcattatggaaaatatgtatatatttttgccatagtgagactttaggacagctgaaatgaattaatgtgaacattccaataaatcaccttttggctgagactaaatggaaaaagtctcatttcaaaagatttttaaggagacatgtgcaatggaaataagttctcagtttcaatatacagcctgccttttgatgactatcattttaaccaacttaaaaggacacccttcagattttgaaaaggcatttaatgttttccgttaccgatatttacctagtttcaccactgttctcttt

SEQ ID NO: 62124 - DNA, 601 bp, Human
tttcaggaatcatcgattataacacataagtaaaatggtcctatagtgctacgaaatatatggtttgggagacagtgtctataggtcgaaacagggaaattgtggagatgttcaaaaatcatgtaacacatgaaggaaataaatatatagaaagaaaaataatcaaacataatatattgatcggaacatgtcttggaaatatgttatttaaatcatattttagcttttaagcttttaaaagttttaaaagcttttatatttgcttatgcacctcagacttcagagtcccataactttttcktaattgtaaagagctgaaattacattaaaaaataattaatactaataaaacacaagtatttccaggaaggggtatcacatcaacttagggatttattatgagcatatttattgttttcaaaatcccatccacctgctacattggaatgaatatacacagctgttagtgtatcatagaaaaagagaatgaaaaactgaatctacaagtgagattttctgaagaatgtgggaccaaaatacagacagagtaaggcagttggagtacgggaaagaggagctcaacagtaccagggcccctggg

SEQ ID NO: 62125 - DNA, 601 bp, Human
aatatattgatcggaacatgtcttggaaatatgttatttaaatcatattttagcttttaagcttttaaaagttttaaaagcttttatatttgcttatgcacctcagacttcagagtcccataactttttcgtaattgtaaagagctgaaattacattaaaaaataattaatactaataaaacacaagtatttccaggaaggggtatcacatcaacttagggatttattatgagcatatttattgttttcaaaatcccatccacctgctacattggaatgaatatacacagctgttagtgtrtcatagaaaaagagaatgaaaaactgaatctacaagtgagattttctgaagaatgtgggaccaaaatacagacagagtaaggcagttggagtacgggaaagaggagctcaacagtaccagggcccctgggaacatctggctgacaaatccatggaagttggaagagaaacatgaaaaaaggggtagttggaaaggatctcaagataagccttgctttcttaatacagttttcccagggcccaccctggttggatgccagtgattgacctaagtgttcacgatttctcgaaggtcaaggag

SEQ ID NO: 62126 - DNA, 601 bp, Human
tttaagcttttaaaagttttaaaagcttttatatttgcttatgcacctcagacttcagagtcccataactttttcgtaattgtaaagagctgaaattacattaaaaaataattaatactaataaaacacaagtatttccaggaaggggtatcacatcaacttagggatttattatgagcatatttattgttttcaaaatcccatccacctgctacattggaatgaatatacacagctgttagtgtatcatagaaaaagagaatgaaaaactgaatctacaagtgagattttctgaagaatrtgggaccaaaatacagacagagtaaggcagttggagtacgggaaagaggagctcaacagtaccagggcccctgggaacatctggctgacaaatccatggaagttggaagagaaacatgaaaaaaggggtagttggaaaggatctcaagataagccttgctttcttaatacagttttcccagggcccaccctggttggatgccagtgattgacctaagtgttcacgatttctcgaaggtcaaggagttatataaataaacttttatagaaaggaagacactaaaaacactaaggaacagct

SEQ ID NO: 62127 - DNA, 601 bp, Human
agagaaacatgaaaaaaggggtagttggaaaggatctcaagataagccttgctttcttaatacagttttcccagggcccaccctggttggatgccagtgattgacctaagtgttcacgatttctcgaaggtcaaggagttatataaataaacttttatagaaaggaagacactaaaaacactaaggaacagctaatcactagactgaatttccaaattcatgttatattttcaaatgtattttaatgatgtaattagccatagcaaagttccactgagttcaaattgatactaaactccayagacataactaccaactttttcacaggtggtatatcattaaatcatagttgaaagatggcaaatgtttaagtacaaaaataagttttcagattctaagatttattattcacttttatattttcttattacatttttatatgttacaagtaatagatattttttacccctgaaatagtgggttctttattccaggtgaaaagaacttgttgtaataaacctgcttgttctattagaagtcccagatagtctccataaagggaatttatttacatcttctcataggaaagctctagcttcat

SEQ ID NO: 62128 - DNA, 601 bp, Human
gtgctgagattgtaaattaatatgaatatttattaaaatcttcacttatcattagttataatcagcacatacaaaaatttgctgtatacctacttgttttaatatttattttggactatatttctaatggtcctatctaaataaatccttagttgaaaagaagcataagaggaaccaaagttaaaatggggttggtttaactttaatatgataatgtgtgcaaatattagaaactaaatttcttattatagttctaagtgtacctttaacggttttcaagaaaagagggtaagtaggaaakcttttaaatttgtaattagaatccttacaaaaattgaagaatctagatttaaacagagaattaaagtaatttcatggtagtagcaatagaaagacaagaaatatggtcaactcaataatataaatgtgataaaaatgtatttgttcaatcaaacttaggataaattaatgtatggtgaatacccaattgcataaggagataaataatgtttggtgtcattcatagtccctttcagttgggcattttacttaataaaaaatccattcatattcattcatcgatccagttatttttgaaggt

SEQ ID NO: 62129 - DNA, 601 bp, Human
ttcctctctaaagcatattctccctaacacctctcattctgatttaagtttgagaagtggggagaatgcctcagaagtacctgtgatcatgtagctatttcatggcagcaatgagaatagtcctgctcaacctatatttagttcagttcaattcagctgtacatgatgtgcccactgattttaaagctagatattgaagtgacatggtacatgctagaggggcagaactaccagagtattaactatattccaaaagaaaaaaaaatatttaaagtgttacctctattctttattacttctkcttaccctatggtgcataggagcatagacaaaattttaaatacaaaatatataaatttggatcttaaaatctgtgaatttacatacaactccaaccctccataccagctcacttcaactctgtgcttgagggaaaaggagaaagttgagaaaacaagtgtatcaagacggaagagggagatgggcggactctgggaaagaggtagggtgtaccatgtgctagtgtatgcatgtgcgtctatatgttattaaagagggcgagggggttgccacatgagtgaaggtgtcatcgagaaggcta

SEQ ID NO: 62130 - DNA, 601 bp, Human
catttccgtttccttgtcattgaagcaattttggccactgacctgaagaaacactttgacttcgtagccaaatttaatggcaaggtaaatagagctgtacccagttttcttttttttttctttttttttttttttttttgagacagagtcttgctctgtcgcccagactggagtgcagtggcacgatcttggctcactgcagcctctgcctcctgggttcaagtgattctcctgcctcaacgtcccgagtagctgggattacaggctcatgccaccacgcctgcctaatttttgtattttgtttttttagtagagatggggtttcaccatgttggccaggctgctctcaaactcctgacctcatgatccacccgcctcggcctcccaaagtgctgggattacaggtgtgaggcaccatgcccggctgcatcagtcttcattttatagacacattgaaagatatcatggaagcaaactgttgaacaaaacatgttactatgaactcccatatttcaaatgtgaaaatggaatacaataaaatgtttaaccagaagcagacatataggtattgatctgaatctagatgcccaagaagctgaga

SEQ ID NO: 62131 - DNA, 601 bp, Human
gtttccttgtcattgaagcaattttggccactgacctgaagaaacactttgacttcgtagccaaatttaatggcaaggtaaatagagctgtacccagttttcttttttttttctttttttttttttttttttgagacagagtcttgctctgtcgcccagactggagtgcagtggcacgatcttggctcactgcagcctctgcctcctgggttcaagtgattctcctgcctcaacgtcccgagtagctgggattacaggctcatgccaccacgcctgcctaatttttgtattttgtttttttagtagagatggggtttcaccatgttggccaggctgctctcaaactcctgacctcatgatccacccgcctcggcctcccaaagtgctgggattacaggtgtgaggcaccatgcccggctgcatcagtcttcattttatagacacattgaaagatatcatggaagcaaactgttgaacaaaacatgttactatgaactcccatatttcaaatgtgaaaatggaatacaataaaatgtttaaccagaagcagacatataggtattgatctgaatctagatgcccaagaagctgagatgctgtc

SEQ ID NO: 62132 - DNA, 601 bp, Human
tttctttttttttttttttttttgagacagagtcttgctctgtcgcccagactggagtgcagtggcacgatcttggctcactgcagcctctgcctcctgggttcaagtgattctcctgcctcaacgtcccgagtagctgggattacaggctcatgccaccacgcctgcctaatttttgtattttgtttttttagtagagatggggtttcaccatgttggccaggctgctctcaaactcctgacctcatgatccacccgcctcggcctcccaaagtgctgggattacaggtgtgaggcaccrtgcccggctgcatcagtcttcattttatagacacattgaaagatatcatggaagcaaactgttgaacaaaacatgttactatgaactcccatatttcaaatgtgaaaatggaatacaataaaatgtttaaccagaagcagacatataggtattgatctgaatctagatgcccaagaagctgagatgctgtctctatagattctactctgtgctacagaggaataacacattctgtcattgtggtttttgtttgatttaatttgttttcatctctatggtatatttgtataaattatctgg

SEQ ID NO: 62133 - DNA, 601 bp, Human
tacatggtaggtatatatatttatgggttacattaataaattcatataatgtataataatcacaacagagtaaatggggtatctgtcacctcaaacatttatccattgtgttacaaacaatccagttatactcttttagttattttaaaatgtataattcaattatttttgacacactcaccctgtcacccattattataattttatccataattcgtttactttttttgtgaactatttttaccattaatttacacagccaataacatttttaagtagctagaggttcccaattatttgrtattatgatccctatataatatgaagacaataaatgttctattgtttttctcttctcttcaacttttgtttttatcaaagcaaaacatatattaactttatctctcaaataggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacaggtaactgaccactgtttaatacagcttaatct

SEQ ID NO: 62134 - DNA, 601 bp, Human
aggttcccaattatttgatattatgatccctatataatatgaagacaataaatgttctattgtttttctcttctcttcaacttttgtttttatcaaagcaaaacatatattaactttatctctcaaataggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacaggtaactgaccactgyttaatacagcttaatctgtacttacaggttgctcatgaattgctcaaagcttctaacagctatgaaagtatgatcactctattttatattcatacttttgtcagaaaatgcactggtcaattttgatcaggagacaaaaagtgacgtataaaaattggactaaaatataatcatagaactctatgataaaagttatttgcaagcatttggggggaagaagatattgagatagtggaagtcagatgttaggaagatccttgaaatactgtttttttatagatttatttattatcatagaag

SEQ ID NO: 62135 - DNA, 601 bp, Human
aatggtccagctaaatgtaaagaactccatcttcagtggacagatggtattgtcaatgaattttatgaacaggtaactgaccactgtttaatacagcttaatctgtacttacaggttgctcatgaattgctcaaagcttctaacagctatgaaagtatgatcactctattttatattcatacttttgtcagaaaatgcactggtcaattttgatcaggagacaaaaagtgacgtataaaaattggactaaaatataatcatagaactctatgataaaagttatttgcaagcatttggggggaagaagatattgagatagtggaagtcagatgttaggaagatccttgaaatactgtttttttatagatttatttattatcatagaaggtagtttaaatgtatatggagtagcttgtatgtatatggtagtttaaatgtatatgcatatcacattaatttcacttactttcctaaaaaatttatttattatcatagaaggtagtttaaatgtacatggaatagtttatatgtatatgtatatggtagttcgaatgtatctgtatattagattaacttcacttttgtaaaaaaattaataaga

SEQ ID NO: 62136 - DNA, 601 bp, Human
gtatatggagtagcttgtatgtatatggtagtttaaatgtatatgcatatcacattaatttcacttactttcctaaaaaatttatttattatcatagaaggtagtttaaatgtacatggaatagtttatatgtatatgtatatggtagttcgaatgtatctgtatattagattaacttcacttttgtaaaaaaattaataagagcattatgtgaaaaagctaaaaagaaatagacatttcatttgacatgataactaagagttaacagactactcagaaagctaccacaattacataagcygggggtgatcctcctgacattaccctacacccatcagaatgcacttgaaccttcctgtttggcactgtgaaccactcttaaaaagaatgtggaggtgaaggagcatgcataaaggacaggaataagtgacagaaaagcatgtggaaaaaaatgaaggtatttactcttggggaaatataactgtcttcagatatttaaaagagtgacatactaatttagaaatcggttaatcaacattgctgtggagattaaagaagataaattatataacatacttagcacaggatctgattcataaaa

SEQ ID NO: 62137 - DNA, 601 bp, Human
tcacccactttttgatggggttgtttgtttttttcttgtaaatttgtttgagttcattgtagattctggatattagccctttgtcagatgagtaggttgcaaaaattttctcctaaaaccataaaaaccctagaagaaaacctaggcaataccattcaggacataggcatgggcaaggacttcatgtctaaaacaccaaaagcaatggcaacaaaaaccaaaattgacaaatggggatctcatcaaactaaagagcttctgcacagcaaaagaaactaccatcagagtgaacaggcaaccyacagaatgggagaaagttttgtgtttttaaaacatcatgaaatcatgtattgcctttcctaagaatgggattaattcataaatctcgaaatatggaaatgcagaaaaatgtaaattaaagggaaaattcatgtataataataccacttcttaggcataattgttgctgatattttgggatatttcctttattaattttgctagataactgctggttaaaaatctcccttttttcctcagaaacatttgaagcacttcaaaataaaacatttgtacagtaatattattaaacatatagata

SEQ ID NO: 62138 - DNA, 601 bp, Human
ttactttagatgaattttatgcttcttatgaaatacacaatacttcaagtctaaacatcatttgcggagtttgactacggatagctcccttccccaatatcataataatagaaatcccagactatggaatctataataataacacatatgatacaaagatatcttctccgtcatgaagtcatgaagttagaaaaaaataataataaggagttgaagcctattcttcagggtatctggttttttgtttgttttttgttttttgttttttgaggcagagtcttgctctgtcacccaggctggmgtgcagtggcacgatctcggctcactgcaagctccgcctcccaggttcatgccattctcctgcctcagcctcctgagtagctgggactacaggtgcgcaacactacacccggctttttttttttttttttttttttttggattttgagtagagatcgggtttcaccatgttagccaggatggtctcgatctcctgaccttgtgatctgcctgcctcgacctcccaaagtgctgggattacaggcgtgagccaccgcgcccagctgcttcaggttatgttagcgatttaaaagtgaaagaa

SEQ ID NO: 62139 - DNA, 601 bp, Human
tttcatttcaaagagccaggtagtttgctgtcttactaagaataagacagtttttccactgaatgaaggtattgtcagcttagcctctggaaaagctttgttcccaggggccctgacttactgctctttgaactcaaacacatggaaaatacagacgcacagatccaggcattgggaattgaaggacccaggccaggagacttaacaggctcaacttgtcaacctagcctttagcagcaaatgctacaaccacatattccatttctttctgttctgtagggttgggttgtcataccttccmgtttttatcaagttcactaaagcaggaatgagagactttttgggttctgtttgctcatgccttccaaaagttaactgaccacattatattacaatttaaaaatatcccatccacaatgatttgatactgtagctttggaaatattatctttaaagtatttctttacaaccaagaaaatgataaatatggagcaacattagtatttaccaaatattggccacatagagtaacagaattttagaaatgaagggggaatcaatgcttatcagttagctgcctcactttacatatattaaacta

SEQ ID NO: 62140 - DNA, 601 bp, Human
attgcaaggttgtagaaccagaaagggaacctaggtctcttaatttttaacttcaatgcttttggctctcagtaatgttaatatcagaattcatactggctaaaatggttaccttgactttgcctaatacttaggtttcagaaaaaaataaatatgcacagataacttctgtagtttgtaaaacttggagatgtcccaggaaacagaataaaatgtttcaatatggtatcctaggaaaagaaggtttttatcccaccttataattaaatctgaaagattcctacagtgaactaagaggttyctaatgaagtactaagctgcatttagaattggagcaatgaaaggctctttgttctcctttcaaaaggttccagtacagaacaatttggctcccaatacaggcatgttttagaccacctgcaggctctaatctacgcaaatttatttggtacaaactttcttctacgtcaccttcttattcagtataattccagagaggtttattgctaacatttaacagtattaataagagaacagttgctctcatggggactgccctggaaggaaaaaagaggaaaattgagcttttgttagcttcttc

SEQ ID NO: 62141 - DNA, 601 bp, Human
ctgagagaaatggcaagcccatcttggtcacaagaatatgtctgtcataaaacatagcacatgtatttcagtttttgtcttcttggcactctctcttacagagagactgtaaactcctttaaggcaagatctgagcttaattgatctgtgtttccaaagtatcctggaaagtatttgccagttagtttgagtccatctcatgaagaaattatgaatatcataatttttttttccttttgactctgcctgtgttcatttccctcagcactcattcaatttaataattgtcattctgtgtctrtatggttcaaaattaattcaagataatttaatgtcctttttattcactgtgttttaaaaattaattttattctgtacagtacaagaaatttctgcagtatatcaaaataaaactgttaaaagaatgactagcccttccacaaagatgttggcagatgacctccaagtttctttgtcacccccatagaaattggctttttttctttcattattgtgctattattaagacttttcttttttttcttgctcccagagtaagtcatatctacttcattaaatagacccaaatatcccttttgat

SEQ ID NO: 62142 - DNA, 601 bp, Human
aaacatagcacatgtatttcagtttttgtcttcttggcactctctcttacagagagactgtaaactcctttaaggcaagatctgagcttaattgatctgtgtttccaaagtatcctggaaagtatttgccagttagtttgagtccatctcatgaagaaattatgaatatcataatttttttttccttttgactctgcctgtgttcatttccctcagcactcattcaatttaataattgtcattctgtgtctatatggttcaaaattaattcaagataatttaatgtcctttttattcactrtgttttaaaaattaattttattctgtacagtacaagaaatttctgcagtatatcaaaataaaactgttaaaagaatgactagcccttccacaaagatgttggcagatgacctccaagtttctttgtcacccccatagaaattggctttttttctttcattattgtgctattattaagacttttcttttttttcttgctcccagagtaagtcatatctacttcattaaatagacccaaatatcccttttgatcttcctgctaacttgtactgttttttttaattgtttatttacttttgta

SEQ ID NO: 62143 - DNA, 601 bp, Human
attaactctttaatgcagtctcaattagatcagcatctcctgtagaccactttttcgtattagttttatttttaccacttatcaatacttcatcatttacctggaaatgtggaacaaaaactagagagaaaattattcatttagtaaacttttactgaatgctttagtaaagtctaggtcttcacagatattacatatacacaaaagtaaagagaaaagtccatataccaggtgatatggtttggctgtgttcccacccaaccctcatcttgaattgtagttcccataatccccatgtgtygtgggagggacctggtgggaggtaatcgaatcataaggggagttacccccatgctactgttctcatgacagtgagtgacttgtcacaagatttgctggttttataagaggcttttccccctttccttggcacttctctctttgtatgaccatgtgaagaaggatgtttgcttccccttccaccatgattataatttcctgaggcctccatagccctgtcagtcaattaaatctcttttctttgtaaattactcagtcttggggagttctttatagcagtgtgaaaatggactaatacagt

SEQ ID NO: 62144 - DNA, 601 bp, Human
aaattactcagtcttggggagttctttatagcagtgtgaaaatggactaatacagtaagttggtaccagaagtggggtgctgatataaagatacccaaaattgtggaagcaactttggaacacagtaacaggcagagattggaacagtttggagggctcagaagaagacaggaaaatgacagaaagtttggaacttcctggagattggagggtcatatggtttggctgtgtctccacccaaatctaatcttaaattcccatgtgttgtggagggacccggtgggagataattgtatcatcrtggcaagtcttttctatgctgttctcgtgatagtgaataagtctcacaagatctaatggttttaaaaagaggagttcctttgcacaagttctctttttggctgctgccatccatgtaagatgtgagttgcttctccttgccttcctgtatgattgtgaggcttcctgagcaacatggaactgtgagtgagtgctcaattaaacctccttcctttgtaaattgcccagtctcaggtatgtctttgtcagctgcatggaaatggacgaatacagtaaattggtactggtagagttgggtgct

SEQ ID NO: 62145 - DNA, 601 bp, Human
gagggtcatatggtttggctgtgtctccacccaaatctaatcttaaattcccatgtgttgtggagggacccggtgggagataattgtatcatcgtggcaagtcttttctatgctgttctcgtgatagtgaataagtctcacaagatctaatggttttaaaaagaggagttcctttgcacaagttctctttttggctgctgccatccatgtaagatgtgagttgcttctccttgccttcctgtatgattgtgaggcttcctgagcaacatggaactgtgagtgagtgctcaattaaacctcyttcctttgtaaattgcccagtctcaggtatgtctttgtcagctgcatggaaatggacgaatacagtaaattggtactggtagagttgggtgctgctgaaaagacaaccaagaatgtggaaacgactttggaactgggtaacaggaagaggttggaacagtttggagggctcagaagaaaaaagaaaatgtgagaaagttagtttggaattttctagagacttgttgaatggctttgacaaaaaatgctgatagtgatatgaacaatgaagtccaggctgaggtggtctcagatggagatg

SEQ ID NO: 62146 - DNA, 601 bp, Human
taatgctggaatgagttaagacattgggggacttttggaaaggcaagattgtgttttgaaatgtgaggatattagttttgggagaggtgaggggcagaataatatgatttggctatgtcaccacccaaatctcatcttgaattgtagtttacataatctccatgtgttgcgggagggacccagtgggaggtaattgaatcatgggggtggttattgtcatgctgctgttcttgttataatgagttcttatgagatctaatggttttgtaagggacttttccccctttgcttggcacttctstcttcctgccaccatgtgaattaaggacatgtttgcttccccttccaccatgattatgtttcctgaggcctccccagccctgtggaactgtgagtcaattaaacctctttcctttataaattacccagtcttgagcagttttttatagcagcatgagaatggactaatacaccagggaaattcacaatctaatgggaggatcttagctgaacttctgaactcttggctcaagtctaaaatcgtcacttagatgagggtactgagagttaaatgatattctggttgcttggaaaagaacag

SEQ ID NO: 62147 - DNA, 601 bp, Human
agaatggactaatacaccagggaaattcacaatctaatgggaggatcttagctgaacttctgaactcttggctcaagtctaaaatcgtcacttagatgagggtactgagagttaaatgatattctggttgcttggaaaagaacagacctctcttctaagctgtctaccagctgcctactttacctctctactcagaggtcttccagacacttcatgttcagaatacctctattcattttctgctgatatggttttgctgtgtccccacccaaatctcattttgaattgtagctccaataaytctcatgtgttgtggaaaggacccaatgggagacacttgaatcatgagggcagtttcccccatattgttctcctggtactgaataagtcatggatctgatgattttataaggggtttcctcttttgcttgactctctcattctctttttgcctgacaccatgtaagacatgccttttgccttctgccatgtttgtgagacctccccagccatgtggaactcttgagtccattaaacctcttttttctttgtaaattatccagtctcaggtatgtctttatcagcagtgtgaaattgacta

SEQ ID NO: 62148 - DNA, 601 bp, Human
gacagaagcaaataattttccaaagtagatgtaaaaaatgtacattcctataagcaatatattagttctaattgttaaattcttcgtctacacttgattttttatagtcattttcattttagctattccaagtaggcatagagtgctcttatgttatagttttcatttgcatttccctgtcttatgtaatatgcaactttttgtatttttaatcaatatatatttgtacatatttatgtggggcacatgatattttgctacattcatcaaatgtgtaatgattaaatcaggatatttagartatctgtcacctcgagtatttgtcatttctttttttttttttttttttttgagaccgagtctcagtctgtcacccagtctggagggcagtggcacattctcagctcactgcaagctcactccgtctcctgggttgaagtgattctcctgcctcagccccccaagtagctaggacaggcatatgccaccatgcccggctaatttttgtatttttagtagagatggggtttcaccatgttggccaggctggtcttaaactcctgacctcaagtggtccatccgcctcggcctcccaaagtgc

SEQ ID NO: 62149 - DNA, 601 bp, Human
gtaaaaaatgtacattcctataagcaatatattagttctaattgttaaattcttcgtctacacttgattttttatagtcattttcattttagctattccaagtaggcatagagtgctcttatgttatagttttcatttgcatttccctgtcttatgtaatatgcaactttttgtatttttaatcaatatatatttgtacatatttatgtggggcacatgatattttgctacattcatcaaatgtgtaatgattaaatcaggatatttagagtatctgtcacctcgagtatttgtcatttctttttttttttttttttttttgagaccgagtctcagtctgtcacccagtctggagggcagtggcacattctcagctcactgcaagctcactccgtctcctgggttgaagtgattctcctgcctcagccccccaagtagctaggacaggcatatgccaccatgcccggctaatttttgtatttttagtagagatggggtttcaccatgttggccaggctggtcttaaactcctgacctcaagtggtccatccgcctcggcctcccaaagtgctgggattacaggcatgagccactgcacccg

SEQ ID NO: 62150 - DNA, 601 bp, Human
tcaggatatttagagtatctgtcacctcgagtatttgtcatttctttttttttttttttttttttgagaccgagtctcagtctgtcacccagtctggagggcagtggcacattctcagctcactgcaagctcactccgtctcctgggttgaagtgattctcctgcctcagccccccaagtagctaggacaggcatatgccaccatgcccggctaatttttgtatttttagtagagatggggtttcaccatgttggccaggctggtcttaaactcctgacctcaagtggtccatccgcctcrgcctcccaaagtgctgggattacaggcatgagccactgcacccggccatatttatcatttctatgtgttgggaagtcccctcttcccactattttaaagtatgcaatacattatttttaacaataatcaccttactctgctatcgaagaacttatttattctaactagtatgtttgtgctcattaatcaatatctcttcattcctcctaacccccaaccatacacccttctcagcttctgatgtctgtcattctaccctcacttccatgagatcaacttttctagctcccacataagagt

SEQ ID NO: 62151 - DNA, 601 bp, Human
atcaacttttctagctcccacataagagtgagagcatgagtatatttgtctttattgctagacttatttcatttaacataatgatctccagttccattaatgatgctgcaaatgtcataattttattctttttatgtctgaatattattccattgtgtatgtataccacattttctttatccattcatcagttgatggacacttaggttgattccatatctttgctattgtgaagactgctgcaataaatatgggggtgcaattatctttttaatatactaatttcttttcctttgataartacccagtagtgggattgctagatcatatggtagttctcttttgagattttgagaaatctgcatactgttttccatagtggctataccaacttatatacctacaaacagtgttatgagttcccttttctccacatccttgccagcatctgttgtttttctgtttttagtaatagccattctaactggggtaagatgatatctcattgtggctttgatttgcatattcctggtgattagtgatattgagcattttttcatatacctgttggccatttgtatgttttcttttcagaaatgtc

SEQ ID NO: 62152 - DNA, 601 bp, Human
cttttttggttccatagagattttggaattgtttttcctgtttttctgaataatgtattggtattttaaaaataaagattgcgggggaggagccaagatggccgaacaggaacagctccggtctacagctcccagcgtggtggatgcagaagatggtgatttctgcatttccatctgaggtaccgggttcatctctctagggagtgcgagacagtgggcgcaggtcagtgggtgcgcgcaccgtgcgcgagccaaagcagggcgaggcattgcctcacttgggaaacgcaaggggtcaggkagttccctttcccagtcaaagaaaggggtgacagatggcacctggaaaatcaggtcactcccacctgaatactgcgcttttccgacgggcttaaaaaacggcgcaccatgagattatatcccgcacctggcttggagggtcctacgcccacagagtctcgctgattgctagcacagcagtctgagatcaaactgcaaggcggcagtgaggctgggggaggggcgcccgccattgcccaggcttgattaggtaaacaaagcagccaggaagctcgaactgggtggagcccaccacagctca

SEQ ID NO: 62153 - DNA, 601 bp, Human
agctggagatctgagaacaggcagactgcctcctcaagtgggtccctgacccctgacccctgagcagcctaactgggaggcaccccccagtaggggaacactgacacctcacatggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcrccaatcctcctccaaaggaacgcagttcctcaccagcaacggaacaaagctagatggagaatgactttgacgagctgagagaagaaggcttcagacgatcaaattactccgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaa

SEQ ID NO: 62154 - DNA, 517 bp, Human
ctacaaggctagagtaaccaaaacagcatggtactggtaccaaaacagagatatacaagaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggawcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaata

SEQ ID NO: 62155 - DNA, 572 bp, Human
ctacaaggctagagtaaccaaaacagcatggtactggtaccaaaacagagatatacaagaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggaacccttccttacaccttatacaaaaatcaattcaagatggattaaagacttaaacrttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcatacaaatttacaagaaaaaaacaaacaacccca

SEQ ID NO: 62156 - DNA, 601 bp, Human
cataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcatacaaatttacaagaaaaaaacaaacaaccccatcaaaaagtgggcraaggacatgaacagacacttttcaaaagaagacatttatgcagccaaaaaacacatgaaaaaatgctcatcatcactggccatcagagaaatgcaaatcaaaaccacaatgagacaccatctcacaccatttagaatggcaatcattaaaaagtcaggaaaccacaggtactggaaaggatgtggagaaataggaacacttttacactgttggtgggactgtaaactagttcaaccattgtggaagtcagtgtggcgattcctcaggggatctagaactggaaataccatttgacccagc

SEQ ID NO: 62157 - DNA, 601 bp, Human
aatatcacactggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaataaaaataaaaataaagattgcactgaatccatacattgcttgggtagaatggtcattttaacaatattaatacttcagatccatgatcatgggatgtctttgcattcrtgtgtgttgtcttcaacgtgtttcatcagatttttgtagttttccatgtagaggtctttatccatcttggttaaatttatttctaattttttatagctattgtaaaagggattgccttcttaatttctttgtcagctagttcatcattggtatatagaaatactactgatttttttgtatattgatttttgtatcctgcaactttactcaatttatttatcagatctaagagttttttgatggagtctatgtttttctagatataggattatgtcatctacaaagagggacaatttgact

SEQ ID NO: 62158 - DNA, 601 bp, Human
tatttatcagatctaagagttttttgatggagtctatgtttttctagatataggattatgtcatctacaaagagggacaatttgacttcctcttttccagtttggatgcctgattgttctgagtaggacttctagtacaattttgaatagcagcagtgatagtgagcaccttgtccttttctagttcttagaggaaaggctttcaactttccacattcaatatgatattagctgtggttttattatgtgtggtgtttattatgttgaggcatgttccttcctagtatttttagtttttatyatgaagtgatgttgaattttatcaaatgctttttctgcatatattgagaggatagatgcaaaaaagcatttttatgcgaagtcacccagtactgaactttttattgttgggagtctttattgctgatttaatctgattacttattattggtctatttaggttttctatttcttcctgattcaatcttggtatatgtgtccaggaatttatccatttcatctaggttttctagtttgctaatacatacttgttcaaaatagtctctgatacttttgtatttctgtgctatcagttataatg

SEQ ID NO: 62159 - DNA, 601 bp, Human
agtgatagtgagcaccttgtccttttctagttcttagaggaaaggctttcaactttccacattcaatatgatattagctgtggttttattatgtgtggtgtttattatgttgaggcatgttccttcctagtatttttagtttttatcatgaagtgatgttgaattttatcaaatgctttttctgcatatattgagaggatagatgcaaaaaagcatttttatgcgaagtcacccagtactgaactttttattgttgggagtctttattgctgatttaatctgattacttattattggtctrtttaggttttctatttcttcctgattcaatcttggtatatgtgtccaggaatttatccatttcatctaggttttctagtttgctaatacatacttgttcaaaatagtctctgatacttttgtatttctgtgctatcagttataatgtctcctttttcatttctgattttatttttggaggtcttctcatttttcttggttagtctagctagtggcttattcattttgtttatcttttcaaaaaaccaacttttgtttccttgacacattgtactttttaaatttttattttatttagttc

SEQ ID NO: 62160 - DNA, 601 bp, Human
ggatagatgcaaaaaagcatttttatgcgaagtcacccagtactgaactttttattgttgggagtctttattgctgatttaatctgattacttattattggtctatttaggttttctatttcttcctgattcaatcttggtatatgtgtccaggaatttatccatttcatctaggttttctagtttgctaatacatacttgttcaaaatagtctctgatacttttgtatttctgtgctatcagttataatgtctcctttttcatttctgattttatttttggaggtcttctcatttttctyggttagtctagctagtggcttattcattttgtttatcttttcaaaaaaccaacttttgtttccttgacacattgtactttttaaatttttattttatttagttctcttatctttattatttcttttattctactactttgtggcctagttagttattgcttctcaagttccttgaggtgcattattaggttgcttatttgaaacatttttagttttttgttgttgatatttattgtgttaaacttccttttgactactactttgtgttgtttccattttcatttgtttcaagaaatttat

SEQ ID NO: 62161 - DNA, 601 bp, Human
accaacttttgtttccttgacacattgtactttttaaatttttattttatttagttctcttatctttattatttcttttattctactactttgtggcctagttagttattgcttctcaagttccttgaggtgcattattaggttgcttatttgaaacatttttagttttttgttgttgatatttattgtgttaaacttccttttgactactactttgtgttgtttccattttcatttgtttcaagaaatttattgatttattccttaattatctctttgacccaaaggtcattcagagacwttttttttaattttcatgtatttatacagtttccaaagtttcttttgttattgatttctagttttattcattgtggtctgagaagaaacttgatataatttagatttttaaaaaatgttttgagacttattttgtatcctagcatctggtctatcctggagaatagttccatgtgctgacaatgagtactctgcagctgttcaacaaaatgttctgtaaatatctgtgaagtccattggcctaaaatgcagtttaaatccaacgtttatttattaattttctgtctagatgagctgtctg

SEQ ID NO: 62162 - DNA, 601 bp, Human
tcaagaaatttattgatttattccttaattatctctttgacccaaaggtcattcagagacattttttttaattttcatgtatttatacagtttccaaagtttcttttgttattgatttctagttttattcattgtggtctgagaagaaacttgatataatttagatttttaaaaaatgttttgagacttattttgtatcctagcatctggtctatcctggagaatagttccatgtgctgacaatgagtactctgcagctgttcaacaaaatgttctgtaaatatctgtgaagtccattggyctaaaatgcagtttaaatccaacgtttatttattaattttctgtctagatgagctgtctggttctgagagtgggatgttgaattcctcaactatttttgtgttgaagtgtctctctccctttagatctattaatgtttgctttgcatatatctgggtgtgatactgcttctcagccttttggctaagatcaggtttagtatctggttgctctggtattggtgcatatatgtttagaactattctatcctcttactgaattgatctcgttgtcattatataatgactgtgtcttcttttta

SEQ ID NO: 62163 - DNA, 601 bp, Human
ggtctgagaagaaacttgatataatttagatttttaaaaaatgttttgagacttattttgtatcctagcatctggtctatcctggagaatagttccatgtgctgacaatgagtactctgcagctgttcaacaaaatgttctgtaaatatctgtgaagtccattggcctaaaatgcagtttaaatccaacgtttatttattaattttctgtctagatgagctgtctggttctgagagtgggatgttgaattcctcaactatttttgtgttgaagtgtctctctccctttagatctattaatrtttgctttgcatatatctgggtgtgatactgcttctcagccttttggctaagatcaggtttagtatctggttgctctggtattggtgcatatatgtttagaactattctatcctcttactgaattgatctcgttgtcattatataatgactgtgtcttctttttactgttttgacttaatttctgtttcatctaatataagtatagctactcttgcttttttgcttttgtttgcatgaagtatatttttctgtctttcacttctagtctatatctgtcttttctatcttttacttctagt

SEQ ID NO: 62164 - DNA, 601 bp, Human
agtgggttttatactttcaagtgttttcataatgatagatatcatccttttgctttcacatgtcagcctccctgaggtatttcttgtagtgctggtctagtggtgatgaattctctgagctttgcttctgtgagaaaagactttatttttccttcatttataaaggacaacttggctgggtatatggttttttctttcagtgacttgaatatattatcccattatctcctggactgaatgatttctgctgagaaatctgttagtctgattggagtttccttataagttactagatactttycttttgctgtttttagaactctctatgtctttgacttttttttttttttttttgagatggagtctcgctctgtcccccatgctggagtgcagtggcgtgatctcagctcactgcaagctccgcctcctgggttcacaccattctcctgcctcagcctcccgagtagctgggactacaggcacacgccaccatgcctggctaattttttgtatttttagtagagatggagtttcaccgtgttaggcaggattgtctcgatctcctgacctcgtgatctgcctgtcttggcctccgaaagtg

SEQ ID NO: 62165 - DNA, 601 bp, Human
agatatcatccttttgctttcacatgtcagcctccctgaggtatttcttgtagtgctggtctagtggtgatgaattctctgagctttgcttctgtgagaaaagactttatttttccttcatttataaaggacaacttggctgggtatatggttttttctttcagtgacttgaatatattatcccattatctcctggactgaatgatttctgctgagaaatctgttagtctgattggagtttccttataagttactagatacttttcttttgctgtttttagaactctctatgtctttgacttttttttttttttttttgagatggagtctcgctctgtcccccatgctggagtgcagtggcgtgatctcagctcactgcaagctccgcctcctgggttcacaccattctcctgcctcagcctcccgagtagctgggactacaggcacacgccaccatgcctggctaattttttgtatttttagtagagatggagtttcaccgtgttaggcaggattgtctcgatctcctgacctcgtgatctgcctgtcttggcctccgaaagtgctgggattacaggcgtgagccaccgcacccagccat

SEQ ID NO: 62166 - DNA, 601 bp, Human
atggttttttctttcagtgacttgaatatattatcccattatctcctggactgaatgatttctgctgagaaatctgttagtctgattggagtttccttataagttactagatacttttcttttgctgtttttagaactctctatgtctttgacttttttttttttttttttgagatggagtctcgctctgtcccccatgctggagtgcagtggcgtgatctcagctcactgcaagctccgcctcctgggttcacaccattctcctgcctcagcctcccgagtagctgggactacaggcacrcgccaccatgcctggctaattttttgtatttttagtagagatggagtttcaccgtgttaggcaggattgtctcgatctcctgacctcgtgatctgcctgtcttggcctccgaaagtgctgggattacaggcgtgagccaccgcacccagccatctttgacttttgaaagtttggctacaatgcaccacggggaagaccttgaattttatttgtgtgagtttctctgagcttcctgcatctagatgtctaaatctctttttgttagacttgggaagttttcacctataattttgttaaaca

SEQ ID NO: 62167 - DNA, 601 bp, Human
tgtcccccatgctggagtgcagtggcgtgatctcagctcactgcaagctccgcctcctgggttcacaccattctcctgcctcagcctcccgagtagctgggactacaggcacacgccaccatgcctggctaattttttgtatttttagtagagatggagtttcaccgtgttaggcaggattgtctcgatctcctgacctcgtgatctgcctgtcttggcctccgaaagtgctgggattacaggcgtgagccaccgcacccagccatctttgacttttgaaagtttggctacaatgcaccayggggaagaccttgaattttatttgtgtgagtttctctgagcttcctgcatctagatgtctaaatctctttttgttagacttgggaagttttcacctataattttgttaaacaggttttctgtcccttttattttcttttcaccttctgggacactgaaaattcaaatatgtcatgcaagctttgttcattattattattttttatgtttttagtgttcatctgactgggttatgtcaaaagacctgtcttcaaattctgattctttcttcaacttgatatagtctattgttaaaactttt

SEQ ID NO: 62168 - DNA, 601 bp, Human
tggttcatgtaaacatgatgttggctattatcagtgcttacttgttcctgcgtttgtctctgcctcacctgcctaacagcttgttctttcagccttgctttcttcatgaagctggaactgtagccagctctaagttcacttcatgccagatgcataagcaaaggagaaaggatctccaattacacctcgcaaaccgacattcattctgtgcaaatgagaaatatctcaggggaggactcaggcccgacttgggccacacacacacccattggccagtcactgtgaaacaattttgtagacyggttgtgagggcagaagtagaatttaacaaccttttctggaaccacataattgaaggaagggggaaaagttccccctaaatgattttggacgcacagttaccagaagaagagataaagataaggagaagaaaaaggaaaaaataaaaacagaaacagtatatactctaggaggtacatatggagtatcatgggaatttagaagaaagagattatttcttagaagaattcagtgaaatctgatggagtctttaaaaaatgaaggaatatatactctcaagtggttgcaaagaacatttcag

SEQ ID NO: 62169 - DNA, 601 bp, Human
gagtctttaaaaaatgaaggaatatatactctcaagtggttgcaaagaacatttcaggatagacaataccagcttgaaaatatgagttcagtgtagatgttttaaaaataagaaaagcagagtagttaagtgtagttaactacactttgaaattaatttttagtttattttatttttttgagatggaatctcgctctgttgcccaggctggagtgcagtggctctatctcagctcactgcaagctccgcctcctgggttcacaccattctcctgcctcaacctcctgagtagctgggactrctggcgcctgccaccacgcctggttaattttttgtatttttagtagagacagggtttcaccgtgttagccaggatggtctcaatctcctgagctcgtgattcgcccgccttggcctcccaaagtgctgggattcacagacgtgagccactgcacccagcctgaaattaattttttagtccacatgaagcagatgaggaacatcaaaaccatctttaaatatatcagtcttgtagatgtttgtgaattaaattgattgacagagacagactaacaagaagttatttcagtgatctatgtgg

SEQ ID NO: 62170 - DNA, 601 bp, Human
atatatactctcaagtggttgcaaagaacatttcaggatagacaataccagcttgaaaatatgagttcagtgtagatgttttaaaaataagaaaagcagagtagttaagtgtagttaactacactttgaaattaatttttagtttattttatttttttgagatggaatctcgctctgttgcccaggctggagtgcagtggctctatctcagctcactgcaagctccgcctcctgggttcacaccattctcctgcctcaacctcctgagtagctgggactactggcgcctgccaccacgccyggttaattttttgtatttttagtagagacagggtttcaccgtgttagccaggatggtctcaatctcctgagctcgtgattcgcccgccttggcctcccaaagtgctgggattcacagacgtgagccactgcacccagcctgaaattaattttttagtccacatgaagcagatgaggaacatcaaaaccatctttaaatatatcagtcttgtagatgtttgtgaattaaattgattgacagagacagactaacaagaagttatttcagtgatctatgtggaaagtcttgagagcctgaatg

SEQ ID NO: 62171 - DNA, 601 bp, Human; identical to SEQ ID NO: 27715

SEQ ID NO: 62172 - DNA, 601 bp, Human; identical to SEQ ID NO: 27716

SEQ ID NO: 62173 - DNA, 601 bp, Human; identical to SEQ ID NO: 27717

SEQ ID NO: 62174 - DNA, 601 bp, Human; identical to SEQ ID NO: 27718

SEQ ID NO: 62175 - DNA, 601 bp, Human; identical to SEQ ID NO: 27719

SEQ ID NO: 62176 - DNA, 601 bp, Human; identical to SEQ ID NO: 27720

SEQ ID NO: 62177 - DNA, 601 bp, Human; identical to SEQ ID NO: 27721

SEQ ID NO: 62178 - DNA, 601 bp, Human; identical to SEQ ID NO: 27722

SEQ ID NO: 62179 - DNA, 601 bp, Human
cactctgaggcctgtccctgccttcttcccccttagcatctctgatctacccacttgtctccaggccttctgccatgctcatggtcaggaccaccctcagtcccggttcagacttgctcctttctaacttgctccctttcattccatcctgggcaacctgcatgattcttctagaatgaaactgatcactttaccccacctccaaacaaactcagcaaaggcattgcaatgaaaacaaaaccccaacttttcacagtggtgcaaaaggtcagaggccttgcctgtctctccttctcccctwgtctcagtccttctccttaggtcctccttgggagatttgcacttcctcccaagcacaccaggatccttcttgctgcttccttttgcacgcgcagctccctttgcctggaaacttttctctccaaagctgccaccccaccctttagctggctaatttcagcttatccttgaagtcttagctgatatgccacttcttttgggaagcctttctgactcctccaggtgggcagaagtgtacctgctctgggattccatagcagcctgtatttccctgtcatggtgcttccttgattgtagccgt

SEQ ID NO: 62180 - DNA, 601 bp, Human
ggcctctgcagcccttcagggctctcctgttccaaggctgccattttctgggtctgaggcctgaggattggcgtgatcactttagttttccagttattggcggtgccagagtcccagctgcctaagctagaactcaggagttgttcttacctctttcccaccccagcactctgaggcctgtccctgccttcttcccccttagcatctctgatctacccacttgtctccaggccttctgccatgctcatggtcaggaccaccctcagtcccggttcagacttgctcctttctaacttgctcsctttcattccatcctgggcaacctgcatgattcttctagaatgaaactgatcactttaccccacctccaaacaaactcagcaaaggcattgcaatgaaaacaaaaccccaacttttcacagtggtgcaaaaggtcagaggccttgcctgtctctccttctccccttgtctcagtccttctccttaggtcctccttgggagatttgcacttcctcccaagcacaccaggatccttcttgctgcttccttttgcacgcgcagctccctttgcctggaaacttttctctccaaagctgccacc

SEQ ID NO: 62181 - DNA, 601 bp, Human
tacaaaaattagctgggcatgggggtgggcacctgtaatcccagctacttgggaggctgaagcaggagaatcacttgaacccagaggcagaggttgcaatgagacaagattgtactactgcactttagcctgggtgacagagccagtccctgtctaaaaaaaaagaaaagaaaaaaaaagttagctatggttgagactattattagcacattagcacatatcattcatatgtagcatgcttcattttattgattttccttagatactattcctatttccttgacaatgtaaagagttcaamtgaggtagctcatttattcttcagtatttttcccattttttcccatttttttctttcattaattcataatgctttatgctggtgtaatgataatagggtgtagacctctccagggctgttgctgctctgcccattagcaaggttttggagttggaagtgacctgtgaacaaggggtagggttattctctgaagactaacatggtttgaagtctctgccactcaccggatcaggcggagcaggtccaggtaggctgttcttgccatgtccacttgggcaccagacaggaaggcgtcatgga

SEQ ID NO: 62182 - DNA, 601 bp, Human
tggctgcagtattcagaacagcaacatgctttgcaggtgtgactgtacgagcaataggctataccatttaggcttgtgtaagtacactctgtgatgttcacatgatgacagactcacctgaagacacatttctcagaacggatcctccagtcattaagtgatgcatgactgtacttatgttctgcctgtaatgctctttccctagcagccacaacagcttctccctaccttctcctcaggtctttccttaaatgtcaccctcccagggaggccttctctggcctacttaaaattgtagctycccctcctccctactgacccccagcattctttcctccacttcctgctatcctttctttcatggtaggtattaccatttcacatggtatacagtgtgacttattttgtgcatgtgtgtgcctgtctcctctcctctagtctgtaggcatctgtgaccctttttcatctgaaactcgtatccttcatttgaggaatgttttcttgaattattttattaatgattcgcttccttctgttttctctgtcttctttctagacctgttcttcagatgatgaacagctaagattggtcctcttactt

SEQ ID NO: 62183 - DNA, 601 bp, Human
cctccagcactgtcactgctccaatccactatcatcactcacttggatgattgcattagcgatccagctgatctccctgcttttcactcttagttcttaatatggcagctggagcaagcctttaaaaatacacatcagattcttttaggttgtgtctatccaatgctcaaaaccctcccattctatcccatgctcaaaaccctcgcattctcttaagtctttgcaatgatctaccttaccgtctcttcccaccccctactgtactcccttaactctctgccctctgccgtcattttccacygcagtcatgccattcctgcccctgtggcctcttctgtgttctctggatggatatgccaagcacactctggtctccaacatttgtactgtcatgcactgcataatgatgttttggtcaatgatggaccatgtatatgatggcggtcccatgacattatgatagagctgaaaaattcctattgcttagtgattgatgttagaattggctgcagtattcagaacagcaacatgctttgcaggtgtgactgtacgagcaataggctataccatttaggcttgtgtaagtacactctgtgatgtt

SEQ ID NO: 62184 - DNA, 601 bp, Human
agcttttgactctatttccttctccatcaccttggctcccgtttaggacaaaactccctgaaagtgttatgtgtgtttatgcttatgatttccaattttcacattctctcctgaactggatctgttcatgtttttactcccaccactccacagaaatagctcttgccacggttacttccttattatcttgcgagggtctcaagactgagtacttggacctcttctcttcatgcactccttgtgatgttcttctcaaggctttaaatatcaaccatacgccaatgacttccaaacttatccytccagtgtcccctgcttaccaacatctgtacttggatttctgataggctcttcaaaagtaatgtatctgaacccaaactccttcccgtccaccctgcccaaacctgggcctcctgtagtcttccgcatttatagtaaatggcagctctgcccttctgaccaaaaaccttgattcttctcttctttctcaccatacatctaatctgtcagcaaatcctgttctgccttcaagatatattcaaacttcaaccattcccaccacctccagcactgtcactgctccaatccactatcatcactc

SEQ ID NO: 62185 - DNA, 601 bp, Human
gaaaataaggtggttcaattaccgcagtgatttatctccttctttttgttacttaaaagccagtttaccactctgtgtgtatgcacttgggtctgtcaagccatgatttagagcttgggccttcctcttaattccctttactaagttccgagcagtgcattttgctgattacaatccaggctcagagttcctgccaggccatactgccactccttgtttcttttatgtgttctctaagaatattttaaacagacgtgctacgccaagtgattgccaacctaacgggaatcaattaaaatgsgagaacatgaaggtgtattcactgcctgttctctgctttcttacataatttataatgtgttccactcaactacctgagtattggttggtgacttctgagcccactggaacaggcgttcgtagacgtttccatcataacagccaagtgctgaatttaaacactgatcggtgaagtcaaaagcatcagttaacaggatggcatccttcctgggataggaaacaagagtttgtaagtattttagattgctcttatgaatcaaactagtcttggatggtgaataacaatacctaattagaggtt

SEQ ID NO: 62186 - DNA, 601 bp, Human
ctttctttgctccttggattgtattccttagagtgaagaggagagggtatcatctctagcaggcaatcaggtctaagagagacatccctcaagcttcctaccacttctgaatacctacttttatctacacaaaactgaaagttaaaaggctgaaaataaggtggttcaattaccgcagtgatttatctccttctttttgttacttaaaagccagtttaccactctgtgtgtatgcacttgggtctgtcaagccatgatttagagcttgggccttcctcttaattccctttactaagttccragcagtgcattttgctgattacaatccaggctcagagttcctgccaggccatactgccactccttgtttcttttatgtgttctctaagaatattttaaacagacgtgctacgccaagtgattgccaacctaacgggaatcaattaaaatgggagaacatgaaggtgtattcactgcctgttctctgctttcttacataatttataatgtgttccactcaactacctgagtattggttggtgacttctgagcccactggaacaggcgttcgtagacgtttccatcataacagccaagtgct

SEQ ID NO: 62187 - DNA, 601 bp, Human; identical to SEQ ID NO: 30863

SEQ ID NO: 62188 - DNA, 601 bp, Human
cttggaggggatcaagtcagggccagtttgagggacacttaaacgcgtgccaaggggtcaaagattccacagccttgcggctcactctgccagagtttgggtggggtcgatgaccatctttgcaaggccacacctaatgctgggatcctaaggcacctgaggtttcaccaggcccagcaccaacgctggctggcggcgcaaacccctgccccaccccaagccctgggcctcctatggccgcatcttcagcatctctgccaggcagcgccacacgactccagggctgccgggtgggacgcckatcacggcggcccctcggggggagccaccccagaaaccacggtttttaggtgtttaaagacagggcggcaaaaacgcacgagggaaaagcaatcttttcaaaagagcctccgaatccctcggctggccaggacggcagagctgggggaggaacgcacggacgctgagcgggaaaaggaaaccaggacggagccgtctcctgccgaaacagaactctccgcacgaatcgcgggctttcggggctccctgacccgtccgccaggtcggccccgaaacggctgtcccgtttgctccaggacgc

SEQ ID NO: 62189 - DNA, 601 bp, Human
cctaggccctctgcagagggtggtctggcagcttggatccgggccctgccaagtcacagtgcccagctcttccatgctgggaacagaaggccccggggcccaggggcagagagggaatgtccttccttgctgcaaaacaggacccaagaagtcaggccaggaagacaagagacaagaggcttgctgaggagctgtgggaggttgaggtgcagggtcagcctgggacctggggggaaccccagaagctgagactcagtttcctcatccaagcaacggggacagctgtatctgtgttgagcartgaaatgccagaaacctttaagagcaacttttaaatgaatgtaacttttagatggaggttctctcactctggttccagcatacctggggctgacaggctatgccctgcaggtatgaggagtgtgtgtccctatatacacacgtggcgtccctgtgtgtatgagtgatgagaggggctggggtccctgtgtggacgtgggtgaggcagggtgtgaaggaaccacgctgtgcatgtccacagccttggcagcaagtgctgtgagaaggggcaggagtgtgtcttggtgatccagtgtgagtg

SEQ ID NO: 62190 - DNA, 601 bp, Human
tgtgaaatgggccaaggccatgacccttgcagacttgttggaaaagatgaagtgagtaggcacagcacaggggcagtgcactgtgagcccccatggggtgctactgctggtattagccttatccagttaagacgaggggacctagagggtcttcggccaggctgcagagggggaaggtctcaggggagatggcagcttccgggccttcccttccccttggcaccccaggttccattttaacagatatcataatttttaattggttttctcctcccctggctaaaaggctattagctccccrctaggtgatcgcatcccattttcttcacaccaccaaggaaacagtgatttcctcagcctgtccctaaagtgattctgcagaagaaaggcaatttagtgaatcagctcaatgcacttccccatttgctctctgcttgcaggcccccagcaggcacagcccaccagtgagggctgcaggcagcttctggaggccagacagggttagtgagctggagtggaggaggaagcaagccaggcccaggtgaacctggtgaagcctctggccagagaaaggggagaaggaaaaggatgaagcaggggg

SEQ ID NO: 62191 - DNA, 601 bp, Human
ggctttcttctcccaggctgtcctggaggatgggaaaaatgaggaggaaggccctgtcctgcatgaggaaacacagctgtacccccatccctgatgcccaaaccccatccctgcacccttgtcttcagagcagtagcttccatccgatgccagggcctcaggcatatgttggctgcaagggccacagcctggtgtcccagccgaacatctgcaccgccactggcagcaagatgccttcctgccatccacagagcacacacagtcggcccttctgctggcacagccatgcctggtgctcctycccagacccataggactcccagacatcaactaaagctgacgagacccagagagtatctcagcgtctgtgcatggtgccacacattactctgggatctgggctgggatgtcctgagggcacctggagcccgaggtggggggactcaccagtgggtgggcaggctcagggcaacctccctggaagccctccttagccccaccctggacccacaccactggcccagagaacgggctggagcaagccagagggccagggctggggagctcccgcatcctctctaccggttcgagtccataggct

SEQ ID NO: 62192 - DNA, 601 bp, Human
tctcctatgagaggtacagcctgcctcaggggacaaagaatcaagcaccaaggcttcgcctcaatccctgagccggccctggctgctgttctagtgggggagccagaggggctctggtgggcctggggccttctccccttccagccccaaggggtgcagtgcctgggtcatggaccccaagggacctccccatttgacctcatagtcccactgactggcagcctcccaggggccatggggtgctcccctaccccatggggcacagaagacggctctggcaggcccaggtgcagacgggcasggagagacagccctggtgccatcatcaccttctctgtgaccatgactgaggtgtgctccctgcctggtggtcactgcccagtccccgccccttgccacacacgcatgcggaagtcactacacagggtctccttgactacggtctctccctgccatgagacagctctggagagtccccagccctagagcagcagggcaggagccgaggctccctcaggagtgctcccagcctgctgttgttactattattgttactgttattgttactattaagtcactctgctgaaaaataattgcagag

SEQ ID NO: 62193 - DNA, 601 bp, Human
ccccgcgtcctctgtacttgaagcctcctggggtgagaacgaccatgtgacaggatcccacggaacacagggaaagtgacggtggccccctcccaggcctcaaagctccttaagcctcaggcttcttgaagctctgtgccctcctgtgcacatagccaggcacaagggctgggaggtgtggccacccagtgggtaagggccatgccaggctatgccacaagaaggacatagtagatggcgttaagcccctgagactggggggcattcctgtcaccaagtacagtctcacatgcccctgcakatacaggtggtggggaggctaggggagcaaagacaatttgaggctttcccgggtcacgagttttcaaggtgctgtggggcatcctgtatgtgacctgccagaggagtctcctgcagagacaacctgtgggctgcccaccggtgctgggtcccatagccaggctggccccttacgatggcagagcaatgtgcccatgtcaccaagcgcccatgagccccgttgtttccctgggtgaggagggccaggcccagagccccacttgggctaagtgttaggcttcctggggctggcagacgccct

SEQ ID NO: 62194 - DNA, 601 bp, Human
ttacacaaatttcacaattaaaaaagagtaaaccataattatttgctaccctgtttccccctctgtccccctcagctgctgggcccgccaggagcccctgctatgtggaccaggacaagggatggagagctggtaggcagaagtgtgtgcaggtacacccctgcgtgcccccatccccgcgtcctctgtacttgaagcctcctggggtgagaacgaccatgtgacaggatcccacggaacacagggaaagtgacggtggccccctcccaggcctcaaagctccttaagcctcaggcttctygaagctctgtgccctcctgtgcacatagccaggcacaagggctgggaggtgtggccacccagtgggtaagggccatgccaggctatgccacaagaaggacatagtagatggcgttaagcccctgagactggggggcattcctgtcaccaagtacagtctcacatgcccctgcatatacaggtggtggggaggctaggggagcaaagacaatttgaggctttcccgggtcacgagttttcaaggtgctgtggggcatcctgtatgtgacctgccagaggagtctcctgcagagacaacctg

SEQ ID NO: 62195 - DNA, 601 bp, Human
tgggtatggggtttccttttggggtgatgcaaattttttggaactaaggcaatgcctgttcaatgctgtaaatgtgctaaatgccaccaaatggttcacttataaatggttaaacttatgttacacaaatttcacaattaaaaaagagtaaaccataattatttgctaccctgtttccccctctgtccccctcagctgctgggcccgccaggagcccctgctatgtggaccaggacaagggatggagagctggtaggcagaagtgtgtgcaggtacacccctgcgtgcccccatccccgcrtcctctgtacttgaagcctcctggggtgagaacgaccatgtgacaggatcccacggaacacagggaaagtgacggtggccccctcccaggcctcaaagctccttaagcctcaggcttcttgaagctctgtgccctcctgtgcacatagccaggcacaagggctgggaggtgtggccacccagtgggtaagggccatgccaggctatgccacaagaaggacatagtagatggcgttaagcccctgagactggggggcattcctgtcaccaagtacagtctcacatgcccctgcatatacag

SEQ ID NO: 62196 - DNA, 601 bp, Human
ccatgcagatgaaatgttccaggacaggccaagccgcagagacagaacgcaggctgggggttgcccggggacaggaagcagctgtttaatgggtatggggtttccttttggggtgatgcaaattttttggaactaaggcaatgcctgttcaatgctgtaaatgtgctaaatgccaccaaatggttcacttataaatggttaaacttatgttacacaaatttcacaattaaaaaagagtaaaccataattatttgctaccctgtttccccctctgtccccctcagctgctgggcccgccagsagcccctgctatgtggaccaggacaagggatggagagctggtaggcagaagtgtgtgcaggtacacccctgcgtgcccccatccccgcgtcctctgtacttgaagcctcctggggtgagaacgaccatgtgacaggatcccacggaacacagggaaagtgacggtggccccctcccaggcctcaaagctccttaagcctcaggcttcttgaagctctgtgccctcctgtgcacatagccaggcacaagggctgggaggtgtggccacccagtgggtaagggccatgccaggctatgccac

SEQ ID NO: 62197 - DNA, 601 bp, Human
tccatgcagatgaaatgttccaggacaggccaagccgcagagacagaacgcaggctgggggttgcccggggacaggaagcagctgtttaatgggtatggggtttccttttggggtgatgcaaattttttggaactaaggcaatgcctgttcaatgctgtaaatgtgctaaatgccaccaaatggttcacttataaatggttaaacttatgttacacaaatttcacaattaaaaaagagtaaaccataattatttgctaccctgtttccccctctgtccccctcagctgctgggcccgccasgagcccctgctatgtggaccaggacaagggatggagagctggtaggcagaagtgtgtgcaggtacacccctgcgtgcccccatccccgcgtcctctgtacttgaagcctcctggggtgagaacgaccatgtgacaggatcccacggaacacagggaaagtgacggtggccccctcccaggcctcaaagctccttaagcctcaggcttcttgaagctctgtgccctcctgtgcacatagccaggcacaagggctgggaggtgtggccacccagtgggtaagggccatgccaggctatgcca

SEQ ID NO: 62198 - DNA, 601 bp, Human
cttatgctgagtgaagccagacaacagtccatgcagatgaaatgttccaggacaggccaagccgcagagacagaacgcaggctgggggttgcccggggacaggaagcagctgtttaatgggtatggggtttccttttggggtgatgcaaattttttggaactaaggcaatgcctgttcaatgctgtaaatgtgctaaatgccaccaaatggttcacttataaatggttaaacttatgttacacaaatttcacaattaaaaaagagtaaaccataattatttgctaccctgtttccccctcygtccccctcagctgctgggcccgccaggagcccctgctatgtggaccaggacaagggatggagagctggtaggcagaagtgtgtgcaggtacacccctgcgtgcccccatccccgcgtcctctgtacttgaagcctcctggggtgagaacgaccatgtgacaggatcccacggaacacagggaaagtgacggtggccccctcccaggcctcaaagctccttaagcctcaggcttcttgaagctctgtgccctcctgtgcacatagccaggcacaagggctgggaggtgtggccacccagt

SEQ ID NO: 62199 - DNA, 601 bp, Human
ccagagaataacagagaataatgcgtggtggtgagaatgtggatagattgtaacccttgggaatgtaacacaattcaaccactgtggaaaacagtttggcggctccacaaaatataaaacagaattacctagcgatttcatgtccaggtatgtacccaaaagaactgaaagcacgaactcaggtatttataacaggaatgtccctggcagcatttttcataactgccaaaaggtggaaagcacccacgtgtccatccccagatgaatgggtgacggcacactatttacccctcacaggaargggctgatgtgtgccacagcctagaggaaccctgaagaccttatgctgagtgaagccagacaacagtccatgcagatgaaatgttccaggacaggccaagccgcagagacagaacgcaggctgggggttgcccggggacaggaagcagctgtttaatgggtatggggtttccttttggggtgatgcaaattttttggaactaaggcaatgcctgttcaatgctgtaaatgtgctaaatgccaccaaatggttcacttataaatggttaaacttatgttacacaaatttcacaattaaaaa

SEQ ID NO: 62200 - DNA, 601 bp, Human
catgaaccagagaataacagagaataatgcgtggtggtgagaatgtggatagattgtaacccttgggaatgtaacacaattcaaccactgtggaaaacagtttggcggctccacaaaatataaaacagaattacctagcgatttcatgtccaggtatgtacccaaaagaactgaaagcacgaactcaggtatttataacaggaatgtccctggcagcatttttcataactgccaaaaggtggaaagcacccacgtgtccatccccagatgaatgggtgacggcacactatttacccctcayaggaaggggctgatgtgtgccacagcctagaggaaccctgaagaccttatgctgagtgaagccagacaacagtccatgcagatgaaatgttccaggacaggccaagccgcagagacagaacgcaggctgggggttgcccggggacaggaagcagctgtttaatgggtatggggtttccttttggggtgatgcaaattttttggaactaaggcaatgcctgttcaatgctgtaaatgtgctaaatgccaccaaatggttcacttataaatggttaaacttatgttacacaaatttcacaat

SEQ ID NO: 62201 - DNA, 601 bp, Human
caaaccaaagccacaacgagctagcactgtgcactggctgcacggccagagtgagacatgaaccagagaataacagagaataatgcgtggtggtgagaatgtggatagattgtaacccttgggaatgtaacacaattcaaccactgtggaaaacagtttggcggctccacaaaatataaaacagaattacctagcgatttcatgtccaggtatgtacccaaaagaactgaaagcacgaactcaggtatttataacaggaatgtccctggcagcatttttcataactgccaaaaggtggaargcacccacgtgtccatccccagatgaatgggtgacggcacactatttacccctcacaggaaggggctgatgtgtgccacagcctagaggaaccctgaagaccttatgctgagtgaagccagacaacagtccatgcagatgaaatgttccaggacaggccaagccgcagagacagaacgcaggctgggggttgcccggggacaggaagcagctgtttaatgggtatggggtttccttttggggtgatgcaaattttttggaactaaggcaatgcctgttcaatgctgtaaatgtgctaaat

SEQ ID NO: 62202 - DNA, 601 bp, Human
accatcaacattaccatcacctccaccacaaccatcatcacgacctccactatcaccatcaccaataccaccactaccaacaccaacaccaacaccatgaccatcactatcaccagcaccacccccatctcacctctatccctaccactctcatcactttgctggcatcctgagacttccaaatgaaagcagctttttgccaggtttaacctacactaaccatggaaggaaatttgggctgtgaagacccacagggccaccactggctcatcctgcccgctgttgtatttataaccctgcytgatccctggcataaagagcaggtgtgaaggaaaatcctggggcaggctctggtaactggagtccatagaagcccctcttcgggagcacactgcatcagcccctggttcctcggcctaattgtacccgctaacaagtcaatacctcctttgagaaaaatctgacagcctgtcccattcttagttcactgggtttaagcatctctctgtaaaaccatcaagaaaacactggtctctgcagatgatggacagctcagtgcatataccgggcgctcagtaaacaccaagggcagctccttccc

SEQ ID NO: 62203 - DNA, 601 bp, Human
ctgaggcctcagcagaggaggcagcgcccagaagcggcccagtctcagctgccttctgtcacagagcccttccctttgccacgcctcctcctcacacgagcccagtgccaacccaagaggctcccgggcagccactactggacactggtttccaagtgacgattaagtgcaccctgcctggcgtcctgctctcttcctaaattccctgtgtcttccctgcacctgggggtggctctcatcacctctgactcaggaggttcagtgggctctcagcctcacccctgcccagggcagccaccamacacagctgttcacaggtgtctctctgagccatttgccaggcctgggcctactcacacatgtccagtttccctttcatacacagagcctggtatgtgcagctgcctgcatgcccctgccatcagcccctcactccgggccctggtgctcgctcgctcagcctggcccagggctcccaggtgcatggccatccctgtcctctccacctgtgggagtcctgcccactgtcctgaacaagctcctgtcccagccccgatctctgccccaagtcctgaccttgctggcctttgcctcccttaac

SEQ ID NO: 62204 - DNA, 601 bp, Human
gtttttgttttaattcattttaaaatcaaaaggatgaaataaatataataagaaataaataataataaagtggcctggattgtgtttgtcttataccaacacagttgcagaatataattttgcttttggatgtgggaggggcccatggtgcacgcatgtggccctggcttgagagtcacctggttgtgcctgagcccccaggaggacaaggcttagcatggagcacacagccctgagcaaggcagggacccatctgaggcctcagcagaggaggcagcgcccagaagcggcccagtctcarctgccttctgtcacagagcccttccctttgccacgcctcctcctcacacgagcccagtgccaacccaagaggctcccgggcagccactactggacactggtttccaagtgacgattaagtgcaccctgcctggcgtcctgctctcttcctaaattccctgtgtcttccctgcacctgggggtggctctcatcacctctgactcaggaggttcagtgggctctcagcctcacccctgcccagggcagccaccaaacacagctgttcacaggtgtctctctgagccatttgccaggcctggg

SEQ ID NO: 62205 - DNA, 601 bp, Human
gggtgcgcaaaaaaggtttttgttttaattcattttaaaatcaaaaggatgaaataaatataataagaaataaataataataaagtggcctggattgtgtttgtcttataccaacacagttgcagaatataattttgcttttggatgtgggaggggcccatggtgcacgcatgtggccctggcttgagagtcacctggttgtgcctgagcccccaggaggacaaggcttagcatggagcacacagccctgagcaaggcagggacccatctgaggcctcagcagaggaggcagcgcccagargcggcccagtctcagctgccttctgtcacagagcccttccctttgccacgcctcctcctcacacgagcccagtgccaacccaagaggctcccgggcagccactactggacactggtttccaagtgacgattaagtgcaccctgcctggcgtcctgctctcttcctaaattccctgtgtcttccctgcacctgggggtggctctcatcacctctgactcaggaggttcagtgggctctcagcctcacccctgcccagggcagccaccaaacacagctgttcacaggtgtctctctgagcca

SEQ ID NO: 62206 - DNA, 601 bp, Human
agccctgggcaccggagctgccagccagactcactcgggtaggaccacctgcagcatgctgcacaaacctgggtcctcggctctgtcccagctggaggctgcttttgcctgggactataatctaactttgcatttagggaaaaaacacggatcaagggaggctctactgtaaataacaaatttggaggtgtatataaagagagattctagttttaaaaagttattttaaattgtggtaaaatacacatgaactttatcatcttaaaatttttaagtgtacaattcagtggcattaagtgcrttcacactgccatgcaaaccatccttccacagcactctttttatcctgtaaaactgaaattctgtacccatgagacaattactccccctcctctcctctcccagttcctggaatcctccattctactgtctccacgaatttgacgactgcagggacctcatgtaagtggaatcatacagtgcttgtccttctgtgacataatgccctcgaggttcaaccatggcataggatgtggcaaattttttttcctttttaaagccaagtaatattccattgtatgtctgtattatattttgctta

SEQ ID NO: 62207 - DNA, 601 bp, Human
ccaatgaatgaatcaatgaatcaacgagccagtacaatggtttcataaacaggagtgtgaaagggctaggcacatttgggaaatggtcagaatttgggaaggggaagggagtaaggggacggggagatactgtgacatggtctcacgggcactggagccacgggcaggctgtcagtggcaggacagagctgtgtggatgcgccctgtgcacacgtgcagtgcccactagtgcaccagcaaccttgtggggccagccactgtgctgagcaaacaagcctgaggctgaggacaaaaccactcyttttcagctcaggaaatgatctatcagtgcctgaggagccctgggcaccggagctgccagccagactcactcgggtaggaccacctgcagcatgctgcacaaacctgggtcctcggctctgtcccagctggaggctgcttttgcctgggactataatctaactttgcatttagggaaaaaacacggatcaagggaggctctactgtaaataacaaatttggaggtgtatataaagagagattctagttttaaaaagttattttaaattgtggtaaaatacacatgaactttatcatctta

SEQ ID NO: 62208 - DNA, 601 bp, Human
ggctcccagggccccctctgccctccaactcacttcctcctcactcttacagggtgcctaccttcctgccacatctgccaactcactttctgtgagctgaatgaataaatttatgaaccaatgaatgaatcaatgaatcaacgagccagtacaatggtttcataaacaggagtgtgaaagggctaggcacatttgggaaatggtcagaatttgggaaggggaagggagtaaggggacggggagatactgtgacatggtctcacgggcactggagccacgggcaggctgtcagtggcaggayagagctgtgtggatgcgccctgtgcacacgtgcagtgcccactagtgcaccagcaaccttgtggggccagccactgtgctgagcaaacaagcctgaggctgaggacaaaaccactccttttcagctcaggaaatgatctatcagtgcctgaggagccctgggcaccggagctgccagccagactcactcgggtaggaccacctgcagcatgctgcacaaacctgggtcctcggctctgtcccagctggaggctgcttttgcctgggactataatctaactttgcatttagggaaaaaaca

SEQ ID NO: 62209 - DNA, 601 bp, Human
gggcaggacaggcaatctcgcacagaggagccagggtccactgaatcatggcaccctctgtggagccctgtgttaactgtccgctgcttgcagaataaaacatagctcctcatcagggctcccagggccccctctgccctccaactcacttcctcctcactcttacagggtgcctaccttcctgccacatctgccaactcactttctgtgagctgaatgaataaatttatgaaccaatgaatgaatcaatgaatcaacgagccagtacaatggtttcataaacaggagtgtgaaagggctrggcacatttgggaaatggtcagaatttgggaaggggaagggagtaaggggacggggagatactgtgacatggtctcacgggcactggagccacgggcaggctgtcagtggcaggacagagctgtgtggatgcgccctgtgcacacgtgcagtgcccactagtgcaccagcaaccttgtggggccagccactgtgctgagcaaacaagcctgaggctgaggacaaaaccactccttttcagctcaggaaatgatctatcagtgcctgaggagccctgggcaccggagctgccagccagact

SEQ ID NO: 62210 - DNA, 601 bp, Human
ccaactcttccccatctcatcacggtatggccccacctcactgctcaggtcacacacctcagtccccagatccctttctctttcacccctcaccccacctcccaagtcccctctgccacccctgtccaaccctggaccacatgctgggcaggacaggcaatctcgcacagaggagccagggtccactgaatcatggcaccctctgtggagccctgtgttaactgtccgctgcttgcagaataaaacatagctcctcatcagggctcccagggccccctctgccctccaactcacttcctcstcactcttacagggtgcctaccttcctgccacatctgccaactcactttctgtgagctgaatgaataaatttatgaaccaatgaatgaatcaatgaatcaacgagccagtacaatggtttcataaacaggagtgtgaaagggctaggcacatttgggaaatggtcagaatttgggaaggggaagggagtaaggggacggggagatactgtgacatggtctcacgggcactggagccacgggcaggctgtcagtggcaggacagagctgtgtggatgcgccctgtgcacacgtgcagtgcc

SEQ ID NO: 62211 - DNA, 601 bp, Human
cgtctttcagcctcactgctgctgctgagggcccatgctcaggccggcccctcctgggtaacccactttctcccagctgctcccaggacctcctctgtctttggtgctgtccagcgtcgctgggatgctaccgaggctgctcaccccctcggctggtttcctcctctgcaccctgtcctccagatggtggcagtggctcactcaccagccatatccaggccctgggctgttaatcctgtctctatgctggtgtgcagcatgctgatcagcagcctgggcatctccatgccttgctctctcyactcctttgcctcagtttggcccctcctcaccccaaattgtccccaactcttccccatctcatcacggtatggccccacctcactgctcaggtcacacacctcagtccccagatccctttctctttcacccctcaccccacctcccaagtcccctctgccacccctgtccaaccctggaccacatgctgggcaggacaggcaatctcgcacagaggagccagggtccactgaatcatggcaccctctgtggagccctgtgttaactgtccgctgcttgcagaataaaacatagctcctca

SEQ ID NO: 62212 - DNA, 601 bp, Human
acccccaccagcaggagcctgcgcctggccttcttcttgcctcattttttgacgtcattcatggaaggcccatttttgctgggtggagaattccatgtggacagctattttcctccactctacataaggtctggctcccgtctttcagcctcactgctgctgctgagggcccatgctcaggccggcccctcctgggtaacccactttctcccagctgctcccaggacctcctctgtctttggtgctgtccagcgtcgctgggatgctaccgaggctgctcaccccctcggctggtttcctmctctgcaccctgtcctccagatggtggcagtggctcactcaccagccatatccaggccctgggctgttaatcctgtctctatgctggtgtgcagcatgctgatcagcagcctgggcatctccatgccttgctctctctactcctttgcctcagtttggcccctcctcaccccaaattgtccccaactcttccccatctcatcacggtatggccccacctcactgctcaggtcacacacctcagtccccagatccctttctctttcacccctcaccccacctcccaagtcccctctgccac

SEQ ID NO: 62213 - DNA, 601 bp, Human
ccacgtggggctgtctcctggtcagactcaggcggacacattgcacacatgcattccttctctcacacacactcattctctcagacgcataccattacacaccacgggggcacacactgttatacacttgttctcccatatgctcacacattctcacactgccaatagggctctaacaagcacatgtatttgctcatactggtatatacccgctttcacacacaagcacacacattttcctgcaccctcggtgcacacatactaagcgtggcctggccctgtctgtggaggcaggggctcrccagctctccactggctcctggctgtggcccttggtctctcactcccccactgccgaccacccggcagctctgatggggcactgtgaggtcacccttgccatggcatggtgaccctgccacagaaacacaaatggagctccagaccatgaaaaacttccctaggatggcagcacaagggccgaaatttgggacttccaaaaaagaaaacaataacaacgatatgatccaaaaactgcatgaattagaagcagcgtagggcatgtgtgtagagcaggcccttcctgcagaacccctcatgc

SEQ ID NO: 62214 - DNA, 601 bp, Human
ggaaggggttccttccctggtgcccacctgcagctgagggtgccccacagagctctccccacccccattcatccctctttcatcacagcttagtgcctctgatgttactgctcctgtctcagggaccacgtggggctgtctcctggtcagactcaggcggacacattgcacacatgcattccttctctcacacacactcattctctcagacgcataccattacacaccacgggggcacacactgttatacacttgttctcccatatgctcacacattctcacactgccaatagggctctarcaagcacatgtatttgctcatactggtatatacccgctttcacacacaagcacacacattttcctgcaccctcggtgcacacatactaagcgtggcctggccctgtctgtggaggcaggggctcaccagctctccactggctcctggctgtggcccttggtctctcactcccccactgccgaccacccggcagctctgatggggcactgtgaggtcacccttgccatggcatggtgaccctgccacagaaacacaaatggagctccagaccatgaaaaacttccctaggatggcagcaca

SEQ ID NO: 62215 - DNA, 601 bp, Human
gagacagaaaaagagatggaggcatgcccacctaagaccccatctgctcccaccctgcccagctcagcaggaaagagtctgccctagtgtttgacagagtgaagtgctagactgtttccaatgttccacacgtggctgggctgtttaaattattcatctttggatgcagaggggaccagtcctgagccccctcgtcccacatgtgcgcgtgcacacaccttgtcaatccacacactccgtccaggtgtgcatgttctcatgcccaggtgggcctggagcaggttactttgcaggcagcacraggccaagcttcatcggtggagggctttggagagatgctgggacaggccaggggttgctcctgtctccggttgttacacctgccttttctaggtcctgctgcccgggcagtccacgagacagggtgtgctatgtgctccaccctagcacatacccaaagcatgcaatccctcggcactgatgcagcccatacctgagcctagccatcagcttcctgcagcccccagcctcagctcccgtgccctaaggatagttcctgccagacctgagcctgcacagcagccccagcctagcatccagc

SEQ ID NO: 62216 - DNA, 601 bp, Human
ggcctgtggaccaaggccaggcccgtgggtcgagacccacgtctggtgacagacactcccactcctggcaccatgggaaggtcaccagcaggacttacaaagcttttcccaccccatgccttcaaagcccaaatgccacgtggtgacagaatcctccctcaaacctagcacacaggtgtctgcctggacagctttggttgccagggctgggcccaccctgtacttctgcagcacagcggtggcctggcacacaccacacccaccgacggtgcaaatggcagtgtcgcttgtctgagaaacyaagaggattcccacatcaaccctcaatgacccccgccaccgtggttctggttcctcaggctggctgtgcccaggcaccatgcaggatggggtgggggaaggtcctgcttgctcacagcacacttgccaaagacccaagttgctgctcacattcagagagacctcagaaaccttcaaggcctatgtagtgtgtgtcatgagtgtgtgtatatgtatgcacgcacagggcatgcaggagacagaaaaagagatggaggcatgcccacctaagaccccatctgctcccaccctgcccagctca

SEQ ID NO: 62217 - DNA, 601 bp, Human
aaacagacttaaatgcacttaaaatgcctcccaggtggtctctgcagctgggcacagctgtcttaaggttcccgcttgtcacagacacttctagatggaaaaacacatggtccaaggtgggagaatgaaggaggtgggtgcaggacctgcctcagcggactgcagcctgggcagtcccagtgggccctgctcagaggtctcacgcttggtttaatgctctttgctacagtcttgaaattcttcataattctagatcaaggggcccacaaatgatgcagccaatcgtggtgggtcagccacrggggagagctggggaacagctgctggcatcaggaaccaccggactgtgcagactctgcagaacactggcctcctctgggcctcagtttccccagcttcgaagtgggggaggcatgctaaggagaggaggaacggccagtgcaggtgcagccaggcgtgcacctctgcacaggggtgtatcatcatgaggctctcactgcagactcagccactgggtgcagatcccttcactgcccatttcacatataagaacagcaaggctgggtggcgagaagcctgaccaagtgaaatagctggacat

SEQ ID NO: 62218 - DNA, 601 bp, Human
cctgctgccaaaagggatttgtgggtcaggcaatgattgcgagcagaaacagacttaaatgcacttaaaatgcctcccaggtggtctctgcagctgggcacagctgtcttaaggttcccgcttgtcacagacacttctagatggaaaaacacatggtccaaggtgggagaatgaaggaggtgggtgcaggacctgcctcagcggactgcagcctgggcagtcccagtgggccctgctcagaggtctcacgcttggtttaatgctctttgctacagtcttgaaattcttcataattctagawcaaggggcccacaaatgatgcagccaatcgtggtgggtcagccacaggggagagctggggaacagctgctggcatcaggaaccaccggactgtgcagactctgcagaacactggcctcctctgggcctcagtttccccagcttcgaagtgggggaggcatgctaaggagaggaggaacggccagtgcaggtgcagccaggcgtgcacctctgcacaggggtgtatcatcatgaggctctcactgcagactcagccactgggtgcagatcccttcactgcccatttcacatataagaacag

SEQ ID NO: 62219 - DNA, 601 bp, Human
gatgctaggggttggctgagctcaggtggggagaggcaatgcagctcagctgggtctagttttctctgggacacacacctctggccctggtcttcccaataagaaccatttgcccttgggtggccgtggggtggctctggtgatgcccaggctgcagaagagtgggtagggccctggcaccccatctgtcgcaggagcagatccagtctgggaatcccacaggtgctcctctggggcctccatgatgtgcaagcacctttagtggtccagggactagaggtaggacaggcctgggcttccsaaagcccccaccacaaagcccacatgtgcaggggagaacgggccttcctgctcccatctggcagagcccacccctacaggatcgtggggggcccaatcccaattggtctccctgctgccaaaagggatttgtgggtcaggcaatgattgcgagcagaaacagacttaaatgcacttaaaatgcctcccaggtggtctctgcagctgggcacagctgtcttaaggttcccgcttgtcacagacacttctagatggaaaaacacatggtccaaggtgggagaatgaaggaggtgggtgcagg

SEQ ID NO: 62220 - DNA, 601 bp, Human
ctgggattacaggcatgcaccaccatgcccagctaattttgtattttcttagtagagatggggtttctccatgttggtcaggctggtctcgaactctcaacctccggcgatccgcccgcctctgcctcccaaagtgctgggattacaggtatgagccaccgtgcccggcctatctatgtaatttttacctaaataactgaaaaatgaatcactgaaggcgctgtggacagaggcgtagcttccttgaagaaggcaggatgctagcctcggctgtggctgagtgagcccaagcaggggcacrgtgcactatgctgctgactgtgtgtggccaacatttcccacagtggaaagcttttaaaatagtttttggaactcatgtacattgtcggtgaaaatggaaaataatatacagttatcatgaaaaacaagaaggtagttcccaaaaacttaaaaattgaattaccatatgatctaccaatcccacttctgggtacatacgcaaaagaattgaaagccaagtctcaaatagatatttacacacccatgttcacaacagcactattcacgatagacaaaaggtggaagcaacctcagtggccat

SEQ ID NO: 62221 - DNA, 601 bp, Human
gtgcaatcttggctcaccacaacttccacctcccgggttcaagcgattctcctgcctcagcctccccagtagctgggattacaggcatgcaccaccatgcccagctaattttgtattttcttagtagagatggggtttctccatgttggtcaggctggtctcgaactctcaacctccggcgatccgcccgcctctgcctcccaaagtgctgggattacaggtatgagccaccgtgcccggcctatctatgtaatttttacctaaataactgaaaaatgaatcactgaaggcgctgtggacrgaggcgtagcttccttgaagaaggcaggatgctagcctcggctgtggctgagtgagcccaagcaggggcacggtgcactatgctgctgactgtgtgtggccaacatttcccacagtggaaagcttttaaaatagtttttggaactcatgtacattgtcggtgaaaatggaaaataatatacagttatcatgaaaaacaagaaggtagttcccaaaaacttaaaaattgaattaccatatgatctaccaatcccacttctgggtacatacgcaaaagaattgaaagccaagtctcaaatag

SEQ ID NO: 62222 - DNA, 601 bp, Human
tgaactatggatacacgcaaacacctggatgggtcacacacacaaaccatgccaaggtgaggaagccaggcagagaagagcgcacatggcatgattctggacggatgttaggcaatggatcagactggctgcctgtggcaggcgggggtgtgggggaggtggacagattgggaagggccacagggcactttctggggaatgtgaaggtcccatatcctgagaagggtgcagatcacgtgggcatattcgtttgtcagtattgtgcagctaaggtccgtgcatcttatctatgtaatttttttttatttatttatttatttatttatttatttatttatttatttttgagatggagttttgctcttgttgcctaggctggaatgcaatggtgcaatcttggctcaccacaacttccacctcccgggttcaagcgattctcctgcctcagcctccccagtagctgggattacaggcatgcaccaccatgcccagctaattttgtattttcttagtagagatggggtttctccatgttggtcaggctggtctcgaactctcaacctccggcgatccgcccgcctctgcctcccaaagtgctggg

SEQ ID NO: 62223 - DNA, 601 bp, Human
accatatgaccgtgcaattccactccattcatccaagaaaagtgaaaacatacgtctatcaaatgccatagttggaaatggaaggatgattcacagaagtcaagagcctagaggcccttcagcaggtggatggacaggcacaccgtggtccagccatgccacagaatcctgcccagcaatggaaaaggatgaactatggatacacgcaaacacctggatgggtcacacacacaaaccatgccaaggtgaggaagccaggcagagaagagcgcacatggcatgattctggacggatgttagscaatggatcagactggctgcctgtggcaggcgggggtgtgggggaggtggacagattgggaagggccacagggcactttctggggaatgtgaaggtcccatatcctgagaagggtgcagatcacgtgggcatattcgtttgtcagtattgtgcagctaaggtccgtgcatcttatctatgtaatttttatttatttatttatttatttatttatttatttatttatttatttttgagatggagttttgctcttgttgcctaggctggaatgcaatggtgcaatcttggctcaccacaact

SEQ ID NO: 62224 - DNA, 601 bp, Human
aacatgaacactcaattatttgtatagttacacacgggctagaaaagaactgctttaaaacagaaaaagaaaaggaaacaggggaagcagtatcctcagtgacaagcctattctcaatcatccaagccggaagggcacctgaaccatacagacttctcaacaggtcacccagagccagagtgttcaagggcaggagacactgccacccatgtggggcaggcaacagttgccaaaaaatgaagaaagcactttacaggaaagtcataaatctttatctaaacatacgcctaccatatgaccstgcaattccactccattcatccaagaaaagtgaaaacatacgtctatcaaatgccatagttggaaatggaaggatgattcacagaagtcaagagcctagaggcccttcagcaggtggatggacaggcacaccgtggtccagccatgccacagaatcctgcccagcaatggaaaaggatgaactatggatacacgcaaacacctggatgggtcacacacacaaaccatgccaaggtgaggaagccaggcagagaagagcgcacatggcatgattctggacggatgttaggcaatggatcag

SEQ ID NO: 62225 - DNA, 601 bp, Human
ttctcatgcagccgtgtgcggtacgtgccgtagagatgctggcccaggcggaagctgggcacctcctcaggggcgtcccgcagggcatggacgtacagcaagggcgtgccggccgcctggtccacatacagcttctcccagtaagcatccctcgagaagtagaggcccaatgccactgtgggaagtagggaagtgagtgagggatggtgagaataaggcttcttcaaggacaaaaaaaaaaaaaatcattaatttaaaattccgatcttagcaggagtttttcatctctgttcctgagaamatgaacactcaattatttgtatagttacacacgggctagaaaagaactgctttaaaacagaaaaagaaaaggaaacaggggaagcagtatcctcagtgacaagcctattctcaatcatccaagccggaagggcacctgaaccatacagacttctcaacaggtcacccagagccagagtgttcaagggcaggagacactgccacccatgtggggcaggcaacagttgccaaaaaatgaagaaagcactttacaggaaagtcataaatctttatctaaacatacgcctaccatatgaccgtg

SEQ ID NO: 62226 - DNA, 601 bp, Human; identical to SEQ ID NO: 18568

SEQ ID NO: 62227 - DNA, 601 bp, Human; identical to SEQ ID NO: 18569

SEQ ID NO: 62228 - DNA, 601 bp, Human; identical to SEQ ID NO: 18570

SEQ ID NO: 62229 - DNA, 601 bp, Human; identical to SEQ ID NO: 18571

SEQ ID NO: 62230 - DNA, 601 bp, Human; identical to SEQ ID NO: 18572

SEQ ID NO: 62231 - DNA, 601 bp, Human; identical to SEQ ID NO: 18573

SEQ ID NO: 62232 - DNA, 601 bp, Human; identical to SEQ ID NO: 18574

SEQ ID NO: 62233 - DNA, 601 bp, Human; identical to SEQ ID NO: 18575

SEQ ID NO: 62234 - DNA, 601 bp, Human; identical to SEQ ID NO: 18576

SEQ ID NO: 62235 - DNA, 601 bp, Human; identical to SEQ ID NO: 18577

SEQ ID NO: 62236 - DNA, 601 bp, Human; identical to SEQ ID NO: 18578

SEQ ID NO: 62237 - DNA, 601 bp, Human; identical to SEQ ID NO: 18579

SEQ ID NO: 62238 - DNA, 601 bp, Human; identical to SEQ ID NO: 18580

SEQ ID NO: 62239 - DNA, 601 bp, Human; identical to SEQ ID NO: 18581

SEQ ID NO: 62240 - DNA, 601 bp, Human; identical to SEQ ID NO: 18582

SEQ ID NO: 62241 - DNA, 601 bp, Human; identical to SEQ ID NO: 18583

SEQ ID NO: 62242 - DNA, 601 bp, Human; identical to SEQ ID NO: 18584

SEQ ID NO: 62243 - DNA, 601 bp, Human; identical to SEQ ID NO: 18585

SEQ ID NO: 62244 - DNA, 601 bp, Human; identical to SEQ ID NO: 18586

SEQ ID NO: 62245 - DNA, 601 bp, Human; identical to SEQ ID NO: 18587

SEQ ID NO: 62246 - DNA, 601 bp, Human; identical to SEQ ID NO: 18588

SEQ ID NO: 62247 - DNA, 601 bp, Human; identical to SEQ ID NO: 18589

SEQ ID NO: 62248 - DNA, 601 bp, Human; identical to SEQ ID NO: 18590

SEQ ID NO: 62249 - DNA, 601 bp, Human; identical to SEQ ID NO: 18591

SEQ ID NO: 62250 - DNA, 601 bp, Human; identical to SEQ ID NO: 18592

SEQ ID NO: 62251 - DNA, 601 bp, Human; identical to SEQ ID NO: 18593

SEQ ID NO: 62252 - DNA, 601 bp, Human; identical to SEQ ID NO: 18594

SEQ ID NO: 62253 - DNA, 601 bp, Human; identical to SEQ ID NO: 18595

SEQ ID NO: 62254 - DNA, 601 bp, Human; identical to SEQ ID NO: 18596

SEQ ID NO: 62255 - DNA, 601 bp, Human; identical to SEQ ID NO: 18597

SEQ ID NO: 62256 - DNA, 601 bp, Human; identical to SEQ ID NO: 18598

SEQ ID NO: 62257 - DNA, 601 bp, Human; identical to SEQ ID NO: 18599

SEQ ID NO: 62258 - DNA, 601 bp, Human; identical to SEQ ID NO: 18600

SEQ ID NO: 62259 - DNA, 601 bp, Human; identical to SEQ ID NO: 62188

SEQ ID NO: 62260 - DNA, 601 bp, Human; identical to SEQ ID NO: 62189

SEQ ID NO: 62261 - DNA, 601 bp, Human; identical to SEQ ID NO: 62190

SEQ ID NO: 62262 - DNA, 601 bp, Human; identical to SEQ ID NO: 62191

SEQ ID NO: 62263 - DNA, 601 bp, Human; identical to SEQ ID NO: 62192

SEQ ID NO: 62264 - DNA, 601 bp, Human; identical to SEQ ID NO: 62193

SEQ ID NO: 62265 - DNA, 601 bp, Human; identical to SEQ ID NO: 62194

SEQ ID NO: 62266 - DNA, 601 bp, Human; identical to SEQ ID NO: 62195

SEQ ID NO: 62267 - DNA, 601 bp, Human; identical to SEQ ID NO: 62196

SEQ ID NO: 62268 - DNA, 601 bp, Human; identical to SEQ ID NO: 62197

SEQ ID NO: 62269 - DNA, 601 bp, Human; identical to SEQ ID NO: 62198

SEQ ID NO: 62270 - DNA, 601 bp, Human; identical to SEQ ID NO: 62199

SEQ ID NO: 62271 - DNA, 601 bp, Human; identical to SEQ ID NO: 62200

SEQ ID NO: 62272 - DNA, 601 bp, Human; identical to SEQ ID NO: 62201

SEQ ID NO: 62273 - DNA, 601 bp, Human; identical to SEQ ID NO: 62202

SEQ ID NO: 62274 - DNA, 601 bp, Human; identical to SEQ ID NO: 62203

SEQ ID NO: 62275 - DNA, 601 bp, Human; identical to SEQ ID NO: 62204

SEQ ID NO: 62276 - DNA, 601 bp, Human; identical to SEQ ID NO: 62205

SEQ ID NO: 62277 - DNA, 601 bp, Human; identical to SEQ ID NO: 62206

SEQ ID NO: 62278 - DNA, 601 bp, Human; identical to SEQ ID NO: 62207

SEQ ID NO: 62279 - DNA, 601 bp, Human; identical to SEQ ID NO: 62208

SEQ ID NO: 62280 - DNA, 601 bp, Human; identical to SEQ ID NO: 62209

SEQ ID NO: 62281 - DNA, 601 bp, Human; identical to SEQ ID NO: 62210

SEQ ID NO: 62282 - DNA, 601 bp, Human; identical to SEQ ID NO: 62211

SEQ ID NO: 62283 - DNA, 601 bp, Human; identical to SEQ ID NO: 62212

SEQ ID NO: 62284 - DNA, 601 bp, Human; identical to SEQ ID NO: 62213

SEQ ID NO: 62285 - DNA, 601 bp, Human; identical to SEQ ID NO: 62214

SEQ ID NO: 62286 - DNA, 601 bp, Human; identical to SEQ ID NO: 62215

SEQ ID NO: 62287 - DNA, 601 bp, Human; identical to SEQ ID NO: 62216

SEQ ID NO: 62288 - DNA, 601 bp, Human; identical to SEQ ID NO: 62217

SEQ ID NO: 62289 - DNA, 601 bp, Human; identical to SEQ ID NO: 62218

SEQ ID NO: 62290 - DNA, 601 bp, Human; identical to SEQ ID NO: 62219

SEQ ID NO: 62291 - DNA, 601 bp, Human; identical to SEQ ID NO: 62220

SEQ ID NO: 62292 - DNA, 601 bp, Human; identical to SEQ ID NO: 62221

SEQ ID NO: 62293 - DNA, 601 bp, Human; identical to SEQ ID NO: 62222

SEQ ID NO: 62294 - DNA, 601 bp, Human; identical to SEQ ID NO: 62223

SEQ ID NO: 62295 - DNA, 601 bp, Human; identical to SEQ ID NO: 62224

SEQ ID NO: 62296 - DNA, 601 bp, Human; identical to SEQ ID NO: 62225

SEQ ID NO: 62297 - DNA, 601 bp, Human; identical to SEQ ID NO: 18568

SEQ ID NO: 62298 - DNA, 601 bp, Human; identical to SEQ ID NO: 18569

SEQ ID NO: 62299 - DNA, 601 bp, Human; identical to SEQ ID NO: 18570

SEQ ID NO: 62300 - DNA, 601 bp, Human; identical to SEQ ID NO: 18571

SEQ ID NO: 62301 - DNA, 601 bp, Human; identical to SEQ ID NO: 18572

SEQ ID NO: 62302 - DNA, 601 bp, Human; identical to SEQ ID NO: 18573

SEQ ID NO: 62303 - DNA, 601 bp, Human; identical to SEQ ID NO: 18574

SEQ ID NO: 62304 - DNA, 601 bp, Human; identical to SEQ ID NO: 18575

SEQ ID NO: 62305 - DNA, 601 bp, Human; identical to SEQ ID NO: 18576

SEQ ID NO: 62306 - DNA, 601 bp, Human; identical to SEQ ID NO: 18577

SEQ ID NO: 62307 - DNA, 601 bp, Human; identical to SEQ ID NO: 18578

SEQ ID NO: 62308 - DNA, 601 bp, Human; identical to SEQ ID NO: 18579

SEQ ID NO: 62309 - DNA, 601 bp, Human; identical to SEQ ID NO: 18580

SEQ ID NO: 62310 - DNA, 601 bp, Human; identical to SEQ ID NO: 18581

SEQ ID NO: 62311 - DNA, 601 bp, Human; identical to SEQ ID NO: 18582

SEQ ID NO: 62312 - DNA, 601 bp, Human; identical to SEQ ID NO: 18583

SEQ ID NO: 62313 - DNA, 601 bp, Human; identical to SEQ ID NO: 18584

SEQ ID NO: 62314 - DNA, 601 bp, Human; identical to SEQ ID NO: 18585

SEQ ID NO: 62315 - DNA, 601 bp, Human; identical to SEQ ID NO: 18586

SEQ ID NO: 62316 - DNA, 601 bp, Human; identical to SEQ ID NO: 18587

SEQ ID NO: 62317 - DNA, 601 bp, Human; identical to SEQ ID NO: 18588

SEQ ID NO: 62318 - DNA, 601 bp, Human; identical to SEQ ID NO: 18589

SEQ ID NO: 62319 - DNA, 601 bp, Human; identical to SEQ ID NO: 18590

SEQ ID NO: 62320 - DNA, 601 bp, Human; identical to SEQ ID NO: 18591

SEQ ID NO: 62321 - DNA, 601 bp, Human; identical to SEQ ID NO: 18592

SEQ ID NO: 62322 - DNA, 601 bp, Human; identical to SEQ ID NO: 18593

SEQ ID NO: 62323 - DNA, 601 bp, Human; identical to SEQ ID NO: 18594

SEQ ID NO: 62324 - DNA, 601 bp, Human; identical to SEQ ID NO: 18595

SEQ ID NO: 62325 - DNA, 601 bp, Human; identical to SEQ ID NO: 18596

SEQ ID NO: 62326 - DNA, 601 bp, Human; identical to SEQ ID NO: 18597

SEQ ID NO: 62327 - DNA, 601 bp, Human; identical to SEQ ID NO: 18598

SEQ ID NO: 62328 - DNA, 601 bp, Human; identical to SEQ ID NO: 18599

SEQ ID NO: 62329 - DNA, 601 bp, Human; identical to SEQ ID NO: 18600

SEQ ID NO: 62330 - DNA, 601 bp, Human; identical to SEQ ID NO: 62188

SEQ ID NO: 62331 - DNA, 601 bp, Human; identical to SEQ ID NO: 62189

SEQ ID NO: 62332 - DNA, 601 bp, Human; identical to SEQ ID NO: 62190

SEQ ID NO: 62333 - DNA, 601 bp, Human; identical to SEQ ID NO: 62191

SEQ ID NO: 62334 - DNA, 601 bp, Human; identical to SEQ ID NO: 62192

SEQ ID NO: 62335 - DNA, 601 bp, Human; identical to SEQ ID NO: 62193

SEQ ID NO: 62336 - DNA, 601 bp, Human; identical to SEQ ID NO: 62194

SEQ ID NO: 62337 - DNA, 601 bp, Human; identical to SEQ ID NO: 62195

SEQ ID NO: 62338 - DNA, 601 bp, Human; identical to SEQ ID NO: 62196

SEQ ID NO: 62339 - DNA, 601 bp, Human; identical to SEQ ID NO: 62197

SEQ ID NO: 62340 - DNA, 601 bp, Human; identical to SEQ ID NO: 62198

SEQ ID NO: 62341 - DNA, 601 bp, Human; identical to SEQ ID NO: 62199

SEQ ID NO: 62342 - DNA, 601 bp, Human; identical to SEQ ID NO: 62200

SEQ ID NO: 62343 - DNA, 601 bp, Human; identical to SEQ ID NO: 62201

SEQ ID NO: 62344 - DNA, 601 bp, Human; identical to SEQ ID NO: 62202

SEQ ID NO: 62345 - DNA, 601 bp, Human; identical to SEQ ID NO: 62203

SEQ ID NO: 62346 - DNA, 601 bp, Human; identical to SEQ ID NO: 62204

SEQ ID NO: 62347 - DNA, 601 bp, Human; identical to SEQ ID NO: 62205

SEQ ID NO: 62348 - DNA, 601 bp, Human; identical to SEQ ID NO: 62206

SEQ ID NO: 62349 - DNA, 601 bp, Human; identical to SEQ ID NO: 62207

SEQ ID NO: 62350 - DNA, 601 bp, Human; identical to SEQ ID NO: 62208

SEQ ID NO: 62351 - DNA, 601 bp, Human; identical to SEQ ID NO: 62209

SEQ ID NO: 62352 - DNA, 601 bp, Human; identical to SEQ ID NO: 62210

SEQ ID NO: 62353 - DNA, 601 bp, Human; identical to SEQ ID NO: 62211

SEQ ID NO: 62354 - DNA, 601 bp, Human; identical to SEQ ID NO: 62212

SEQ ID NO: 62355 - DNA, 601 bp, Human; identical to SEQ ID NO: 62213

SEQ ID NO: 62356 - DNA, 601 bp, Human; identical to SEQ ID NO: 62214

SEQ ID NO: 62357 - DNA, 601 bp, Human; identical to SEQ ID NO: 62215

SEQ ID NO: 62358 - DNA, 601 bp, Human; identical to SEQ ID NO: 62216

SEQ ID NO: 62359 - DNA, 601 bp, Human; identical to SEQ ID NO: 62217

SEQ ID NO: 62360 - DNA, 601 bp, Human; identical to SEQ ID NO: 62218

SEQ ID NO: 62361 - DNA, 601 bp, Human; identical to SEQ ID NO: 62219

SEQ ID NO: 62362 - DNA, 601 bp, Human; identical to SEQ ID NO: 62220

SEQ ID NO: 62363 - DNA, 601 bp, Human; identical to SEQ ID NO: 62221

SEQ ID NO: 62364 - DNA, 601 bp, Human; identical to SEQ ID NO: 62222

SEQ ID NO: 62365 - DNA, 601 bp, Human; identical to SEQ ID NO: 62223

SEQ ID NO: 62366 - DNA, 601 bp, Human; identical to SEQ ID NO: 62224

SEQ ID NO: 62367 - DNA, 601 bp, Human; identical to SEQ ID NO: 62225

SEQ ID NO: 62368 - DNA, 601 bp, Human; identical to SEQ ID NO: 18568

SEQ ID NO: 62369 - DNA, 601 bp, Human; identical to SEQ ID NO: 18569

SEQ ID NO: 62370 - DNA, 601 bp, Human; identical to SEQ ID NO: 18570

SEQ ID NO: 62371 - DNA, 601 bp, Human; identical to SEQ ID NO: 18571

SEQ ID NO: 62372 - DNA, 601 bp, Human; identical to SEQ ID NO: 18572

SEQ ID NO: 62373 - DNA, 601 bp, Human; identical to SEQ ID NO: 18573

SEQ ID NO: 62374 - DNA, 601 bp, Human; identical to SEQ ID NO: 18574

SEQ ID NO: 62375 - DNA, 601 bp, Human; identical to SEQ ID NO: 18575

SEQ ID NO: 62376 - DNA, 601 bp, Human; identical to SEQ ID NO: 18576

SEQ ID NO: 62377 - DNA, 601 bp, Human; identical to SEQ ID NO: 18577

SEQ ID NO: 62378 - DNA, 601 bp, Human; identical to SEQ ID NO: 18578

SEQ ID NO: 62379 - DNA, 601 bp, Human; identical to SEQ ID NO: 18579

SEQ ID NO: 62380 - DNA, 601 bp, Human; identical to SEQ ID NO: 18580

SEQ ID NO: 62381 - DNA, 601 bp, Human; identical to SEQ ID NO: 18581

SEQ ID NO: 62382 - DNA, 601 bp, Human; identical to SEQ ID NO: 18582

SEQ ID NO: 62383 - DNA, 601 bp, Human; identical to SEQ ID NO: 18583

SEQ ID NO: 62384 - DNA, 601 bp, Human; identical to SEQ ID NO: 18584

SEQ ID NO: 62385 - DNA, 601 bp, Human; identical to SEQ ID NO: 18585

SEQ ID NO: 62386 - DNA, 601 bp, Human; identical to SEQ ID NO: 18586

SEQ ID NO: 62387 - DNA, 601 bp, Human; identical to SEQ ID NO: 18587

SEQ ID NO: 62388 - DNA, 601 bp, Human; identical to SEQ ID NO: 18588

SEQ ID NO: 62389 - DNA, 601 bp, Human; identical to SEQ ID NO: 18589

SEQ ID NO: 62390 - DNA, 601 bp, Human; identical to SEQ ID NO: 18590

SEQ ID NO: 62391 - DNA, 601 bp, Human; identical to SEQ ID NO: 18591

SEQ ID NO: 62392 - DNA, 601 bp, Human; identical to SEQ ID NO: 18592

SEQ ID NO: 62393 - DNA, 601 bp, Human; identical to SEQ ID NO: 18593

SEQ ID NO: 62394 - DNA, 601 bp, Human; identical to SEQ ID NO: 18594

SEQ ID NO: 62395 - DNA, 601 bp, Human; identical to SEQ ID NO: 18595

SEQ ID NO: 62396 - DNA, 601 bp, Human; identical to SEQ ID NO: 18596

SEQ ID NO: 62397 - DNA, 601 bp, Human; identical to SEQ ID NO: 18597

SEQ ID NO: 62398 - DNA, 601 bp, Human; identical to SEQ ID NO: 18598

SEQ ID NO: 62399 - DNA, 601 bp, Human; identical to SEQ ID NO: 18599

SEQ ID NO: 62400 - DNA, 601 bp, Human; identical to SEQ ID NO: 18600

SEQ ID NO: 62401 - DNA, 601 bp, Human; identical to SEQ ID NO: 62188

SEQ ID NO: 62402 - DNA, 601 bp, Human; identical to SEQ ID NO: 62189

SEQ ID NO: 62403 - DNA, 601 bp, Human; identical to SEQ ID NO: 62190

SEQ ID NO: 62404 - DNA, 601 bp, Human; identical to SEQ ID NO: 62191

SEQ ID NO: 62405 - DNA, 601 bp, Human; identical to SEQ ID NO: 62192

SEQ ID NO: 62406 - DNA, 601 bp, Human; identical to SEQ ID NO: 62193

SEQ ID NO: 62407 - DNA, 601 bp, Human; identical to SEQ ID NO: 62194

SEQ ID NO: 62408 - DNA, 601 bp, Human; identical to SEQ ID NO: 62195

SEQ ID NO: 62409 - DNA, 601 bp, Human; identical to SEQ ID NO: 62196

SEQ ID NO: 62410 - DNA, 601 bp, Human; identical to SEQ ID NO: 62197

SEQ ID NO: 62411 - DNA, 601 bp, Human; identical to SEQ ID NO: 62198

SEQ ID NO: 62412 - DNA, 601 bp, Human; identical to SEQ ID NO: 62199

SEQ ID NO: 62413 - DNA, 601 bp, Human; identical to SEQ ID NO: 62200

SEQ ID NO: 62414 - DNA, 601 bp, Human; identical to SEQ ID NO: 62201

SEQ ID NO: 62415 - DNA, 601 bp, Human; identical to SEQ ID NO: 62202

SEQ ID NO: 62416 - DNA, 601 bp, Human; identical to SEQ ID NO: 62203

SEQ ID NO: 62417 - DNA, 601 bp, Human; identical to SEQ ID NO: 62204

SEQ ID NO: 62418 - DNA, 601 bp, Human; identical to SEQ ID NO: 62205

SEQ ID NO: 62419 - DNA, 601 bp, Human; identical to SEQ ID NO: 62206

SEQ ID NO: 62420 - DNA, 601 bp, Human; identical to SEQ ID NO: 62207

SEQ ID NO: 62421 - DNA, 601 bp, Human; identical to SEQ ID NO: 62208

SEQ ID NO: 62422 - DNA, 601 bp, Human; identical to SEQ ID NO: 62209

SEQ ID NO: 62423 - DNA, 601 bp, Human; identical to SEQ ID NO: 62210

SEQ ID NO: 62424 - DNA, 601 bp, Human; identical to SEQ ID NO: 62211

SEQ ID NO: 62425 - DNA, 601 bp, Human; identical to SEQ ID NO: 62212

SEQ ID NO: 62426 - DNA, 601 bp, Human; identical to SEQ ID NO: 62213

SEQ ID NO: 62427 - DNA, 601 bp, Human; identical to SEQ ID NO: 62214

SEQ ID NO: 62428 - DNA, 601 bp, Human; identical to SEQ ID NO: 62215

SEQ ID NO: 62429 - DNA, 601 bp, Human; identical to SEQ ID NO: 62216

SEQ ID NO: 62430 - DNA, 601 bp, Human; identical to SEQ ID NO: 62217

SEQ ID NO: 62431 - DNA, 601 bp, Human; identical to SEQ ID NO: 62218

SEQ ID NO: 62432 - DNA, 601 bp, Human; identical to SEQ ID NO: 62219

SEQ ID NO: 62433 - DNA, 601 bp, Human; identical to SEQ ID NO: 62220

SEQ ID NO: 62434 - DNA, 601 bp, Human; identical to SEQ ID NO: 62221

SEQ ID NO: 62435 - DNA, 601 bp, Human; identical to SEQ ID NO: 62222

SEQ ID NO: 62436 - DNA, 601 bp, Human; identical to SEQ ID NO: 62223

SEQ ID NO: 62437 - DNA, 601 bp, Human; identical to SEQ ID NO: 62224

SEQ ID NO: 62438 - DNA, 601 bp, Human; identical to SEQ ID NO: 62225

SEQ ID NO: 62439 - DNA, 601 bp, Human; identical to SEQ ID NO: 18568

SEQ ID NO: 62440 - DNA, 601 bp, Human; identical to SEQ ID NO: 18569

SEQ ID NO: 62441 - DNA, 601 bp, Human; identical to SEQ ID NO: 18570

SEQ ID NO: 62442 - DNA, 601 bp, Human; identical to SEQ ID NO: 18571

SEQ ID NO: 62443 - DNA, 601 bp, Human; identical to SEQ ID NO: 18572

SEQ ID NO: 62444 - DNA, 601 bp, Human; identical to SEQ ID NO: 18573

SEQ ID NO: 62445 - DNA, 601 bp, Human; identical to SEQ ID NO: 18574

SEQ ID NO: 62446 - DNA, 601 bp, Human; identical to SEQ ID NO: 18575

SEQ ID NO: 62447 - DNA, 601 bp, Human; identical to SEQ ID NO: 18576

SEQ ID NO: 62448 - DNA, 601 bp, Human; identical to SEQ ID NO: 18577

SEQ ID NO: 62449 - DNA, 601 bp, Human; identical to SEQ ID NO: 18578

SEQ ID NO: 62450 - DNA, 601 bp, Human; identical to SEQ ID NO: 18579

SEQ ID NO: 62451 - DNA, 601 bp, Human; identical to SEQ ID NO: 18580

SEQ ID NO: 62452 - DNA, 601 bp, Human; identical to SEQ ID NO: 18581

SEQ ID NO: 62453 - DNA, 601 bp, Human; identical to SEQ ID NO: 18582

SEQ ID NO: 62454 - DNA, 601 bp, Human; identical to SEQ ID NO: 18583

SEQ ID NO: 62455 - DNA, 601 bp, Human; identical to SEQ ID NO: 18584

SEQ ID NO: 62456 - DNA, 601 bp, Human; identical to SEQ ID NO: 18585

SEQ ID NO: 62457 - DNA, 601 bp, Human; identical to SEQ ID NO: 18586

SEQ ID NO: 62458 - DNA, 601 bp, Human; identical to SEQ ID NO: 18587

SEQ ID NO: 62459 - DNA, 601 bp, Human; identical to SEQ ID NO: 18588

SEQ ID NO: 62460 - DNA, 601 bp, Human; identical to SEQ ID NO: 18589

SEQ ID NO: 62461 - DNA, 601 bp, Human; identical to SEQ ID NO: 18590

SEQ ID NO: 62462 - DNA, 601 bp, Human; identical to SEQ ID NO: 18591

SEQ ID NO: 62463 - DNA, 601 bp, Human; identical to SEQ ID NO: 18592

SEQ ID NO: 62464 - DNA, 601 bp, Human; identical to SEQ ID NO: 18593

SEQ ID NO: 62465 - DNA, 601 bp, Human; identical to SEQ ID NO: 18594

SEQ ID NO: 62466 - DNA, 601 bp, Human; identical to SEQ ID NO: 18595

SEQ ID NO: 62467 - DNA, 601 bp, Human; identical to SEQ ID NO: 18596

SEQ ID NO: 62468 - DNA, 601 bp, Human; identical to SEQ ID NO: 18597

SEQ ID NO: 62469 - DNA, 601 bp, Human; identical to SEQ ID NO: 18598

SEQ ID NO: 62470 - DNA, 601 bp, Human; identical to SEQ ID NO: 18599

SEQ ID NO: 62471 - DNA, 601 bp, Human; identical to SEQ ID NO: 18600

SEQ ID NO: 62472 - DNA, 601 bp, Human; identical to SEQ ID NO: 33632

SEQ ID NO: 62473 - DNA, 601 bp, Human; identical to SEQ ID NO: 33633

SEQ ID NO: 62474 - DNA, 601 bp, Human; identical to SEQ ID NO: 33634

SEQ ID NO: 62475 - DNA, 601 bp, Human; identical to SEQ ID NO: 33635

SEQ ID NO: 62476 - DNA, 601 bp, Human; identical to SEQ ID NO: 33636

SEQ ID NO: 62477 - DNA, 601 bp, Human; identical to SEQ ID NO: 33637

SEQ ID NO: 62478 - DNA, 601 bp, Human; identical to SEQ ID NO: 33638

SEQ ID NO: 62479 - DNA, 601 bp, Human; identical to SEQ ID NO: 33639

SEQ ID NO: 62480 - DNA, 601 bp, Human; identical to SEQ ID NO: 33640

SEQ ID NO: 62481 - DNA, 601 bp, Human; identical to SEQ ID NO: 33641

SEQ ID NO: 62482 - DNA, 601 bp, Human; identical to SEQ ID NO: 33642

SEQ ID NO: 62483 - DNA, 601 bp, Human; identical to SEQ ID NO: 33643

SEQ ID NO: 62484 - DNA, 601 bp, Human; identical to SEQ ID NO: 33644

SEQ ID NO: 62485 - DNA, 601 bp, Human; identical to SEQ ID NO: 33645

SEQ ID NO: 62486 - DNA, 601 bp, Human; identical to SEQ ID NO: 33646

SEQ ID NO: 62487 - DNA, 601 bp, Human; identical to SEQ ID NO: 33647

SEQ ID NO: 62488 - DNA, 601 bp, Human; identical to SEQ ID NO: 33648

SEQ ID NO: 62489 - DNA, 601 bp, Human; identical to SEQ ID NO: 33649

SEQ ID NO: 62490 - DNA, 601 bp, Human; identical to SEQ ID NO: 33650

SEQ ID NO: 62491 - DNA, 601 bp, Human; identical to SEQ ID NO: 33651

SEQ ID NO: 62492 - DNA, 601 bp, Human; identical to SEQ ID NO: 33652

SEQ ID NO: 62493 - DNA, 601 bp, Human; identical to SEQ ID NO: 33653

SEQ ID NO: 62494 - DNA, 601 bp, Human; identical to SEQ ID NO: 33654

SEQ ID NO: 62495 - DNA, 601 bp, Human; identical to SEQ ID NO: 33655

SEQ ID NO: 62496 - DNA, 601 bp, Human; identical to SEQ ID NO: 33656

SEQ ID NO: 62497 - DNA, 601 bp, Human; identical to SEQ ID NO: 33657

SEQ ID NO: 62498 - DNA, 601 bp, Human; identical to SEQ ID NO: 33658

SEQ ID NO: 62499 - DNA, 601 bp, Human; identical to SEQ ID NO: 33659

SEQ ID NO: 62500 - DNA, 601 bp, Human; identical to SEQ ID NO: 33660

SEQ ID NO: 62501 - DNA, 601 bp, Human; identical to SEQ ID NO: 33661

SEQ ID NO: 62502 - DNA, 601 bp, Human; identical to SEQ ID NO: 33662

SEQ ID NO: 62503 - DNA, 601 bp, Human; identical to SEQ ID NO: 33663

SEQ ID NO: 62504 - DNA, 601 bp, Human; identical to SEQ ID NO: 33664

SEQ ID NO: 62505 - DNA, 601 bp, Human; identical to SEQ ID NO: 33665

SEQ ID NO: 62506 - DNA, 601 bp, Human
caaccttaactctcctacttaaacagcatatctcaaaaactaactacaagggaaaaatgttaataagttgttaaagagtaggattctgagatttttttttaaaaactcctattgggtatataaagttgcttcagctataaacattttaaagtgtgttcactgtgaaaagagctctatttcttgggtttataacataaaaattacagaaatagtgtgtctgtagggagagaagggcatacctacttttctccaatataataaacacaggaggatatagaagccagaggagtacttctgtcarcttaagttccttaaatctttatttcatttatatccttccagatggaccaataatgtgttgacaatatatgtgtccaaataaaaatgagaaaacataagagcgccactgcactccagcctgggagagagcaagactccgcctcaaaaaaaaaaaaaaaaaaaaaaggaaaataacgtagtaccacgccatgtaccactttattcctttactggttcagtaaacacatgctgagcccctactctgggccagcaatgggatacaacaaggattccagcaatgctcacagcctaggaagagaac

SEQ ID NO: 62507 - DNA, 601 bp, Human
gttttcactaaaaaaaagactgatgctgaatttgagatacatttttaaaaaaatggtagctaaccaacctgggcaacacagcaagaacctatatctctacaaaaaaatttaaaaatcagctgggtatggtggtacacacctgtagtgccagctacttgggaggctgaggcaggagggctgctggaacctaggaggttgaggctacagtgagacatgattacgccactgtactttggcctgggcgacaaagtgagaccctgtctctaaaaagagttgtttaatgaaaaataaaaataaaaartagtaactgaccaaatattcttaactaaaggttaggacacaattatgccttgtaagtaaaaatggttttggcaacagtgatagatggagaccaaagagaggaaaataaatgaaaattaagtgagtaagtgcttcaaaacactaattgatcttaggctacctcatcctgctggtatagaaaagaatatagaaagttattgttttctgtttttatgacaaatgccgaaataaataattaagcaaatacttcttattttggagaagtacctactatgctttacttgatgcttcaataatgcat

SEQ ID NO: 62508 - DNA, 601 bp, Human
aatgctttacataaacatggaaagtacaaataaattttattactgatttatgctacatctttaacaggtgaaacaaccaagccaaatctttctttgacagaattttaaaagagacattttattttttaatgcaactatagggagcagggtttcaagttctgcaaccagaaaacaattttgtaaaacaaatatattctaaaccctcgttgtttaccataaccaaattattatagactttgaataacagtttatgtgttttcactaaaaaaaagactgatgctgaatttgagatacatttttwaaaaaatggtagctaaccaacctgggcaacacagcaagaacctatatctctacaaaaaaatttaaaaatcagctgggtatggtggtacacacctgtagtgccagctacttgggaggctgaggcaggagggctgctggaacctaggaggttgaggctacagtgagacatgattacgccactgtactttggcctgggcgacaaagtgagaccctgtctctaaaaagagttgtttaatgaaaaataaaaataaaaaatagtaactgaccaaatattcttaactaaaggttaggacacaattat

SEQ ID NO: 62509 - DNA, 601 bp, Human
atacctggtgatttcaaggacttagcaagcaggtggaagactccatcaaccagtgagcactgcaaacatgtcatgcaaaaacatggcattctctttctaaaaaaacctcatcactggattgcttttcatggttactggtctagatacaagtttgaataggggctatgaattagtatgtatttactgagggtccagaatgtttgttcttgcagagctttaaaatatggttgacaagacacatttaacatccagaacatcttagcaggtcaactgtgtagcacacaggctgttaagcacagcrgagccaggagctacacaaggctagtgcagactcagcagcttcatggacacctggcaagatgtcacagatgtgtaagacaaaccagggaggcaatgggaacccactgctcccctgacagaggttctgcctttgagacagaaaggggtttggctgggataaactgtggaggaagagcagcggtggaagaaaaatcagaacaaataaatgtgagtagagatgtttctttctgtaaaacaaaagtaggttgtgatcagatcctacagtgcgcccagagccaggcttgtgggctgttggcagcta

SEQ ID NO: 62510 - DNA, 601 bp, Human
ggcagggtgtggtggctcatgcctgtaatcccagcactttgggaggctgaggcaggcggatcacttgaggctaggaatctgagatcagcctggccaaaacggtgaaactctgtctctactaaaaatacaaaaattagctgggtgtggtggtgcatgcctgtaatccctgctactcgggaggctgaggcaggagaatcacttgaacccaggaggcagaggttgcagcgagctgagatcacatcactgcactccagcctgggcaacagaggaagattctgtctcaaaaaaaaagaaaaaaaaacaataaacaaacaaacaaacaaaaatagcaccaaaataaatgaaatactgaaactcattactcacagaaaagaaatagtgtttccaaagcatcaaaaacaaaatccaaacactggaaggatacattaaacaacttaaaagtggtgacttctggggcagaggtagagatgagtattctcaattaatacttcttaacattgttgattttttgagccatgtgaatgtattgcctaatcaaaaataaaatttaatttcaaataaaataatttatttttgtatctgaaagacgtaatgttactct

SEQ ID NO: 62511 - DNA, 601 bp, Human
aatagacaatactgaattccctttcccagtgatatcctaatttaaaaatagcaccaaaattggcagggtgtggtggctcatgcctgtaatcccagcactttgggaggctgaggcaggcggatcacttgaggctaggaatctgagatcagcctggccaaaacggtgaaactctgtctctactaaaaatacaaaaattagctgggtgtggtggtgcatgcctgtaatccctgctactcgggaggctgaggcaggagaatcacttgaacccaggaggcagaggttgcagcgagctgagatcacrtcactgcactccagcctgggcaacagaggaagattctgtctcaaaaaaaaagaaaaaaaaacaataaacaaacaaacaaacaaaaatagcaccaaaataaatgaaatactgaaactcattactcacagaaaagaaatagtgtttccaaagcatcaaaaacaaaatccaaacactggaaggatacattaaacaacttaaaagtggtgacttctggggcagaggtagagatgagtattctcaattaatacttcttaacattgttgattttttgagccatgtgaatgtattgcctaatcaaaa

SEQ ID NO: 62512 - DNA, 601 bp, Human
agaatgtatccctgtcattaagtggcacatgactgtacattagtaatgagaaaagagaaaggaaggaaagcagggagggaaggaagaaggaaaagaagagcaaagaaagaagaaaactgaaaaaagagacaaatgaagcaaacatagaaaaatcttggtaattggccaggcgcggtggctcacgcctgtaatcccagcactttgggaggccgaggtgggcggatcacaagttcagcagatcgagatcatcctggctaacacggtgaaacctcgtctctactaaaaatacaaaaaattagcygggctaattttttttttttttttttgtagaatctgggagatcaatatgcagaggttacttatattgctctacttctgtttgtttaattcatttttttcttaaacaattttttctttgttctttttcttttgactgagccatccatttcctatttgtttattttgaaagttttcataataaaggttaatttttaaaaatttaaaactaccaagatcactaatcctatactaacaaagcatgagatttctcacatcaaaaaaaaagtccttctgtgagagcccattttttgaatagtttaaa

SEQ ID NO: 62513 - DNA, 601 bp, Human
tcttcaacaactgttgctgataatatgacaaaaaagagagtaagaagagcatgaggcatggggaattgctctaaagtaagagacaggagacagaaaagccaagagaatgtggaggctttgttggagtcctaattctaacaagctaacggggaaaaaagctgatttgatactaccaaggaaatacgaatatagactagatattaaatgatgccaacaaattgctattaaatttttattaggtaataatgatacaagagttatgtaagaagatgttcatccttttcaaaagtacataataaasgtataagactgagatgacatgagggctaggatttcctttaaagtaatcacaagccaggtaacaacacttctgtcagcaatgaaccacatatgctacagtgggtggtcccttgagatgataatggaactgaaaaatttctatcacctagtaacattgtagctgtcatgtcagagtacaaggcattactcacaggtttgtggtgatgctggtgtaaacaaaactactgtgccgccagtcatatgaaagcctaacacacacaattaggtacagtacacaacacttaataaatgaccatattac

SEQ ID NO: 62514 - DNA, 601 bp, Human
gcttacaggaatgataggaagagaggaactagtgaaatgatgccacaaggaagcacacagataaatccagaaagttagaaattctgtaggacaaatggcctggtctcttcaacaactgttgctgataatatgacaaaaaagagagtaagaagagcatgaggcatggggaattgctctaaagtaagagacaggagacagaaaagccaagagaatgtggaggctttgttggagtcctaattctaacaagctaacggggaaaaaagctgatttgatactaccaaggaaatacgaatatagactwgatattaaatgatgccaacaaattgctattaaatttttattaggtaataatgatacaagagttatgtaagaagatgttcatccttttcaaaagtacataataaaggtataagactgagatgacatgagggctaggatttcctttaaagtaatcacaagccaggtaacaacacttctgtcagcaatgaaccacatatgctacagtgggtggtcccttgagatgataatggaactgaaaaatttctatcacctagtaacattgtagctgtcatgtcagagtacaaggcattactcacaggtt

SEQ ID NO: 62515 - DNA, 601 bp, Human
agctatttcacatcttttgatgtgatgtgacacaaagtatacaacatcacctatgggtgtccatgccaaaaacgggaaatgtttaacagtgagttattatatgtaacatccagcttacaggaatgataggaagagaggaactagtgaaatgatgccacaaggaagcacacagataaatccagaaagttagaaattctgtaggacaaatggcctggtctcttcaacaactgttgctgataatatgacaaaaaagagagtaagaagagcatgaggcatggggaattgctctaaagtaagagasaggagacagaaaagccaagagaatgtggaggctttgttggagtcctaattctaacaagctaacggggaaaaaagctgatttgatactaccaaggaaatacgaatatagactagatattaaatgatgccaacaaattgctattaaatttttattaggtaataatgatacaagagttatgtaagaagatgttcatccttttcaaaagtacataataaaggtataagactgagatgacatgagggctaggatttcctttaaagtaatcacaagccaggtaacaacacttctgtcagcaatgaa

SEQ ID NO: 62516 - DNA, 601 bp, Human
ccagaacataccactatcaacatgatacaatggtataattaggtcttttaaattaagaacaatagaatttagtaatgtatcaaaatcttcatctaatcttcatccaacactaattatgattgaaatgagcacagaaatatcagtcaagaagagactttcaactgaagaattcatcattgtaaactgaattttaaaaaagtcaatggatcactgtatttatgaagcacactctatgagtcagacttatatttcaacctctgacgcacctggaattaaggtaaagaaagaacttggatattaygtccaaacaccatggcctcaaacttagtgaaaatataaaacacaatcaagtacagtcagagaatccaggttgaaacacaggtaaacacagcttcagtctcaccttattctattcagtgagtgagagcaaatgtgacagagaacatgtgcaccaaatggcaaatgcccacagaggcttgttacagaatgaacaagatggcctgccggagggcacgtgtgggcgaggaaaaaatggacacctgtaaaggacacagcacgtgacagtactgtcagagaaactatttttaactttatcaaaagc

SEQ ID NO: 62517 - DNA, 601 bp, Human
tgctctcagctcacgtcttcaacacggagtgaaaaaacatgcacagagggtgtttgggtggtcacaggccccagtacagccctccacgccaggctcatcatgtggctccgcctgcctccacagagcactccgaggctgaggccgacctgtgaacaaccaactgcaccatctccatccacagcttccttatctgcatagatgctacacataagaacattttcctctctcatctagagacccaagacagtgggaaagcaccatgggcagcatataggacctcacagcacagcagagccacaaycagcagagacagagcttagatgcattttgaggatttggcttcagtgccatccctgtcaccacctcagactcttctacagttttacaagaattttatgactattttttgtaaagaattccatggatctggacccagaagtaagggatctctagaaccctttgattcctctgaagaaagaaagtggaagaaaattgtgttatccactacaggtgactgaataagtccaataaacactctgctattctggtttataatacgttacatatgagtttacagattttcagcaaagaaccagaacat

SEQ ID NO: 62518 - DNA, 601 bp, Human
cagcatctggagcacacctggaaagatgaggctcctagaagagggggagggcactcaaaggggaagaaagagggcagcaaaggcccaaggggattcaagcaaatggggcagacaagctcaagcaagcactagtgccttagtcctcactcagctgcctcagccatccagagcgagactacatgcctctccacaccctcagtgactctcaccaaatgcaggctacttccttcctgaagaaaagccagaaggagagaggtccagagagggtggaagagattcaaaaagctacagggtgtttccygcagctccaacccacatctgaggggccccaaggagcagtcccacatgaccagccagtcaggagggcgtgactgctgtgctctcagctcacgtcttcaacacggagtgaaaaaacatgcacagagggtgtttgggtggtcacaggccccagtacagccctccacgccaggctcatcatgtggctccgcctgcctccacagagcactccgaggctgaggccgacctgtgaacaaccaactgcaccatctccatccacagcttccttatctgcatagatgctacacataagaacattttcctc

SEQ ID NO: 62519 - DNA, 601 bp, Human
agagccctgggtttgaaaatactatttctcattggttccatgctttgagcaagttacttaggtttctgaagcttcagtttcctcaccagtaaagtggaaatactttccaggctccattaacaattacagaaacacatgcaatgaacctggcatggttcctggagaaaagcaggcacactgtaaattatagccactattattgctgttagacagagacacggacagggacaagactaaacccagcggtttctacttctattccagttcccttcttctactcctattccagttcccttctatyccccaaagctgaccttacctctaaaaagaaatgcaacactgtgtcaagaagctgtgtagatgcagtaaactttcattaatcacctgccatgtgcctgcatgacaactcctcagtgtggaaagatgaacacattgtaacaataatgacgaccaatccaaatgatcaggggcagaggagcactgcaaacaaggcattggctcaaagatgaggctgtggtcagttacacctggcagaggggagaagctgggaatgggaggaacagagagaactacaaagaagaggcagcatctggagcacacc

SEQ ID NO: 62520 - DNA, 601 bp, Human
gcattgactcctacggcagcctaacagtgaacaaagattgagaacgatcaatttagagaagtaaaaagagaaatgagtgtggtgataaaaaaggagagaacaggaagtctgagggtatgtgttgaagaaagaattttaagaaactggacatggtaagcgccgtcaaaaactgcagacattaggatctcaaatccaagctaaaaaaaaaaaaaaaaaacccaaacagaaaactacagacatcacggatgttgagcagtaaaacaaattactgaatttcatgctggcaggtggctgataaccyggaaacactagctgggtagactgacaggcctataaaccagactgtagctattagaaagaggaggcatcaggagagagtaggactgggggaagttcggcaggaaaaaaatgagatagtaccacagtctctccaactgtcacagaagggtaattatttgtgttgtaagataagagatatcttagcaggtctgcaggcaaagggtttgaagctaatacaaaggaagagatggtgattgtgataaagttagaataactggtgaagcaagatctatagtggtttgagataatattatcttatatt

SEQ ID NO: 62521 - DNA, 601 bp, Human
acctgctgggttcaagcgattctcctgcctcctaattttgatacttttggtagatacgggcctctattggttttaaaataaacatttatttattggtttagcaattttagataatatttactgattcccctcctcctgccttgacctcctgatctgtcttgttgttacatatagatatagatatattgatgctctttttcttaattttgctaggcaccagagaggagaagaatagagatatgccctttattttgccaacatttactggatctccccagaatgcatacaatgggggaatagmtgctattagtagtaaggaagaagaggagagacatgacaaaatcctgtgctttagaaagattattctggcagtgacatgtaggtcagtttaaaatgcaaagattcatgattattatagcaagaggaagttcaatatagtttgtgtatcccttatccaaaatgcttgggatatgttttggattttggatttttttttctattttggaaaatttgcatatacataatgagatatcttggggatgtgacctatgtctaaacacgaaatttatttgtttcatatacaccttatatacatagcttg

SEQ ID NO: 62522 - DNA, 601 bp, Human
actgtgaagtgcccatgagataccagacactcaggacccaaagctaaggagaacaaggagacttcactgtacagatattagagccatagagggagacagggccattagggaagggcgatgcgggcagagaagaaggtaaagggcagacccctgaactaccagagggaggggtgggaaggaagacacagaacagttcagaggtactgaagaactgagagaaaggagtgcatggaaagaggggagaaaataaactataaaaggaagtggtccaggcttgaggtttccactcctgcacatgagraggttgaaagtcaccactccatcctaacaagcaggaagctgaacaagctgaaaatcaagaatcttcttagattcagcagagaatcaaggccacagagcaaactgctgcccccaaaactggaaagaaaggcaggcagccatagagaatcacagcttaccagagcagaaacctcccatagaacctactaccaaggcaagaaagtttaaactataattggttataaaaagcaattcatttttttgtttccagacaataaaaacacaaaaataaaggagaataaaaagaaactttacatattaa

SEQ ID NO: 62523 - DNA, 601 bp, Human
accaatgcacactaaaataacttttgagtattcaaccttctattagtacactcataaagtatatgcatgtggtattgttttatcacattgcaaaaagaaaagcagacatttttataagttgagataaagaaaaataaatatacatagaatttctaatattttatgactacactctcaatgaattgcttacagatgccatttgggagacagcttctgtaggccataggggagcatctgatgttttctggaatgctgcacagtggacagcatggagggtggaatgcaggaggcagggagggcygacaggaggacagacttccaggcttcagagggtgaactctgacagagggcagtggggtcagggatgaatgtgtttttcctttgagatgcaaacgtctcaggactgtgtgagtgattggatttggagggtgatgagaaagacagaacaatctagaataacactcaggtttctggcttggacaaataagtggatggtagagtcactgaatcagccggcacaatgaacacaaaaaaggaagaggggaatctgggtgtgtttgtgggagaagagaggagggtgaggtgcaatgatgggaggagg

SEQ ID NO: 62524 - DNA, 601 bp, Human
tagtgttgaaagagacgttcatgatccagtgccctcgctccctggttcgttcactcaagcatgctgtcagcaaacctgcggggtgctggaagagaagaatgaagagcctttgtgtctaagcagctggcactgaaagaggcagagaagtgaaccaactacactgtgtcctgggcctggtgcagtgggcacacggctggcgctcaacagacagtgctgaagcatgaacgaatgagcactgcaaaatgggaaggcaaaggagagcatgatgactttacttgtggagtgcagagtagcaccagggaaagcttctcggataggaatcaagaaagaatcggccgggtgctgtggctcacgcctataatcccagcactttgggaggctgaggtgggtggatcatgaggtcaggagttcaagaccagtttggccaacatggtgaaaccccgtctctactaaaagtacaaaaattagccgggtgtggtggcgggtgcctgtaatcccagctactcgggaggctgaggcagagaattgcttgaacccaggaggcggaggttgagtgagccacgattgtgccactgcactccagcctgggcgacagagcaag

SEQ ID NO: 62525 - DNA, 601 bp, Human
tacattccttatacatacttacatgcaaaatatgatcagtttcagttataatggtaactcttaccttatgaattatattctagaaacttgtgacctatatacataaatattaaatgaataaaaatcctgaggcacattaagtgaatttaaagttctcatccagtaaaatattcatttatgaaaaaaatgcctgcaatataaataatcagatcttatctgttttatagttagatatcttaaattaaagacaacgtaactagtaaggtgaattattcttcacccaaaaataactttttctgtgctatatattccaatataaaccaaagcaaatccaaaatacgtgatttgaatgtttacatttgaatcattaagtcaagccaaaatatatagccatagccaaaaataatggctctagaatattgtaggttctcattatatgtctactttttaggattaccaaaatacacatttttttttcaattggctttatttgtgattctagaactgcacaacacttcgttccataaaatgagtccccacaacaaatttatatataaaaatataaaaacatagttactaataaatgaatgagtttagtaag

SEQ ID NO: 62526 - DNA, 601 bp, Human
atgctccaagagagaaaaacgggcaatataggctgggctcaatattatacctaagagaaggaagagaggttcaacagcatctttgtttatttcaatttctgaaggtaaattcaattaacttttcatttaatacttaagatcactggagctaaagaaggattcaaaacataaaagtgtatttatatcatttgaggggttttcagacagttttcttcagaatgacagtctgattattactagtgttagttataagtcagtaattaaggtagatatatcattccctaacctttgtcccttcccygttatttactctttcactaacccaattaagcagtctcaactgctcactgtatacattccttatacatacttacatgcaaaatatgatcagtttcagttataatggtaactcttaccttatgaattatattctagaaacttgtgacctatatacataaatattaaatgaataaaaatcctgaggcacattaagtgaatttaaagttctcatccagtaaaatattcatttatgaaaaaaatgcctgcaatataaataatcagatcttatctgttttatagttagatatcttaaattaaagac

SEQ ID NO: 62527 - DNA, 601 bp, Human
gtaaatgcctgcaactgcaggctgagcaggaggagctcaccagttttcggacatcttcgctccacacctctccttttgcaggctgctctgcatataatgaaatccccaacagtctgttaagcaaaatattcaggccttccatgcatgctccaagagagaaaaacgggcaatataggctgggctcaatattatacctaagagaaggaagagaggttcaacagcatctttgtttatttcaatttctgaaggtaaattcaattaacttttcatttaatacttaagatcactggagctaaagaargattcaaaacataaaagtgtatttatatcatttgaggggttttcagacagttttcttcagaatgacagtctgattattactagtgttagttataagtcagtaattaaggtagatatatcattccctaacctttgtcccttccctgttatttactctttcactaacccaattaagcagtctcaactgctcactgtatacattccttatacatacttacatgcaaaatatgatcagtttcagttataatggtaactcttaccttatgaattatattctagaaacttgtgacctatatacata

SEQ ID NO: 62528 - DNA, 601 bp, Human
tgatgtaaacctgaaactgctgttgactcaactgcccaaccgaaaggtaaatgcctgcaactgcaggctgagcaggaggagctcaccagttttcggacatcttcgctccacacctctccttttgcaggctgctctgcatataatgaaatccccaacagtctgttaagcaaaatattcaggccttccatgcatgctccaagagagaaaaacgggcaatataggctgggctcaatattatacctaagagaaggaagagaggttcaacagcatctttgtttatttcaatttctgaaggtaaatkcaattaacttttcatttaatacttaagatcactggagctaaagaaggattcaaaacataaaagtgtatttatatcatttgaggggttttcagacagttttcttcagaatgacagtctgattattactagtgttagttataagtcagtaattaaggtagatatatcattccctaacctttgtcccttccctgttatttactctttcactaacccaattaagcagtctcaactgctcactgtatacattccttatacatacttacatgcaaaatatgatcagtttcagttataatggtaact

SEQ ID NO: 62529 - DNA, 601 bp, Human; identical to SEQ ID NO: 33666

SEQ ID NO: 62530 - DNA, 601 bp, Human; identical to SEQ ID NO: 33667

SEQ ID NO: 62531 - DNA, 601 bp, Human; identical to SEQ ID NO: 33668

SEQ ID NO: 62532 - DNA, 601 bp, Human; identical to SEQ ID NO: 33669

SEQ ID NO: 62533 - DNA, 601 bp, Human
gacaacataaaaattcagaccaagagaataaatattcagaagcaaaggctttttagaagtgagacaggctcgaatgcctattctactacagaacttgtttcttcatctggaaaatggggataaagtgttttccttatggggaggttatgaggactaaatggtagattaccaggcatgtaataaagggtagctatttttcaacacatgactatatgctaggactatgatttaatagactggcaaaagaaaagatagggaatcaggaaaaaaagaagcaataaaaggtttgttactaacagarggtgagttctgaaaagcaagaagagttcaatttatccaggatgtcataaacgccaactatcacaacccaaaggacaagacgacaatattactgttcctacctgtccagtctgataatgtctggcaaattggttaactactcgataatcatttgcaaagtactccatcagaatagaaggaacctcagcaaaatcagtagggcacctggtccctaaaacaagaaaaaaaaaaaagttggcatgaatcaaatcaatatatttatctactttttgtgtgccctttaaaacttttatttgtactt

SEQ ID NO: 62534 - DNA, 601 bp, Human
agcctttagctcccagctcctggccaggcctccccagcagtctagaggttgctcctcccctctcctgggctttgccttcgggcggtaacaccctagtcaggctctgtctcagttcccctaggaattaaagaccgcgggcaatgggatgttgcctgacttattcttggctgtttcttggatgctgagaatgcagactggtaaatattaaaactcagcaagtgttttctgactgaagggcctctctgtcctatgtcctcaataaatgtattttggtggaacagatgaataccgctgagagctractggcgaatgccgcttctctttttcccagacctccttcctcctgcacttctcctccccagcctccccagttcccccagggccctcgtggccctgcctgtgcacagggctctaagcacctcaggcagggagcaatcactgaactactaatcattcccagttcccaaaatacacagccatagatggattatgctatcacgtggtagggtatgcctctctatgttattggccaagtctacataattcccagaacaattctttgtagattaatggatgggtagttaattggatcacaaatctg

SEQ ID NO: 62535 - DNA, 601 bp, Human
cttttaaaaaaatgactactgtgcaaggctcctggtcctcttgtgtagtcacccccgcgtgtgtgtcctcccacgccctgtgttcgcgcccctcgccagaccctctttccgcagccctgcaccacgcgctctcactttggcagcggccacctccgaaacctcagactcctcaaactcgcagaaacccctcctggcggcagtgatgctccccacgtctcccacactaagtggcgcctcccttggcctgaccctgcggaaccctcggaagcaggatgcccctttgctgtcccctgcctcccaycctgaccccttcaccagccgtgtacttgtctgcgggttgctgggtcgccagagctgaggccacccagcaagggtgggtggagagaggccacgcgcccgggatgaggggagaggggccgagcccccggagccggagcctgcctctccaggaagcctctcaggctctatccgcaccccctgcgatccgcttcctccctgacaccagcgtgattttcttgaagtaaaaatttgattcccgcctgaaagcctttactggctgctgctccagcagcagaagacccaacccatatgcccgtgtttt

SEQ ID NO: 62536 - DNA, 601 bp, Human
gcatgacacctgcaaatctgataagcatacttctaattcttccaccacaaggaattctttgactatgctatgatatagttctgataaaatacctgtaggtgttaataagtcactgattatcctctacctgagacctctctggaatatatttcataatgttaaaaaaatcctttcctgaaaggcagcaggatagaaaattaggcataaacatgcaaccctgttattttttccttgtgagattaaatgccatttatttacaaagacttggattttagagaattaacttcttatccttaaggcwaggactgcacttaagatttaaaaaaaataaataaaataaaataaacctccttggtgccttcattagtgacaagaagaggcaagcccttgtgaagctcaaagcatttacatgtctcttgcctttgggcacgctttccattctccatgagaatcacaaaattttagattctttagagactacgtctgtaagtcccttaagggcactggatccatcttctgtgtctgaaacttgaattaattcaaagcagcttagtgctttcttcctatctcatctatcttggattagattttgggtttactc

SEQ ID NO: 62537 - DNA, 601 bp, Human
gcttgtcaagacgttctgaatcttgaatgagcacctctggtatctgctatctctgacagctgcatgacacctgcaaatctgataagcatacttctaattcttccaccacaaggaattctttgactatgctatgatatagttctgataaaatacctgtaggtgttaataagtcactgattatcctctacctgagacctctctggaatatatttcataatgttaaaaaaatcctttcctgaaaggcagcaggatagaaaattaggcataaacatgcaaccctgttattttttccttgtgagaytaaatgccatttatttacaaagacttggattttagagaattaacttcttatccttaaggctaggactgcacttaagatttaaaaaaaataaataaaataaaataaacctccttggtgccttcattagtgacaagaagaggcaagcccttgtgaagctcaaagcatttacatgtctcttgcctttgggcacgctttccattctccatgagaatcacaaaattttagattctttagagactacgtctgtaagtcccttaagggcactggatccatcttctgtgtctgaaacttgaattaatt

SEQ ID NO: 62538 - DNA, 601 bp, Human
ccacctaccaataccaccatgttggggaccaagttttaacataagttttggtggagcaaaccatattctaaccacagcagaggtcaaggggcaggctattagactgcacggtgaaggtgcttagcattttcaatgctgggtataggggtttagactgtcttctttccttgaatctaagaacccaatatttgtaaagagccactgtgattttatgacagatttggggagagagcacactatgccactgctatagcttgagtatctgtcccctccaaaacccatgttgaaatttaagccccartggggcttaaataccccttctccaggcagtattgagagatcactgggtcatgagggctctgccctcataaatggattaattcatccattgattataatggattaagagattatcatgggagtgggactgctggctttataagaagaggaagagagacctgagctagcatgtgagcacactcagtccctcgccatgtgaggccctgagccaccttgggactctgcagagtccccaccagtaggaaggcgctcatcagatacggccccttgaccttggacttctcagcctccataactgtaa

SEQ ID NO: 62539 - DNA, 601 bp, Human
agtcaattaggacacatatattcacacatctggggaaaattcagtctgagaaagtgggatgggaacagaaccttagaaatgcaaaggaaaggtaaaagtatcagacttttgctcattttcagaaatttacctaaaacctgatgtgaagaaattgcaaatctagggcacagacaaatagatcctgcctccattaggaatcaggatctggggacagtgagagaaagaagaggaaaactctgagtacccaaatgatctgggcgtcggggacagcctagcttccccatggcggcgggagggggggatgtggatgggaattgccttactgcattttgtgttgctataacagaatatctgagactgggtaaattataaagaacagaagcttatgtagcttacaattctgtaggctaggaacttcaagactgggcaacacatccggcagcttctggtgagagccttgtgctgcatcaaagcatggcagagaaatggaaggggaacctgatgcatatgtaaagagcaaaatacaagaggcaacctcgcttcataacaacctgctctcgtgggaactgatctgttcccatgagaactaatccattccaga

SEQ ID NO: 62540 - DNA, 601 bp, Human
ggctaagtcaattaggacacatatattcacacatctggggaaaattcagtctgagaaagtgggatgggaacagaaccttagaaatgcaaaggaaaggtaaaagtatcagacttttgctcattttcagaaatttacctaaaacctgatgtgaagaaattgcaaatctagggcacagacaaatagatcctgcctccattaggaatcaggatctggggacagtgagagaaagaagaggaaaactctgagtacccaaatgatctgggcgtcggggacagcctagcttccccatggcggcgggagcgggggatgtggatgggaattgccttactgcattttgtgttgctataacagaatatctgagactgggtaaattataaagaacagaagcttatgtagcttacaattctgtaggctaggaacttcaagactgggcaacacatccggcagcttctggtgagagccttgtgctgcatcaaagcatggcagagaaatggaaggggaacctgatgcatatgtaaagagcaaaatacaagaggcaacctcgcttcataacaacctgctctcgtgggaactgatctgttcccatgagaactaatccatt

SEQ ID NO: 62541 - DNA, 601 bp, Human
tgggctaagtcaattaggacacatatattcacacatctggggaaaattcagtctgagaaagtgggatgggaacagaaccttagaaatgcaaaggaaaggtaaaagtatcagacttttgctcattttcagaaatttacctaaaacctgatgtgaagaaattgcaaatctagggcacagacaaatagatcctgcctccattaggaatcaggatctggggacagtgagagaaagaagaggaaaactctgagtacccaaatgatctgggcgtcggggacagcctagcttccccatggcggcgggrgggggggatgtggatgggaattgccttactgcattttgtgttgctataacagaatatctgagactgggtaaattataaagaacagaagcttatgtagcttacaattctgtaggctaggaacttcaagactgggcaacacatccggcagcttctggtgagagccttgtgctgcatcaaagcatggcagagaaatggaaggggaacctgatgcatatgtaaagagcaaaatacaagaggcaacctcgcttcataacaacctgctctcgtgggaactgatctgttcccatgagaactaatcca

SEQ ID NO: 62542 - DNA, 601 bp, Human
gggctgggctaagtcaattaggacacatatattcacacatctggggaaaattcagtctgagaaagtgggatgggaacagaaccttagaaatgcaaaggaaaggtaaaagtatcagacttttgctcattttcagaaatttacctaaaacctgatgtgaagaaattgcaaatctagggcacagacaaatagatcctgcctccattaggaatcaggatctggggacagtgagagaaagaagaggaaaactctgagtacccaaatgatctgggcgtcggggacagcctagcttccccatggcggsgggagggggggatgtggatgggaattgccttactgcattttgtgttgctataacagaatatctgagactgggtaaattataaagaacagaagcttatgtagcttacaattctgtaggctaggaacttcaagactgggcaacacatccggcagcttctggtgagagccttgtgctgcatcaaagcatggcagagaaatggaaggggaacctgatgcatatgtaaagagcaaaatacaagaggcaacctcgcttcataacaacctgctctcgtgggaactgatctgttcccatgagaactaa

SEQ ID NO: 62543 - DNA, 601 bp, Human
caggggctgggctaagtcaattaggacacatatattcacacatctggggaaaattcagtctgagaaagtgggatgggaacagaaccttagaaatgcaaaggaaaggtaaaagtatcagacttttgctcattttcagaaatttacctaaaacctgatgtgaagaaattgcaaatctagggcacagacaaatagatcctgcctccattaggaatcaggatctggggacagtgagagaaagaagaggaaaactctgagtacccaaatgatctgggcgtcggggacagcctagcttccccatggcggcgggagggggggatgtggatgggaattgccttactgcattttgtgttgctataacagaatatctgagactgggtaaattataaagaacagaagcttatgtagcttacaattctgtaggctaggaacttcaagactgggcaacacatccggcagcttctggtgagagccttgtgctgcatcaaagcatggcagagaaatggaaggggaacctgatgcatatgtaaagagcaaaatacaagaggcaacctcgcttcataacaacctgctctcgtgggaactgatctgttcccatgagaac

SEQ ID NO: 62544 - DNA, 601 bp, Human
tgttataacattaaatattaaataaaagagaaattcattacttggagaggcatctctttctgctctaatcatttacgagaagaatctcctgaactgaaatgagcctccttagaattcccttccactattcctagtaatattgttttttcctagaatgactttcttcctttacatggtatccttcaaatggtatatgaaagacttgagtttcatttttctagtctaaaaatgtcttttcttaaacccctcctaatgtgaagtggcttccaattttacaaataagcagcagccacccctcagratggtttctagttcatcagcatcactgtaaaacaggcccttcaaaattgatcaaacacactgggactggcagcccagctccaggcaatatgctgaggacaaagggatattgtgggtaaagataaggatagtggcagtttctgtaggggtggaggagttagttggaaactgaggaattgaggacaaaagggaacagaggcagctactgtgaagcaggggaaagggtggggcaaccaagcatctggactactcaggggctgggctaagtcaattaggacacatatattcacacatctgggga

SEQ ID NO: 62545 - DNA, 601 bp, Human
agcggggcagagatgggttcagagaagagcatgtggtaatgttttacttctcaggttggagaatggcttcatagctgttctttctacaaatactgtgttataacattaaatattaaataaaagagaaattcattacttggagaggcatctctttctgctctaatcatttacgagaagaatctcctgaactgaaatgagcctccttagaattcccttccactattcctagtaatattgttttttcctagaatgactttcttcctttacatggtatccttcaaatggtatatgaaagacttgrgtttcatttttctagtctaaaaatgtcttttcttaaacccctcctaatgtgaagtggcttccaattttacaaataagcagcagccacccctcaggatggtttctagttcatcagcatcactgtaaaacaggcccttcaaaattgatcaaacacactgggactggcagcccagctccaggcaatatgctgaggacaaagggatattgtgggtaaagataaggatagtggcagtttctgtaggggtggaggagttagttggaaactgaggaattgaggacaaaagggaacagaggcagctac

SEQ ID NO: 62546 - DNA, 601 bp, Human
aagttcaaaaaactaaacaccacacttcttaggaataaataatgtggccaaaaaatgataagaattgagcactatgctttcctctgggaggcaagcggggcagagatgggttcagagaagagcatgtggtaatgttttacttctcaggttggagaatggcttcatagctgttctttctacaaatactgtgttataacattaaatattaaataaaagagaaattcattacttggagaggcatctctttctgctctaatcatttacgagaagaatctcctgaactgaaatgagcctccttagrattcccttccactattcctagtaatattgttttttcctagaatgactttcttcctttacatggtatccttcaaatggtatatgaaagacttgagtttcatttttctagtctaaaaatgtcttttcttaaacccctcctaatgtgaagtggcttccaattttacaaataagcagcagccacccctcaggatggtttctagttcatcagcatcactgtaaaacaggcccttcaaaattgatcaaacacactgggactggcagcccagctccaggcaatatgctgaggacaaagggatattgt

SEQ ID NO: 62547 - DNA, 601 bp, Human
atgttataaataaatgcttgtaaagaaaagaaaaagaaacactcaccaactcattttatgaaatagtatatatttaagtgaacaccagcaaataatgacaaagaaaaatcataagcaatccctctctcataaacataaatgcaaaaatcaagaatataaaaatattagtaaactagcaaactatgaggtgggtggatcaactggggtcaggagctcaaggccagcctggccaacatggtaaaaccccacctctactaaaattacaaaaattagccatgtgtggtggcacacgctgtaatcycagctactcaggaggctgaggcgggagaatcacttgaacccaggaggtggaagttgcagtgagcagagactgcaccactgcactccagcctgggcgatggagggagactctgtctcaaaaaaataaataaataaaataattagcaaactaaagccagctctgcattaaaaaataactattatttaggaccaaggtggcttaatcctgaaatgcaaaggtggctaatgtttaacattaacattcactacattaacagattaaaggtgaagaacaatctgacagctcaaaagatgcaggaaa

SEQ ID NO: 62548 - DNA, 601 bp, Human
ctgaaacatctgactttctcaatgctgtcacagcttgggtgaccacacatggaggtgggcatgacagtcctacgttatgactgccatcttggtgtgatcaataatagcactcctttctttcttaacagcatttggagctgggcacggtggctcacgcctataatccctgcattttggagggccaaagctggaggactgcttgaggctgaatgttcgagaacaggctgggcaacagaacgagacaccatctctacaaaaaaatttaaaattagctgggcatgataacaggccctgtagtccwagctacttgggaggctggggcaggaggactgcttcagcccaagaatttgaggtttcagggagctgtgattgcaccactgcactctagcctgggtgacagtgtgagaccctgtccctctctcaccaaaaaaggggtttggcttggacaatagatcatattgtcaccctattaataactaacttactgagtgcttcatatgagccaaacactgcatcagttgtccacagcctatgctatactgccttaccaaagagaggaaggtgtcaactgtatccttggggtaaacaaaagtggcaatgt

SEQ ID NO: 62549 - DNA, 601 bp, Human
catctgaaacatctgactttctcaatgctgtcacagcttgggtgaccacacatggaggtgggcatgacagtcctacgttatgactgccatcttggtgtgatcaataatagcactcctttctttcttaacagcatttggagctgggcacggtggctcacgcctataatccctgcattttggagggccaaagctggaggactgcttgaggctgaatgttcgagaacaggctgggcaacagaacgagacaccatctctacaaaaaaatttaaaattagctgggcatgataacaggccctgtagycctagctacttgggaggctggggcaggaggactgcttcagcccaagaatttgaggtttcagggagctgtgattgcaccactgcactctagcctgggtgacagtgtgagaccctgtccctctctcaccaaaaaaggggtttggcttggacaatagatcatattgtcaccctattaataactaacttactgagtgcttcatatgagccaaacactgcatcagttgtccacagcctatgctatactgccttaccaaagagaggaaggtgtcaactgtatccttggggtaaacaaaagtggcaa

SEQ ID NO: 62550 - DNA, 601 bp, Human
gcactttggaaggctgaggcaagctgatcacttgaggtcaagggttcgaggccagtctggccaacatggtgaaaccctgtatctacttaaaaaaaaaaaaaaattagctgggcctggtggcgggtgcctgtaatcccagctactcaggaggctgaggcatgagaatcgctggaacgcgaatgcgggaggtagaggatgcagtgtgacaagatcgcaccactgcactccagcctgggtgacagagcgagactctgtctcaaaaattaataaaaataaataaatgaataaataaataaataatcttaacagagttaaacagagcaaaggacaccttaaaaattgggcagtccctggaaccagaataggttcagagagactcaggaactgccatatagtctgataatatttatggacagaaaaaggaaaatgacctacagaaaacagatgtgaggtacagaaatagctgggttggttacagttcacatttgccttatttgaacaaggtttgaacagcctgtgattggctgaaactctgtgattggtacaagggtaggttacaggctgtttatacctctagtaaggttagagttcattatgtatg

SEQ ID NO: 62551 - DNA, 601 bp, Human
cagaaaaataaaatgaggtcagaattgaggttaggcacattaaaacatgtttcctgtaactccgtgtcattgtcacagttgggccatacacttagttctgggttttgcagtgagctaagcagcgttaaaagaaaaactttggacaaattaaatttaacagagtttggctaggcacgttggttcactcctgtaatcccagcactttggaaggctgaggcaagctgatcacttgaggtcaagggttcgaggccagtctggccaacatggtgaaaccctgtatctacttaaaaaaaaaaaaaaattagctgggcctggtggcgggtgcctgtaatcccagctactcaggaggctgaggcatgagaatcgctggaacgcgaatgcgggaggtagaggatgcagtgtgacaagatcgcaccactgcactccagcctgggtgacagagcgagactctgtctcaaaaattaataaaaataaataaatgaataaataaataaataaacttaacagagttaaacagagcaaaggacaccttaaaaattgggcagtccctggaaccagaataggttcagagagactcaggaactgccatatagtctgataa

SEQ ID NO: 62552 - DNA, 601 bp, Human
aatttttttttttgagacggagtctcgctctgttgcccaggctggagtgcagtggcacaatctcggcccactgcaagctccgcctcccaggtccatgccattctcctgcctcagcctcccgagtagagtagctgggactacaggcgcccgccaccacgcctggctaattttttgtatttttagtagagacggggtttcactgtattagccaggatggtctcgatctcctgaccttgtgatccgcctgcctcagcctcccaaagtgctgggattacaggtgtgagccaccacgcctggtccyatacttattaaaaattaaaaagaatcctaccagcatattaagaatgctataaatcaagaacgtttatattagctaattatggtaaagaacaactgtgcaagaaacatcaggactggagagctcttttgggcctttcaggctgtttctaacattctaactcctgaccatcgaaatggctgcttcacaatatccaattaatcaagaaataccattcgttccatgaacttaacccattacagtagaactgagagcatggcctgccttaacaccaaaatctgcctgcatttcaaattcctatga

SEQ ID NO: 62553 - DNA, 601 bp, Human
gtgtgctatacatagaaaagtaaatgttctttttaaaaaaactagtttgattgttagtcaactggaattaataagtgtattaattgaaatgaagttatatgcttattctcttagaaaatacttgctttttaaaacataacaaatttgaaaaaaaaacttaaataccatacaaactgattttcttttaaagttgtatctaaagttattttttaaaaataaacaacgtttcaaaattaaaactgaaatttaaaaatgtttcctggtcaagattttcttctgtaaatattgctttgccaatcgyggccatgataaccaatattgaactacagtgttccctggtatacatgggggaactggttccgggacctcctaaggataccaagatctgtagatgtgcaagtccctgctgtgaaatgatacggtatttgcatataacctatgcacatcctcctgtatatttgaaatcacctcgtgtgtaaatagttgttatagtgtatgttttagaaaataatgacaagaaaaaaagtctgtacatgttcagtaccgacacaaccatccatttttcttccccaaatatatatacatataaatacgtatttat

SEQ ID NO: 62554 - DNA, 601 bp, Human
taagtacaatcctagtagaatagtgcagaggacagaatcattaactcatcaaatcacaaataaaaaatacacatattgtgtgtgctatacatagaaaagtaaatgttctttttaaaaaaactagtttgattgttagtcaactggaattaataagtgtattaattgaaatgaagttatatgcttattctcttagaaaatacttgctttttaaaacataacaaatttgaaaaaaaaacttaaataccatacaaactgattttcttttaaagttgtatctaaagttattttttaaaaataaacmacgtttcaaaattaaaactgaaatttaaaaatgtttcctggtcaagattttcttctgtaaatattgctttgccaatcgcggccatgataaccaatattgaactacagtgttccctggtatacatgggggaactggttccgggacctcctaaggataccaagatctgtagatgtgcaagtccctgctgtgaaatgatacggtatttgcatataacctatgcacatcctcctgtatatttgaaatcacctcgtgtgtaaatagttgttatagtgtatgttttagaaaataatgacaagaaaa

SEQ ID NO: 62555 - DNA, 601 bp, Human
gctgcagcacaaacctttttagattcacaaagacgagacaccatattttttggcagtggcttgataaaacaaaagaatatatatgtgagtaaactgcgtaataagtcactgcactatgtataagccaggaaatttaaaaataacatcaaatgtaacatgagtaatagaatttcattatagtttaaaaataataactttaaatattttagttggcaagacaacatgaataaagacattctgtttaatttcaaaaagtggtaattgtcaaataagggtttgtacatgaaaatacaggattacrtggaactaagacactggcgccgatctttaaaaatctatttaaaacctcaaagggaatactttttctgttcctttgctattagtgagtgcctgttcaaatactctcttgacttttaagtgcatataatcactgacaataggactaaaagatgaaaatgtcaagaaataaatggtaattcacagtgtccgccagtgttaaagctaaactgacatcctaacaaatagtcataataatgtattgcagattattttcttttcgaatctgaaagaactgtagagcttggacacttagtttaatgtc

SEQ ID NO: 62556 - DNA, 601 bp, Human; identical to SEQ ID NO: 33670

SEQ ID NO: 62557 - DNA, 601 bp, Human; identical to SEQ ID NO: 33671

SEQ ID NO: 62558 - DNA, 601 bp, Human; identical to SEQ ID NO: 33672

SEQ ID NO: 62559 - DNA, 601 bp, Human; identical to SEQ ID NO: 33673

SEQ ID NO: 62560 - DNA, 601 bp, Human; identical to SEQ ID NO: 33674

SEQ ID NO: 62561 - DNA, 601 bp, Human; identical to SEQ ID NO: 33675

SEQ ID NO: 62562 - DNA, 601 bp, Human; identical to SEQ ID NO: 33676

SEQ ID NO: 62563 - DNA, 601 bp, Human
tcacaaagaagaatataagatgagaacaaaaacatacaagcccaaaagcaggtgaatcaggcaatgctctgtgaactggaaaatgctagtaaaatctaggcaattgttattatttattccatgaataaatagttagattattcttatcactataaattttcactaacacagataatcaagagcttggcagtagaaagtattagaatagtaaattacatgtaagattaaaaaattagttagtatgactgacattatatacctgtagcagataattaaggttctaagccaatcgaaaactaaygacaagaggtattatgaagataaaatatcctgttgcttcacttgtctggtaaatacgatctcttcccatgcatatttgagcattaggacctgaagatttagtggacaattgtagtttattgattaacttaatctcttagcacaacatattctgctatccaatcttagagcaaataaaaccacttgacatttattctgctttttatagtttacaaaacactttcaagttagctctccttctgttagaccaactaggctagaaggacatcgacctgaacctaccggtagttatcaaaccatt

SEQ ID NO: 62564 - DNA, 601 bp, Human
tgtaatcctcagccttgggaggccaagacaggtggattatctgaggttgggagttcgagaccagcctggccaacatggtgaaaccccgtctctactaaaaaaacaaaagttagccaggagtggtggcgcacacctgtaatcccagctactcaggaggctgaggaaggagaattgcttgaacccaggaggcagaggttgcagtgagccaatactgcgccactgcactccagactaggagtcaaagcaagactccatctcaaaacaacaacaacaacaacaacaacaaaaacactatcaaaamgaaaaaattcttttgtattatcttctaaaatttaaagctttacttttcacatctcggtctttaactctattttttgtgtgcagtgtgatacagggctgcatttttttttccatatagagatcaatcactacaacaccactttaaaaaattgttccttcttcatccaataatctacagtgtcactcaacctatatttgagagtctattaatttgctgagtctgccgttgggctcttgctcctgtttcactgatatctgtgcatccctacaccagtgttagactgtcttaattcctacagct

SEQ ID NO: 62565 - DNA, 601 bp, Human
acatgagatattcaacactttattatgaaatagactttgtgttagatgagtttgcccaactgtaggctaacataagcattctgagcacatttaaggtaggctaggctaagctatgacattcagcagtgtaggggtattaaatgtatttttgacttatgatagtttcaacttacaatgggttattgggacttgaccgcatcgtaagttgagaagcatctgtataaaatataagatactcagagtgggtataaaaaacactatcatggccaggcgcggtggctcatgcctgtaatcctcagcyttgggaggccaagacaggtggattatctgaggttgggagttcgagaccagcctggccaacatggtgaaaccccgtctctactaaaaaaacaaaagttagccaggagtggtggcgcacacctgtaatcccagctactcaggaggctgaggaaggagaattgcttgaacccaggaggcagaggttgcagtgagccaatactgcgccactgcactccagactaggagtcaaagcaagactccatctcaaaacaacaacaacaacaacaacaacaaaaacactatcaaaaagaaaaaattcttt

SEQ ID NO: 62566 - DNA, 601 bp, Human
tccacagtggtgtgaaagcaatatgcattcaatagaaactgtactttgggtgcctgacaaccattttgtttttcactttcagtgcagtattcaataaattacatgagatattcaacactttattatgaaatagactttgtgttagatgagtttgcccaactgtaggctaacataagcattctgagcacatttaaggtaggctaggctaagctatgacattcagcagtgtaggggtattaaatgtatttttgacttatgatagtttcaacttacaatgggttattgggacttgaccgcatcrtaagttgagaagcatctgtataaaatataagatactcagagtgggtataaaaaacactatcatggccaggcgcggtggctcatgcctgtaatcctcagccttgggaggccaagacaggtggattatctgaggttgggagttcgagaccagcctggccaacatggtgaaaccccgtctctactaaaaaaacaaaagttagccaggagtggtggcgcacacctgtaatcccagctactcaggaggctgaggaaggagaattgcttgaacccaggaggcagaggttgcagtgagccaatactg

SEQ ID NO: 62567 - DNA, 601 bp, Human
cagcagaaggtgagcctgttggtatatgttgtactattgccctctattcacaaatgagtagaaaattttggatttccagcatcaaactactgttagatggaatagcaagtaagtacaaattagcctatattttatacagagtgactcagcatgcacacaaatatcaataaattgccgacactagaaggctatttattgacttgtaaagaaagcatcattatttaatatggaatatctgtggagctgcccctattaaatagttacagtcatgtaaatgcaattttccaaagtatgacctacrtaaagctagtgcctagaaattatccatgaagacttccagggttaatacatttgaggatagagactcataatgtttgttagcatattacagactccaagcggttcctcagtagagaagccagctcaatgttgtttaaaccagtattgctcaaagataactagtgcgacactttattcccaagatgagttattaatgcacttaaagaattgctaatatagacatatgcaaaatcactgtctaaaagtttgtaccagattatgtacctaaatttgtatcaactccataagcattataaagact

SEQ ID NO: 62568 - DNA, 601 bp, Human
taattttttgtatttttagtagagatggggtttcaccgtgttagccaggatggcctggatctcctgacctcatggtccgcccgcctcggcctcccaaagtgctgggattacaggcatgagccactgcgcccggcctaggataatttttaactaatgctaacacggtgtcactataatatgccagtttgttgctggatgcaaaaataaaaccctaaacgtggagtgaatcctattcacaagaaacatgtcttcttttcatattctttgttggtgtttgttctaacgagaaggaccaaatatyaacatatccttcagtcccagtaactgctttcctaaaataactttttcattctagctttgaacaacttttatgccatcaagatggtgaattttaaattgtgagttgtgaagaaagacaattttcttagacgtattattatattttcatgtaaatacttagagtgctcagaactttcttattctgttttcaatttgaggtcactaaagggcaaaaaggagtctcactggtggcaagatttattcagagaacactgtcactctgagaacagctgtgctggagacacagcctcaccacccaaac

SEQ ID NO: 62569 - DNA, 601 bp, Human
ttttttttttttttttttttgacagagtcttgctctgtcgcccaagctggggtgcagtggtgtgatttcggctcactgcaactgccacctcccaggttcaaacgattctcctgcctcagcctccccagtagctgagactacaggcatgtaccaccacgcgcagctgattttttttttttgtattttagtagagacagggtttcaccatgttgcccaggctggtttcgaactcctaagctcaggcaatccgcccacctcggcctcccaaagtgctaggattacaggcatgagccaccacacycaggcaaattagagtaatttttttgtttttgtttttgttttgggacggagtctcactctgtcgcccaggctggagtgcagtggtgcgatgtgggctcactgcaagctccgccttctgggtcacgccattcttctgcctcagcctcccaagtagctggggctacatgcgcccgccaccacgcctggctaattttttgtatttttagtagagatggggtttcaccgtgttagccaggatggcctggatctcctgacctcatggtccgcccgcctcggcctcccaaagtgctgggattacagg

SEQ ID NO: 62570 - DNA, 601 bp, Human
ctcttttccgtataaattacccagtctcaggtatttatttgtagcaatgtgagaatggattaatacatataatacatccctcatcccctctctagggtaaattagaataatttttttggtttttttttttttttttttttttgacagagtcttgctctgtcgcccaagctggggtgcagtggtgtgatttcggctcactgcaactgccacctcccaggttcaaacgattctcctgcctcagcctccccagtagctgagactacaggcatgtaccaccacgcgcagctgattttttttttttgtattttagtagagacagggtttcaccatgttgcccaggctggtttcgaactcctaagctcaggcaatccgcccacctcggcctcccaaagtgctaggattacaggcatgagccaccacacccaggcaaattagagtaatttttttgtttttgtttttgttttgggacggagtctcactctgtcgcccaggctggagtgcagtggtgcgatgtgggctcactgcaagctccgccttctgggtcacgccattcttctgcctcagcctcccaagtagctggggctacatgcgcccgccacca

SEQ ID NO: 62571 - DNA, 601 bp, Human
aaaaccacgagccaattaaacctcttttccgtataaattacccagtctcaggtatttatttgtagcaatgtgagaatggattaatacatataatacatccctcatcccctctctagggtaaattagaataatttttttggtttttttttttttttttttttttgacagagtcttgctctgtcgcccaagctggggtgcagtggtgtgatttcggctcactgcaactgccacctcccaggttcaaacgattctcctgcctcagcctccccagtagctgagactacaggcatgtaccaccacrcgcagctgattttttttttttgtattttagtagagacagggtttcaccatgttgcccaggctggtttcgaactcctaagctcaggcaatccgcccacctcggcctcccaaagtgctaggattacaggcatgagccaccacacccaggcaaattagagtaatttttttgtttttgtttttgttttgggacggagtctcactctgtcgcccaggctggagtgcagtggtgcgatgtgggctcactgcaagctccgccttctgggtcacgccattcttctgcctcagcctcccaagtagctgg

SEQ ID NO: 62572 - DNA, 601 bp, Human
agatataatgatgaattggttagcaaatacacatctaaaaggctatttcgaatacaggctccatgagagcaaggattctggtctactttatttactgttacatccattgcttagaccatgtggtagcacgtagtaggcacttaataaaaagataacacatacatatacattatatcaattattaaaaatttgtagttatcacaatataaatacaaaaagcaaattattgtacaactattttaattgggatttgaaatagttttctttatgctaaaaaacaaaagtgtgtttgctctttggrgtgtctgactaaattcagcacaatttttggcagtttttttctaaaaacagtttgttacacatagaaaattatacttaatatgaaatatatatcacttctacataattagacttaatagaaattagtctgaatagaaaccagtctccagtagcagcaacctttctcaactaatacaccttgagtatactgcagcaaatcaggtatatctgattatgtccccaataagtctgcagcacacacctactcaaaaagatggacaggtaaccaatgtttatagattatataaatcccccgatatag

SEQ ID NO: 62573 - DNA, 601 bp, Human
accaaaaatacaaaaattatcagggcggtggtgcatgcctgtaatcccagctactggggaggctgaggcatgagaattgcttgaaccggggaggcagaggttgcagtaagctggcatcgttccactgcactacagctttggcaacagagcgagactccgtctcaaaaaaaaaccaaacaaacaaaaattgactatcaagggaatgagagaacaggaaagaaaagaaactctagtagtaataatatattaaagcattaacaccaaaattgtgcataacaatgccattttctcatggtaggtgttaaatttttcttctttttgggactactaaaaaaaaaaaacaaaaaaactccacgtagtaaatgtaacagtactctcaaaatctctctgcactcttccattatattgatttcatctccctattctcatctttccacatggttaagaggcatgtttgaaagttaatccggatgagcacactatgtaaacaacagggttcaccactagctgcactccatctccaagctggtacagtggttactttcctttgcatacataatcatggtaacagcagtgtcagcttaagaatcttctctagaaa

SEQ ID NO: 62574 - DNA, 601 bp, Human
ctccctcatgtgctcactgtcctctgccttgttaaatcccacagtcagttgtcacagttgctctgaataaccctcaggtccatggcctgctcttggactatactctacattcacttggcaaaaccacagccctggtgaaagctaggcaccgagtatggccaggaaaagcacacaaccatccccacagctctcttttcaaaccagtggcactaaccccacttgggcccttaacgtggcctgcaatcataactcacatctccactctgccatctctcccactctcctttatacctgctcctcwctcctcaaatgccagcagcactgccccatttgcatgctcagctggtgccctgcttccgattgactgagcaaagccccggaagaggacttccacaacaccatctacccactgcttgcatctttgttcacacaccctaaagacggttaggctgtgctctcgggctctacgggctaacccctccacccgtacaaaaatcccttccccttgtctattctcccctgcatcactggcttttcagtcttaatagatctttcccattcacttacacatattattcacctcgttaaaaatccaaatgaa

SEQ ID NO: 62575 - DNA, 601 bp, Human
cctgtcttttcagctaactctctagtaccctatctccaatcccactgggacctcacaatccacttccaaatgttcaccaggccagagctccctcatgtgctcactgtcctctgccttgttaaatcccacagtcagttgtcacagttgctctgaataaccctcaggtccatggcctgctcttggactatactctacattcacttggcaaaaccacagccctggtgaaagctaggcaccgagtatggccaggaaaagcacacaaccatccccacagctctcttttcaaaccagtggcactaaycccacttgggcccttaacgtggcctgcaatcataactcacatctccactctgccatctctcccactctcctttatacctgctcctctctcctcaaatgccagcagcactgccccatttgcatgctcagctggtgccctgcttccgattgactgagcaaagccccggaagaggacttccacaacaccatctacccactgcttgcatctttgttcacacaccctaaagacggttaggctgtgctctcgggctctacgggctaacccctccacccgtacaaaaatcccttccccttgtctatt

SEQ ID NO: 62576 - DNA, 601 bp, Human
gggactggatgctcttaggggcctctggaagaagtcagccctgctgacatcttcattcagcccattaacactcactgtggtcttctccagaattctaagaaaacacatttttgctatattaagccaccaagtttgtggtaatttgttacagcaacaataggcaactaatactctggcctctcgactccttgaccttctcttctttagtgatgatgttcttggccctaactcagcctctcactccatggttacaatctaggccttgccattactgtaactggaaccccttcataatatccaytccaagcattcctttgctcaacaatcacaccctgtcttttcagctaactctctagtaccctatctccaatcccactgggacctcacaatccacttccaaatgttcaccaggccagagctccctcatgtgctcactgtcctctgccttgttaaatcccacagtcagttgtcacagttgctctgaataaccctcaggtccatggcctgctcttggactatactctacattcacttggcaaaaccacagccctggtgaaagctaggcaccgagtatggccaggaaaagcacacaaccatcccc

SEQ ID NO: 62577 - DNA, 601 bp, Human
ctgttttacttcactctcaccaatcctactcctgttagaattctgatgacagcaatgcccccaaagctaatctttcaaatgttctgtgtggcagaaagaataatgccctctcctccaaagatgtccacatcctatccctagaacctgtgaatgtcaccttatttgggaaaaaaatggactttgcagatgtgattaagctaaagatcctgaggtgagaaggttatcctgaattatctgagtacgccctagtcagaaccacaagggtccttataaaagaaaagcaagaagtagaaggagggggaggcaatgtgatgagggaagcagagaatgcagcctgtggcccggagccagggcacaccatctgcctcatggagtggggagaggcagggactggatgctcttaggggcctctggaagaagtcagccctgctgacatcttcattcagcccattaacactcactgtggtcttctccagaattctaagaaaacacatttttgctatattaagccaccaagtttgtggtaatttgttacagcaacaataggcaactaatactctggcctctcgactccttgaccttctcttctttagtgatgatg

SEQ ID NO: 62578 - DNA, 601 bp, Human
ctagcagaagcgtccgtccttctcactcactccttgaagatttcttacttctgttttacttcactctcaccaatcctactcctgttagaattctgatgacagcaatgcccccaaagctaatctttcaaatgttctgtgtggcagaaagaataatgccctctcctccaaagatgtccacatcctatccctagaacctgtgaatgtcaccttatttgggaaaaaaatggactttgcagatgtgattaagctaaagatcctgaggtgagaaggttatcctgaattatctgagtacgccctagtmagaaccacaagggtccttataaaagaaaagcaagaagtagaaggagggggaggcaatgtgatgagggaagcagagaatgcagcctgtggcccggagccagggcacaccatctgcctcatggagtggggagaggcagggactggatgctcttaggggcctctggaagaagtcagccctgctgacatcttcattcagcccattaacactcactgtggtcttctccagaattctaagaaaacacatttttgctatattaagccaccaagtttgtggtaatttgttacagcaacaataggcaac

SEQ ID NO: 62579 - DNA, 601 bp, Human
aaggcaagtaggtgttggctctggttttcactgccagttccttctccttcagaacactccaactctgattttgctgacagtggaccataatcctctttacccttcactactgcagtcactagcagaagcgtccgtccttctcactcactccttgaagatttcttacttctgttttacttcactctcaccaatcctactcctgttagaattctgatgacagcaatgcccccaaagctaatctttcaaatgttctgtgtggcagaaagaataatgccctctcctccaaagatgtccacatccyatccctagaacctgtgaatgtcaccttatttgggaaaaaaatggactttgcagatgtgattaagctaaagatcctgaggtgagaaggttatcctgaattatctgagtacgccctagtcagaaccacaagggtccttataaaagaaaagcaagaagtagaaggagggggaggcaatgtgatgagggaagcagagaatgcagcctgtggcccggagccagggcacaccatctgcctcatggagtggggagaggcagggactggatgctcttaggggcctctggaagaagtcagccctgctga

SEQ ID NO: 62580 - DNA, 601 bp, Human
cggctggtttctcgccaaatcctgcatatgactgggtctgaaggcaagtaggtgttggctctggttttcactgccagttccttctccttcagaacactccaactctgattttgctgacagtggaccataatcctctttacccttcactactgcagtcactagcagaagcgtccgtccttctcactcactccttgaagatttcttacttctgttttacttcactctcaccaatcctactcctgttagaattctgatgacagcaatgcccccaaagctaatctttcaaatgttctgtgtggcrgaaagaataatgccctctcctccaaagatgtccacatcctatccctagaacctgtgaatgtcaccttatttgggaaaaaaatggactttgcagatgtgattaagctaaagatcctgaggtgagaaggttatcctgaattatctgagtacgccctagtcagaaccacaagggtccttataaaagaaaagcaagaagtagaaggagggggaggcaatgtgatgagggaagcagagaatgcagcctgtggcccggagccagggcacaccatctgcctcatggagtggggagaggcagggactg

SEQ ID NO: 62581 - DNA, 601 bp, Human
ttaatccacgtgtgtgatcaatatttgctaatgtttcaaagttttcttcagtctattttaaaaagacaaaatcacactatgtatactttcctatcagtttttccctaaacttatttatgaattctttctaaacatgaatgactgcatattatttcatatgggccatattaggctatgctatgttacaatgtgatcacatgaaccctaaaatctctgtgtttgctccttgagcatacaacatgtcatcacaggtcagtgggcccgtctcgcactatcagtatttaggaacccatgttctcargacctccaccaactggaatgtcattgactgctgaaccaagggcaggagatgtggacaactgtatagtagctctcgaaggccacagcctaggaatgatacacatcacttctgctcacatttctttggtcatattaagtcacaaggccacaaataactgcaaggggcatgaaagtgcaattctaccatggggcagagataggagagctggattactagtgagcaggcctagtgacaaccacatgatgcgcactagtttatctagccattccttgaatgctggattctttccaatgtttttgt

SEQ ID NO: 62582 - DNA, 601 bp, Human
gagcgtggcctctttaatggttcacagagaactgaatggccataccactgggagtcagctggaggagggtgggtgtgcatatgtttgtgtgtttcctcttctgattttagaaggaatacatgctcattagagaaaaaatggaatactgtgaaaaatataaaaaaggaaactcccacccttaatccacgtgtgtgatcaatatttgctaatgtttcaaagttttcttcagtctattttaaaaagacaaaatcacactatgtatactttcctatcagtttttccctaaacttatttatgaatyctttctaaacatgaatgactgcatattatttcatatgggccatattaggctatgctatgttacaatgtgatcacatgaaccctaaaatctctgtgtttgctccttgagcatacaacatgtcatcacaggtcagtgggcccgtctcgcactatcagtatttaggaacccatgttctcaagacctccaccaactggaatgtcattgactgctgaaccaagggcaggagatgtggacaactgtatagtagctctcgaaggccacagcctaggaatgatacacatcacttctgctcacatttct

SEQ ID NO: 62583 - DNA, 601 bp, Human
cttttccgaggcaagtgagtttgcattctctatctccaagatcatttaaaggagagggaaagaatttaggctctagggaaatggatgttatatctagaactaaagccatgatgacaggaaatttctactctgagcccaagttaagtttagtcctgatcctccacctcagctgcactctccaggtaaaaaagggtccctatgattactatcatttccatgagcgtggcctctttaatggttcacagagaactgaatggccataccactgggagtcagctggaggagggtgggtgtgcatatrtttgtgtgtttcctcttctgattttagaaggaatacatgctcattagagaaaaaatggaatactgtgaaaaatataaaaaaggaaactcccacccttaatccacgtgtgtgatcaatatttgctaatgtttcaaagttttcttcagtctattttaaaaagacaaaatcacactatgtatactttcctatcagtttttccctaaacttatttatgaattctttctaaacatgaatgactgcatattatttcatatgggccatattaggctatgctatgttacaatgtgatcacatgaaccc

SEQ ID NO: 62584 - DNA, 601 bp, Human
tttctctcgtgtcccctaccacggcacttccagggagtgctctgcagtgaatgattgctcagcattgcgaaaagtctagttaccacctccaagaatatctcttttaggatgcagcttttccgaggcaagtgagtttgcattctctatctccaagatcatttaaaggagagggaaagaatttaggctctagggaaatggatgttatatctagaactaaagccatgatgacaggaaatttctactctgagcccaagttaagtttagtcctgatcctccacctcagctgcactctccaggtaamaaagggtccctatgattactatcatttccatgagcgtggcctctttaatggttcacagagaactgaatggccataccactgggagtcagctggaggagggtgggtgtgcatatgtttgtgtgtttcctcttctgattttagaaggaatacatgctcattagagaaaaaatggaatactgtgaaaaatataaaaaaggaaactcccacccttaatccacgtgtgtgatcaatatttgctaatgtttcaaagttttcttcagtctattttaaaaagacaaaatcacactatgtatactttcc

SEQ ID NO: 62585 - DNA, 601 bp, Human
gcacagcaggagtgcacatgcttctcctgtctcttcttctaaggcactaatcccttcatgagggctctatcttcatatcctaaagatctcccaaaggtcccacctcctcacaccatcctattcattttcatttattgatttatgtgtgttttatccaggcaaataacacactttctctttctctcgtgtcccctaccacggcacttccagggagtgctctgcagtgaatgattgctcagcattgcgaaaagtctagttaccacctccaagaatatctcttttaggatgcagcttttccgasgcaagtgagtttgcattctctatctccaagatcatttaaaggagagggaaagaatttaggctctagggaaatggatgttatatctagaactaaagccatgatgacaggaaatttctactctgagcccaagttaagtttagtcctgatcctccacctcagctgcactctccaggtaaaaaagggtccctatgattactatcatttccatgagcgtggcctctttaatggttcacagagaactgaatggccataccactgggagtcagctggaggagggtgggtgtgcatatgtttgtgtgt

SEQ ID NO: 62586 - DNA, 601 bp, Human
gagatggcagtttgcttgctgcatcctcacatggtagggtggggggagagagagcaagagcaagagacggggagagggagagagagagagagagagagaagacagagagagagagagcacagcaggagtgcacatgcttctcctgtctcttcttctaaggcactaatcccttcatgagggctctatcttcatatcctaaagatctcccaaaggtcccacctcctcacaccatcctattcattttcatttattgatttatgtgtgttttatccaggcaaataacacactttctctttctctygtgtcccctaccacggcacttccagggagtgctctgcagtgaatgattgctcagcattgcgaaaagtctagttaccacctccaagaatatctcttttaggatgcagcttttccgaggcaagtgagtttgcattctctatctccaagatcatttaaaggagagggaaagaatttaggctctagggaaatggatgttatatctagaactaaagccatgatgacaggaaatttctactctgagcccaagttaagtttagtcctgatcctccacctcagctgcactctccaggtaaaaaagggt

SEQ ID NO: 62587 - DNA, 601 bp, Human
gtgtctgacacacagtggtaaaggtcttaggaaaatgtctgatgaacaaaaatgtacaaagtttaaactacacatcttagtttgggctgctataacaaaataccatagactgggtggcttaaacaatagaagttatttctcatagttctggaggctgggaagtgcaagaatccaggcaccagcagatccagtgtctgatgacggcctgcttccagtgtggagatggcagtttgcttgctgcatcctcacatggtagggtggggggagagagagcaagagcaagagacggggagagggagagagagagagagagagagaagacagagagagagagagcacagcaggagtgcacatgcttctcctgtctcttcttctaaggcactaatcccttcatgagggctctatcttcatatcctaaagatctcccaaaggtcccacctcctcacaccatcctattcattttcatttattgatttatgtgtgttttatccaggcaaataacacactttctctttctctcgtgtcccctaccacggcacttccagggagtgctctgcagtgaatgattgctcagcattgcgaaaagtctagttaccacctc

SEQ ID NO: 62588 - DNA, 601 bp, Human
ttgtgtctgacacacagtggtaaaggtcttaggaaaatgtctgatgaacaaaaatgtacaaagtttaaactacacatcttagtttgggctgctataacaaaataccatagactgggtggcttaaacaatagaagttatttctcatagttctggaggctgggaagtgcaagaatccaggcaccagcagatccagtgtctgatgacggcctgcttccagtgtggagatggcagtttgcttgctgcatcctcacatggtagggtggggggagagagagcaagagcaagagacggggagagggagagagagagagagagagagaagacagagagagagagagcacagcaggagtgcacatgcttctcctgtctcttcttctaaggcactaatcccttcatgagggctctatcttcatatcctaaagatctcccaaaggtcccacctcctcacaccatcctattcattttcatttattgatttatgtgtgttttatccaggcaaataacacactttctctttctctcgtgtcccctaccacggcacttccagggagtgctctgcagtgaatgattgctcagcattgcgaaaagtctagttaccacc

SEQ ID NO: 62589 - DNA, 601 bp, Human
gggaacatcaactttgcttaccttttggcccagcagtacactgttacggacttattttaaggctaaagtagtcaagtgcacagagttatgcagaccttctataataacgaaaaaggagtacacaatcttgaacacaaggagggtctggggcaagatttcagagcaagcagagtgaatgtgaatactaacttcaactaggagcagaagtcacacatgggagacaaaccaggggtgatgggaacgccacagcttgacacgcaggtaagtggcaagcagattgctcagtgcaaagtatccacaygttgtgtctgacacacagtggtaaaggtcttaggaaaatgtctgatgaacaaaaatgtacaaagtttaaactacacatcttagtttgggctgctataacaaaataccatagactgggtggcttaaacaatagaagttatttctcatagttctggaggctgggaagtgcaagaatccaggcaccagcagatccagtgtctgatgacggcctgcttccagtgtggagatggcagtttgcttgctgcatcctcacatggtagggtggggggagagagagcaagagcaagagacggggagaggg

SEQ ID NO: 62590 - DNA, 601 bp, Human
aaaagaaagatcaacataaacatgggaaaataataaaaataggcatttcactccccatatagttggtaaaaagaaaaaaaaataaagagtgactttactagtaatacatgaattgcaagcacaactaagttagcatttgtggagcatcagattggcaaaaattaaaatcagcagtgagggttgtcaaaagaaaactacctaatctattgcacaactttgcaacgtgtctgggaacatcaactttgcttaccttttggcccagcagtacactgttacggacttattttaaggctaaagtagtcaagtgcacagagttatgcagaccttctataataacgaaaaaggagtacacaatcttgaacacaaggagggtctggggcaagatttcagagcaagcagagtgaatgtgaatactaacttcaactaggagcagaagtcacacatgggagacaaaccaggggtgatgggaacgccacagcttgacacgcaggtaagtggcaagcagattgctcagtgcaaagtatccacatgttgtgtctgacacacagtggtaaaggtcttaggaaaatgtctgatgaacaaaaatgtacaaagtttaaac

SEQ ID NO: 62591 - DNA, 601 bp, Human
aacacacagattcccatcaattttggtctatttgtttttcttgctttgacacatcctatgtgcaactgattttatttacacataccatttttatcatgtcaattacccgtttttttcaattcccctttcaagctctacattattttattatactgacataataataataataataataatacatgacatctgcttagtgtttactgggtgccaggcactgggctaagtgctttgatcatacattatttcagtcatagtcctgtgatttagatatcaccatcttactgatgaagatctcacrcctagctcacctgattctacaacaccacactctacagtatgcctgaattatccatcatatctgattaatctcactctcctcagaggagccacctctactcatgttgtaactcctccacacagagcttcagctttgtacaacctgtttccacacataactttctcaatcctttcttgttaatttgaatatgcccactctttatcctggaatgttctcttctctcaagtacacacactagcactctttcaaaccataggtcaaaccagaaacatgccaaataaggatgtttgccttttctat

SEQ ID NO: 62592 - DNA, 601 bp, Human
gagtgtctgagtttttctaaatgttctgagaaagtctggttcacttttcactctccataaatcagcaagtatttcaaagcttccccaagacacaaaaaaacatacacatgtgaaaagaatgattgcatcatcactaagttaggaatttgaagataatgtatgttaaagaaagcaaataactgctttcttttataattattaaatatatacattacaaatcatgatgtgtgcaagacaccaagataaactattctagcacattaataatcacatatggtcatggaaggctgttgggggcacraatcaccataaccatgctcaagcaactagctgtgcattatcatggggacccctggtggcctggccaatggctagccttggggagcagagactccctcaaaactcactaatgaaagaatgctgaacacacagattcccatcaattttggtctatttgtttttcttgctttgacacatcctatgtgcaactgattttatttacacataccatttttatcatgtcaattacccgtttttttcaattcccctttcaagctctacattattttattatactgacataataataataataataata

SEQ ID NO: 62593 - DNA, 601 bp, Human
ggttagaaaaagtggttatgaaataaatgtaaactatcatttgatttatagacatctattgcttccatttaaaggacttagcagtatgaaaggattgtttagacgtactttggcttaagtgggaaaaagttatggctgcaattgtataaatcatttcaaatactgtttgattttagcttttgagtgtctgagtttttctaaatgttctgagaaagtctggttcacttttcactctccataaatcagcaagtatttcaaagcttccccaagacacaaaaaaacatacacatgtgaaaagaaygattgcatcatcactaagttaggaatttgaagataatgtatgttaaagaaagcaaataactgctttcttttataattattaaatatatacattacaaatcatgatgtgtgcaagacaccaagataaactattctagcacattaataatcacatatggtcatggaaggctgttgggggcacgaatcaccataaccatgctcaagcaactagctgtgcattatcatggggacccctggtggcctggccaatggctagccttggggagcagagactccctcaaaactcactaatgaaagaatg

SEQ ID NO: 62594 - DNA, 601 bp, Human
aaaagttgtggttttagtgttctaaataatttagttctaaaacatctctatcggaaaaaggttttatggttgacttgggaaagaaagtagaataagcaaaatcactgggcaggataagttaacatggagatttttcaaactgtgcaccattatctactaatggtttgtaaaatctgtacagtagcttgtgacctgcattaaaaaaaaaaaagaagaaaatgggacagaaaatatatagtgcacagcacagagggtaactttagatttgtggtacttttgtttcagtttcactcccacatayatgtacatatacacctaaatgtacatacatgtatctgtacaatagatcataatgtaaaatgcatttcttactgcaggtttgctcaaaatgcttaaacgccagtgagtaaacagttcaaggacagattaaaaaatcagtgctactaaagtaaaaagagaagtcaaggatataaaggcaggtgaaaatgcttaagatgggtgatctcgtggcttattctgactttacccatggggcaagtggaccataaacacagcaatggctgctgtggctctcaactctgagcactttaaagtatttgtg

SEQ ID NO: 62595 - DNA, 601 bp, Human
atccatcctgaaagatgtcattcaaatgaattaacacacatgaggagaagtggtggtgggattaaataaaagttgtggttttagtgttctaaataatttagttctaaaacatctctatcggaaaaaggttttatggttgacttgggaaagaaagtagaataagcaaaatcactgggcaggataagttaacatggagatttttcaaactgtgcaccattatctactaatggtttgtaaaatctgtacagtagcttgtgacctgcattaaaaaaaaaaaagaagaaaatgggacagaaaatayatagtgcacagcacagagggtaactttagatttgtggtacttttgtttcagtttcactcccacatatatgtacatatacacctaaatgtacatacatgtatctgtacaatagatcataatgtaaaatgcatttcttactgcaggtttgctcaaaatgcttaaacgccagtgagtaaacagttcaaggacagattaaaaaatcagtgctactaaagtaaaaagagaagtcaaggatataaaggcaggtgaaaatgcttaagatgggtgatctcgtggcttattctgactttacccatgggg

SEQ ID NO: 62596 - DNA, 601 bp, Human
ttttttttggtaaatgtgttgctgagagaagaataaaatgttatcaaaatgatgtagatcattccagcagattaaaaaacagatgtttttaagtatatggtcatattcactgtatttttctatttgttttcatctatttcttggatagattgttttctccctgccttcaatctctgtaccccccatctatcacccatactgaaaccttaactttttgcctgcagcttatatctgctcatgtcgcttctctgcttacaaacttcaaacctctaaggcctccctattccctccccagtcatayataagcctctgagcagacataaagaactcttcaggacttgatcccagtctgattttcaacccccaaacaacagcccctcccttctgttccaagttccctatcatcaagcaaccaggactaatatattctctaaccactttctatcataccttacctgttcctcactccctcctccctactgtggcttaagctagggtaaaatctgaagcagaagcaactaagcccagattaatggtcatttctgactccacgaggcaaaattcaacacttctctatttataatagtgttctcacagcact

SEQ ID NO: 62597 - DNA, 601 bp, Human
tgtggaaaatgaagacaagaacaggcagcagctaccagaaataaaaatatccttgccaaaacaaaaacaaaaaccaaaccaaaaacagtgggaagagcaggaggataaaatcaaggcaatctccaagaataaagcaaaaacacaggaagaagagataaatcaaatggaggaacttctgtttcatcagcataatgggtctgctatttccaacagtcctgaatgaaacaactaaactctggataaaatatttaaaagaattttttttggtaaatgtgttgctgagagaagaataaaatgttaycaaaatgatgtagatcattccagcagattaaaaaacagatgtttttaagtatatggtcatattcactgtatttttctatttgttttcatctatttcttggatagattgttttctccctgccttcaatctctgtaccccccatctatcacccatactgaaaccttaactttttgcctgcagcttatatctgctcatgtcgcttctctgcttacaaacttcaaacctctaaggcctccctattccctccccagtcatatataagcctctgagcagacataaagaactcttcaggacttgatc

SEQ ID NO: 62598 - DNA, 601 bp, Human
tcttctgtttctttggttgtttatgctttaggtgatgtatctaagaagccattgcctaatccaaggtcataaatgtgtacgtaatcctatgttttcttctaggaatattccagttttaactcttaaatttaggtctttgatctattttgagttaatttttgtatatagtacaaggtaggagtccaatttcattcttttgcatgtggagatccagttttcccagcaccattcttcgaaaggacaattcttttcccaattagttgtcaactgaacataaatgtatggcttttttttttctggmatctcagttgtattccattgacctgtatgtttatccttatgccagcaccacacagtcttgattactgtagctctgtagtaactgcttcaattgggaagtgtgagccctctagctttgttccttttcaagattgttttggctattctgggtctcccacatttccgtgagaaattttattagatttgtcattttctataaaaaaaagcagctgaggttttgatagagattgtgttaaatctgtaggtcaatttggggtgtattgccatctttaacaatagtaagtcttacaatccatgaaca

SEQ ID NO: 62599 - DNA, 601 bp, Human
atttgaactcattaaaattaaaaaatttgtccccattaaaataaaaaaaatcttctgtttctttggttgtttatgctttaggtgatgtatctaagaagccattgcctaatccaaggtcataaatgtgtacgtaatcctatgttttcttctaggaatattccagttttaactcttaaatttaggtctttgatctattttgagttaatttttgtatatagtacaaggtaggagtccaatttcattcttttgcatgtggagatccagttttcccagcaccattcttcgaaaggacaattctttycccaattagttgtcaactgaacataaatgtatggcttttttttttctggaatctcagttgtattccattgacctgtatgtttatccttatgccagcaccacacagtcttgattactgtagctctgtagtaactgcttcaattgggaagtgtgagccctctagctttgttccttttcaagattgttttggctattctgggtctcccacatttccgtgagaaattttattagatttgtcattttctataaaaaaaagcagctgaggttttgatagagattgtgttaaatctgtaggtcaatt

SEQ ID NO: 62600 - DNA, 601 bp, Human
acaacttcacctccaggaatccgtaacaactgcccccccacttcccatgtaaaggcattccagagcttattaactgcacattctaaaggatagcccagggcttgtgacagtatgtcatttgcaggtcatgttaccacctgtattttgttcagaataactgacagaaataaagaatgtgactgagccaccgaaatgactaaggctgcctgcattctatcaacatgtgatcaatcctccctgattgtctcatctgaagaatttccaaaattcctgatgcaagagtttttagcaatttttttttaacaacaacaacaaaaaaaacggctacagttgtggctgaaatatatggaaaacttgggtaatgccaaacagtacatattatggaaatttaaaaaacatattagataaaaatattcaataccattagttaaaagtagtattcactataaataatgctgctgcgctgaagtattcttacaattattagtataaaaagagaatcaactagcattactttaaaatgctataatattataggtattttatatatagaagctctgtaagagctttcttctcacatctcctaagtttgaaggtttga

SEQ ID NO: 62601 - DNA, 601 bp, Human
attctcactttcctcaatgtctttttaaattacgcttcttcaacaagaccttctctgatgagtaaaaaaaggggagggggtcaggatgctgtctcagtgccaattccaggcacaattggaacaaccggtttcactgctgtccccctgcccccaggcagctgggacctcagcatcgaagtctgtgcagatgaactcccactccataccctcttgctcaatcagggcctaactcccctgcctgccagcttggcctcccccaggtgctctctggtgtggctgatgtcctgcaattgggctggartcctcaccttcagagccactcacccaccaccagagaccgccactgccccctccccattaatctaatcagccagcacctgggattatttcagtgggaagatttattgaagagggggtagaacacacgagtttattattttctaatgagtttgtattgtccctttacagtcttcatagagaaaactggagaggctgtcctaacttcacctcagcattggccgtggcagcgagggcctgccctgtgtcttgtgcgtgctcaccaccctttcctctgtacctctgcatggcgcataaacactag

SEQ ID NO: 62602 - DNA, 601 bp, Human
aaatggaaaaggacatgagtgccctttgtagaccatgagattttctctccaggcatagagtacaacaaaaagtgatgcagaaaggacagtaacttctcaatgggaaggagtccaagggcaggtgtatcacccacagattgcacacaagtgtgcaaggaagcaggtgtgtggggggagggctataactgggctttgtgggcagaggctccattcctgtaggggctcatagctttagaacccaggtctccgcctgccgtggggaatcaggcagccagcacctctaccctgttagataaacttrcaatacaaaaaggagagggacaaatgggacaatttgatgtcacatacggctgctatggtcccttccaaaactcatgttgaaacttaatccccaaagcagcagtattgagaggtggggcctttaagaggtgaccggatcatgagggccctgacttcataaacagactatcatgggagtgggactggtggctttataagaagaggaagagagacctgagctagcccatgagcacactcagcacccttgccatgtgaggccctttcccatcttgggactctgcggcgtccccaccagcaggag

SEQ ID NO: 62603 - DNA, 601 bp, Human
tctatcaaaagcaaatctactagcagagcagggatgtaactgactcaaatggaaatacatttattagatgagacatagaaaggtaacatggatctaattaagacaaatgaaaaacaaccaccacagaaccagaaccaacaaatacttgctctttttcttcccagtcaaaactctttaacattgctttttctctctcctccaacatctgctgagaaaatggtaaattgccccgtcattctaaaggaacccatgctaacattgggaaagtgtcagagaagttaacacagaaaataaggacgtscatggtcaggagagtcagcccaggacagcaacggggcctctgtaggaacaggtactgtgtctgaaccctgatcaggcagctctgggagtcaatgaaacccctgaggcacacgacaagaagggttctgtttttgttttcatgataatcataagtccttcagtaaaggaggtgtgtctgcataggatcagggaaaatccatgaaaggaaaaatggaaaaggacatgagtgccctttgtagaccatgagattttctctccaggcatagagtacaacaaaaagtgatgcagaaaggacagtaac

SEQ ID NO: 62604 - DNA, 601 bp, Human
gccaataaaaacagattgcttgagcccaggaatttgaaaccagcatgggtaacatggtgataacccatctctaccaaaaaaacaaaacaaaacaaaaacaacccaaaaattagctaggcgtggtagcccacctatagtcccagctactcaggaggctgaggtaagaaggatcacctgagcctgggagcagaggtggcagtgagctgagatcacaccactgtactccagcctgggtgacagagtgagactctgtctcaaaaacaaaacaaaacaaaaacccacacaaagtagtatggcagaygtaatgttaaggacacacaaaatattaactaggagcacatctcttcagtatgctaacctcgactgttaatgtaatttatatgtaatattaaaaaacccctggaaatacaggattgtgtctatcaaaagcaaatctactagcagagcagggatgtaactgactcaaatggaaatacatttattagatgagacatagaaaggtaacatggatctaattaagacaaatgaaaaacaaccaccacagaaccagaaccaacaaatacttgctctttttcttcccagtcaaaactctttaacattg

SEQ ID NO: 62605 - DNA, 601 bp, Human
ggcttcccaaagtgctgggattacaggtgtgagccaccacgcctggccctttgtaaatattttttaatttttttttgtaaatattttactagcttatattttataaatagacttgaaaagagcgatttgcccaaggctactggcagagattagtaagtgttccttccttcattttcccctttttccttttagaaacagaataatacccttttcttgctaagtgtgaacaggactctcgattgctgtggcagtgactgcatttcccagatgccccgaggcgtgtggctgtgcgactatattsttgaaaatggctgtgagtaaaggtgacgtgtgcagctgggttctgcaaaaggaagctactcgccctccttgtcctctttctcctttcctgctagctttgaaatggtgaagactgtaatcaccaccttggactcaaaggtgaacaccagatgttgatgaagctaccagctcactggttctatctgctagcttgataggcaaggggaggccaagtttacacccggcttgattttacatcactaacaccaaaactgatgtctatgccacattcatgttgtgtatgtatgacacctgtaacttt

SEQ ID NO: 62606 - DNA, 601 bp, Human
cctaaccaactgaatatggcagtggttccggatgtcactcctgtgaatacattgtgttatccatgatgtctccatctcgctagcaagctcactctagaacactccttgttagctagaggaagaaggtgaccatgttgggaaagcccactgtcagaggtctgggggaggaccctggaacctggggggccctctaggacctgtgggtagcctagagccaaccggtaagaagcctgtcctcagtgctataactgtaggacatgaattatgccaataacctgggtgatgcagccaagctcccagwtgagactgcagccctgccagcaacttgcctgcagccttgtgtgacccccaggcacagcaagcagctacactgtgttgactcctgatccaaaccaactgtgagataggcactgttttaagccactacatttgtagaaatttttatacagcaattgaaaactaataccaatatctatttttttaaatgagacttaggttaaaaatactattttgagaataaacgcctgcaaatatggaaggtatataaagatataccttgtgtctttgtgaaaatgtttgaagggcagtatctttgtaaatt

SEQ ID NO: 62607 - DNA, 601 bp, Human
agtgcttctaactgataaaaagtccctactgacagtttaccaaaacccatgaaataacagtgcccaacagacaggaattctccatttggaatataaagtgttgttaagtggaacagttattgtggtggacacactctcaggaggcccccatgacccatcctcctgatggtcacacctttgtggaatcccctgccttaaatatagacagaagctgctccttgctcctaaccaactgaatatggcagtggttccggatgtcactcctgtgaatacattgtgttatccatgatgtctccatctygctagcaagctcactctagaacactccttgttagctagaggaagaaggtgaccatgttgggaaagcccactgtcagaggtctgggggaggaccctggaacctggggggccctctaggacctgtgggtagcctagagccaaccggtaagaagcctgtcctcagtgctataactgtaggacatgaattatgccaataacctgggtgatgcagccaagctcccagatgagactgcagccctgccagcaacttgcctgcagccttgtgtgacccccaggcacagcaagcagctacactgtgttg

SEQ ID NO: 62608 - DNA, 601 bp, Human
tcactcactctctcaatgtgtgggcatgttccatgcatcactggagactagtgcttctaactgataaaaagtccctactgacagtttaccaaaacccatgaaataacagtgcccaacagacaggaattctccatttggaatataaagtgttgttaagtggaacagttattgtggtggacacactctcaggaggcccccatgacccatcctcctgatggtcacacctttgtggaatcccctgccttaaatatagacagaagctgctccttgctcctaaccaactgaatatggcagtggttcyggatgtcactcctgtgaatacattgtgttatccatgatgtctccatctcgctagcaagctcactctagaacactccttgttagctagaggaagaaggtgaccatgttgggaaagcccactgtcagaggtctgggggaggaccctggaacctggggggccctctaggacctgtgggtagcctagagccaaccggtaagaagcctgtcctcagtgctataactgtaggacatgaattatgccaataacctgggtgatgcagccaagctcccagatgagactgcagccctgccagcaacttgc

SEQ ID NO: 62609 - DNA, 601 bp, Human
cttctatttgcctcacacatccatgctctctctctctctctcactcactctctcaatgtgtgggcatgttccatgcatcactggagactagtgcttctaactgataaaaagtccctactgacagtttaccaaaacccatgaaataacagtgcccaacagacaggaattctccatttggaatataaagtgttgttaagtggaacagttattgtggtggacacactctcaggaggcccccatgacccatcctcctgatggtcacacctttgtggaatcccctgccttaaatatagacagaagytgctccttgctcctaaccaactgaatatggcagtggttccggatgtcactcctgtgaatacattgtgttatccatgatgtctccatctcgctagcaagctcactctagaacactccttgttagctagaggaagaaggtgaccatgttgggaaagcccactgtcagaggtctgggggaggaccctggaacctggggggccctctaggacctgtgggtagcctagagccaaccggtaagaagcctgtcctcagtgctataactgtaggacatgaattatgccaataacctgggtgatgcagc

SEQ ID NO: 62610 - DNA, 601 bp, Human
acttttattacagtacataagttgtcctatcttattgctgttaatctcttactgtgcctaatttataaatgtcactttatcataggtatgtatgtatagtatatatagagttcagtactatctgtagcttcaggcatccacctggggccttgaaacatatcccttgagaataagcggaggacccctataaaccacgagtatagaaatgcaacctattgctctgatgtgtgttataaacttcccaagggcatggcctacatattgtgcccatgtctggacttactgcagtactggaagcacracgggaactcgacagcaatctgctgaatgaatggatggacagatggacaccatgggattctttcacaatgacattcaatgttactgacaactggacatctggctgagatgcagagtccaggaataatatttctggtttacaagaccggtgtattgggttgtactacaagggcagtttcatttaagtaatttattttcgactagggaagtgagtggtattagggtaagaatggtagtgaaatatattaaatacattgactatataccaatgatgatgtgacactgtctgagagagtacatt

SEQ ID NO: 62611 - DNA, 601 bp, Human
tcaggctggagtgcagaggcatgagcatgtctcactgtaacctggagctcctgggctcaagtagcctcagacctcagcctcctgagtagctgggaccacaagtgtgcaccaccataattggctaatttttaaaaaaaatttttgtagagatgagggtctctctctgtttcccaggctagttttgaactcctggcctcaagtgatctgcttaccttgtcaagtgctgggattacaggtgttagccactgtgctcagccaactatactcttaaatagtataccatttcttcatgtccagctayaaatgtagaaatgctttagctaaaatttattttcaaatgatttttatcactggaacattatacagttgactcttgaacaacacaagtggatccacttatatgtggatttctttcaatgaatacagtcgaatacatattggcaggttctgcaaccacaaccaaacgcaggtgggaaatacagtatttcagggatgtgaaacctgcatctatggagggctgaattttcctgtctgcaggttccacatggccaatcacaggacttgaacatgctcagattttggtatccatgctcggggggtg

SEQ ID NO: 62612 - DNA, 601 bp, Human
acgtgtggatctgatttcaaaagcaaaccatgcaaacatctttgtagttttccttttattacggtgagagacatagattttcaaatcctattgctgtcccaaggcatgcctatttaaaccttccttgagttacataatctcagtgatcccatacgaaagacaaaacttggagccagcaaagcagcctgtcaggaaacccatggatatggtcacttgctttagaacttcagagaatggaaggctctttgatcatttttacttgcctatagccctactctaatgccacgattttccagggccrgaaatggaaaggtagcaatgagccatttacttactatctattttcagtttcaaacacagaacaggggctagtgcagagcaagcactcagtaactgtgtgctagatatggaataacggaactaaccatttctcccaattatactctttttaaatttttttagagacatggtctcactctgtgactcaggctggagtgcagaggcatgagcatgtctcactgtaacctggagctcctgggctcaagtagcctcagacctcagcctcctgagtagctgggaccacaagtgtgcaccaccataa

SEQ ID NO: 62613 - DNA, 601 bp, Human
ttatctgacataaacatttcttttaaaaaacagaagcttgggccgggcacagtggctcatgcctgtaatcccagcacatcaggaggctgaggcagctgggtcacttgaggccaggaattcgagaccagcctggccaacatggtgaaaccctgtctctactaaacatacaaaaattagccaggcgtggcggcacaagtctgtaatctcagctacttgggaagctgaagcaggagaactgcttgaacccgggaggcggaggttgtagtgagctaagatcgcaccactgcactccagcctaggygacagagcaagaatctgtctcaaaaaataataataattaaaaaaaaaataaacaacttttttaaaaagcttaactttttttttaaccatgataacaacactctttaacaaagctgttaactccccagaaaataaagaataaacaaagtataatccttgctacaactctataaactagataagtgaattctagttaacatatcaaggaagaaacatttttaaaaatatggttacttcatcacaggaacgtggcagcatactccctgtattcactacacagtggcttaaaagacgcatggca

SEQ ID NO: 62614 - DNA, 601 bp, Human
aactgtcctcaaaggctacacttaggactttaacatttttacttttctgaaacaaatctgacacagcaatcatccactttcttctgtctttatctgacataaacatttcttttaaaaaacagaagcttgggccgggcacagtggctcatgcctgtaatcccagcacatcaggaggctgaggcagctgggtcacttgaggccaggaattcgagaccagcctggccaacatggtgaaaccctgtctctactaaacatacaaaaattagccaggcgtggcggcacaagtctgtaatctcagctrcttgggaagctgaagcaggagaactgcttgaacccgggaggcggaggttgtagtgagctaagatcgcaccactgcactccagcctaggcgacagagcaagaatctgtctcaaaaaataataataattaaaaaaaaaataaacaacttttttaaaaagcttaactttttttttaaccatgataacaacactctttaacaaagctgttaactccccagaaaataaagaataaacaaagtataatccttgctacaactctataaactagataagtgaattctagttaacatatcaaggaagaa

SEQ ID NO: 62615 - DNA, 601 bp, Human
tagttagttcagagagttgtactctgcaatgattctctgttgcatgaactgcttttcatgaactagtttttgtaacacaaaaaccttccatgtttttaccataattacattttatgacaaaacaaaaagtcacagagcagaagaaaaatgggacagaatttaaaaatcattactatacaaagaggggtaatctgggaatgcattctttttttttttttttaagaagagacaaacgctaagaaccaaagataaccaccagcaacttgcctctcagtggaagaagggtgaacaaactgttgtscctccttctctaagctccttccacttattttctaatcataagaaggaagaagcggacacctaattgttttgtacaagttcatcactttgggattcacttctgtgacagaaacgtaaagacagcctagagacggtggcaggagtgccaatggtggagccgggtggaggtgcacatctgttctgacccacttggaacgcctggtcatcaacattggaggagagaatttggagtctggcacagagagagagcatccattctatctcaggacaatgatgtagttatgataggaaaagccacatg

SEQ ID NO: 62616 - DNA, 601 bp, Human
cactggtatcttggaagaggaggaaaggtggatgccagggtgtgggcacagaggaaaggctgtctgcaagccaaagaggcctcgggagaagccagatctgctgacaccttggtctggacttccagcctccaaaacagtgggaagtaaatttctgttgtttaagccacatagtctctggcattttgtgaaggcagccttagcacactaagacatacacaaagaaaattttgtatcacataaatataatcatatatagatgtatatgttttgctccaaatatatggctattcttcttcattamgtgagtttaattacactgattataatacattttatttcacatgactatctacaaaaacagtaaagtcaggagtttatttatttttaataatttagttagttcagagagttgtactctgcaatgattctctgttgcatgaactgcttttcatgaactagtttttgtaacacaaaaaccttccatgtttttaccataattacattttatgacaaaacaaaaagtcacagagcagaagaaaaatgggacagaatttaaaaatcattactatacaaagaggggtaatctgggaatgcattcttt

SEQ ID NO: 62617 - DNA, 601 bp, Human; identical to SEQ ID NO: 33677

SEQ ID NO: 62618 - DNA, 601 bp, Human; identical to SEQ ID NO: 33678

SEQ ID NO: 62619 - DNA, 601 bp, Human; identical to SEQ ID NO: 33679

SEQ ID NO: 62620 - DNA, 601 bp, Human; identical to SEQ ID NO: 33680

SEQ ID NO: 62621 - DNA, 601 bp, Human
ccaagcacggctgccaggaacacacacctcacagaaactcaccgcttatttccgccttagctcggggtgggctggcgctaccaaccaccagccaaaagtatacaatgtacccaatcagtagcttattatgatgtgcctattgtttcacttttgcctgggtctggaacagaccctgaactagatgtcctgtctgacagtacaggcagctgaagagcttggtctgcttgctgcctgaggtcctggttcaatccctggctcttccacatactgccttgttacataagcagagggcctaacctgyttattgtctataaaacggggatcataactcctacctcatagggttactaagaagagtcaatcaacagatacatggtaatccctaaaaccatccccagaggtggaaagttcaataaggaccagtaaggactagctgtaaatgatggctgtgtcagcatgcacacttcctcactcttcacaaagctgatggaatgaatgcagtctccaaaagagcaggatgtttgtctaagcgtctttcactacttcacctctggcacatggaatcatgtctggcacataattagcacttcacaaatatttg

SEQ ID NO: 62622 - DNA, 601 bp, Human
gttctatttctttccattttgctatgtaatataattctttacatttatccaggaagcagttaaacaaaaatatataaggtacctataaaaagttacattttcatagaagaatactgccaacgagatcctgtatgcttttacattacaaatctcagtaatttcacccatcactcctggtaataccccagtgttaaggctgtgagccaacacctaagacctgctgttttggggtacagactgactgcctccaagaaaatgagaagccactactatgggtcttagcttacaaatccagccctakgaagtgacaactggcataaccctctttgcatgtcccccattcatctctgacatgaaacaaatcatgtgaattaatgagatctgacagaacagcattaagaaaaatattaaaatgtaaaagtagaattgttctattgtttgtgttaactaaaatctgaatacttaatcatctctggtttgaatgatggacttctttttctctcatatgtgaattttagtgcagaaaatattaagtttcttaacacaaaattgttttggataaagaacagaatttttgagagttagttgcaacattctggga

SEQ ID NO: 62623 - DNA, 601 bp, Human
tggttagggaggtacatagtttgaaggcaggtgttctatttctttccattttgctatgtaatataattctttacatttatccaggaagcagttaaacaaaaatatataaggtacctataaaaagttacattttcatagaagaatactgccaacgagatcctgtatgcttttacattacaaatctcagtaatttcacccatcactcctggtaataccccagtgttaaggctgtgagccaacacctaagacctgctgttttggggtacagactgactgcctccaagaaaatgagaagccactrctatgggtcttagcttacaaatccagccctatgaagtgacaactggcataaccctctttgcatgtcccccattcatctctgacatgaaacaaatcatgtgaattaatgagatctgacagaacagcattaagaaaaatattaaaatgtaaaagtagaattgttctattgtttgtgttaactaaaatctgaatacttaatcatctctggtttgaatgatggacttctttttctctcatatgtgaattttagtgcagaaaatattaagtttcttaacacaaaattgttttggataaagaacag

SEQ ID NO: 62624 - DNA, 601 bp, Human
gatcgtgccactgcactccagcctgggcagtagagactccatctcaaaaaaaaaaaaaaaaataataataataataagacaaaaaaagaagtgttttgaagtcaaatcacattttacctcccgcaaggaaattaagtgactttcctaagtaatttatagacagtaagtagcagagtcactgactgcaaatccaattctatttcaccatgtgattgctttctttctctggggaagaaaatactgttttaaccactattatgttgccttcaaatggtatttggtgtgttaggctttttaagamagcccctgctgctgcaacttgtcttttttcctgtgaggatcactctatgtaaagttaagtaatggaaaacttctgaataaataccttgcagccaagagttagagagcatagatacatggttgcctagcagtggcctttaactgatgaatgtaaagcaaacatcagggaaaaaagaaagtagaggaatcctgtgtgctcagggacttccttgaatagggtgttggcctctagctggtgaggactagaaatggccgagggactcagagctctgagcagagccctgttcccaagggatgactc

SEQ ID NO: 62625 - DNA, 601 bp, Human
ctttgggccaggcaaggtggctcaggcctgtaaccccagcactttgggagaccaaggagggtggatcacctgaggtcaggagttcgagaccagcctggccaacatggcaaaatcccgtctctactaaaaatacaaaaattagctgggcatggtggcacatgcctgtggtcccagctactcaggaggctgaggcaggagaagtgcataaacccaggaggtggaggttgcagtgaggggagatcgtgccactgcactccagcctgggcagtagagactccatctcaaaaaaaaaaaaaaaaawaataataataataagacaaaaaaagaagtgttttgaagtcaaatcacattttacctcccgcaaggaaattaagtgactttcctaagtaatttatagacagtaagtagcagagtcactgactgcaaatccaattctatttcaccatgtgattgctttctttctctggggaagaaaatactgttttaaccactattatgttgccttcaaatggtatttggtgtgttaggctttttaagaaagcccctgctgctgcaacttgtcttttttcctgtgaggatcactctatgtaaagttaagtaa

SEQ ID NO: 62626 - DNA, 601 bp, Human
gtgctttgggccaggcaaggtggctcaggcctgtaaccccagcactttgggagaccaaggagggtggatcacctgaggtcaggagttcgagaccagcctggccaacatggcaaaatcccgtctctactaaaaatacaaaaattagctgggcatggtggcacatgcctgtggtcccagctactcaggaggctgaggcaggagaagtgcataaacccaggaggtggaggttgcagtgaggggagatcgtgccactgcactccagcctgggcagtagagactccatctcaaaaaaaaaaaaaawaataataataataataagacaaaaaaagaagtgttttgaagtcaaatcacattttacctcccgcaaggaaattaagtgactttcctaagtaatttatagacagtaagtagcagagtcactgactgcaaatccaattctatttcaccatgtgattgctttctttctctggggaagaaaatactgttttaaccactattatgttgccttcaaatggtatttggtgtgttaggctttttaagaaagcccctgctgctgcaacttgtcttttttcctgtgaggatcactctatgtaaagttaag

SEQ ID NO: 62627 - DNA, 601 bp, Human
gaagtgctttgggccaggcaaggtggctcaggcctgtaaccccagcactttgggagaccaaggagggtggatcacctgaggtcaggagttcgagaccagcctggccaacatggcaaaatcccgtctctactaaaaatacaaaaattagctgggcatggtggcacatgcctgtggtcccagctactcaggaggctgaggcaggagaagtgcataaacccaggaggtggaggttgcagtgaggggagatcgtgccactgcactccagcctgggcagtagagactccatctcaaaaaaaaaaawaaaaataataataataataagacaaaaaaagaagtgttttgaagtcaaatcacattttacctcccgcaaggaaattaagtgactttcctaagtaatttatagacagtaagtagcagagtcactgactgcaaatccaattctatttcaccatgtgattgctttctttctctggggaagaaaatactgttttaaccactattatgttgccttcaaatggtatttggtgtgttaggctttttaagaaagcccctgctgctgcaacttgtcttttttcctgtgaggatcactctatgtaaagtt

SEQ ID NO: 62628 - DNA, 601 bp, Human
taagaaagttggtttcagtcaggtattgccacatgtgtttagtggaggattaagtgactgaatgtcatgcctataatatatatatttatgtaagctatgaatgtgtttaaaaatagacaaggccatactgtcaatctgcaaagctactgccacacgtctgtacacacaccccacccccttcagagattaaaaaaaggagaagcagattaaaaagaagtgctttgggccaggcaaggtggctcaggcctgtaaccccagcactttgggagaccaaggagggtggatcacctgaggtcaggarttcgagaccagcctggccaacatggcaaaatcccgtctctactaaaaatacaaaaattagctgggcatggtggcacatgcctgtggtcccagctactcaggaggctgaggcaggagaagtgcataaacccaggaggtggaggttgcagtgaggggagatcgtgccactgcactccagcctgggcagtagagactccatctcaaaaaaaaaaaaaaaaataataataataataagacaaaaaaagaagtgttttgaagtcaaatcacattttacctcccgcaaggaaattaagtgactttc

SEQ ID NO: 62629 - DNA, 601 bp, Human
cattcctaatatctatataattctaccagtctatttgctgtagtaagaaacaattctgcttcctagtgggggcaaagtattacttccttgctattcacaagcctcagcatatctgtctttttagaaaactgcacattttctgaagtggctgtaatggaaactgaaccttagatcatgctcaccatagcatacttaacaaatattctagtatatattttataaaatggtaaaatgaatggaaatgccatatcatcatggtttattttaagcaaaaaccttaagttatcttattactcagaartgtgatttaacataagccaaaaaccattgtgggggtatgagatgaacagcagaaaaccttaacattgacaatgagagttaaacctcaccccagatgtctcagcaattaagaaagttggtttcagtcaggtattgccacatgtgtttagtggaggattaagtgactgaatgtcatgcctataatatatatatttatgtaagctatgaatgtgtttaaaaatagacaaggccatactgtcaatctgcaaagctactgccacacgtctgtacacacaccccacccccttcagagattaaaaaa

SEQ ID NO: 62630 - DNA, 601 bp, Human
tgagtaatacaattgccattcacaaactgctgaagtaatatagtttccattcctaatatctatataattctaccagtctatttgctgtagtaagaaacaattctgcttcctagtgggggcaaagtattacttccttgctattcacaagcctcagcatatctgtctttttagaaaactgcacattttctgaagtggctgtaatggaaactgaaccttagatcatgctcaccatagcatacttaacaaatattctagtatatattttataaaatggtaaaatgaatggaaatgccatatcatyatggtttattttaagcaaaaaccttaagttatcttattactcagaaatgtgatttaacataagccaaaaaccattgtgggggtatgagatgaacagcagaaaaccttaacattgacaatgagagttaaacctcaccccagatgtctcagcaattaagaaagttggtttcagtcaggtattgccacatgtgtttagtggaggattaagtgactgaatgtcatgcctataatatatatatttatgtaagctatgaatgtgtttaaaaatagacaaggccatactgtcaatctgcaaagctac

SEQ ID NO: 62631 - DNA, 601 bp, Human
ccttcccctcccctcagattctttgcggaagagttgaagaaagagagcataaggaattctgtaaccagaggcagaacccaaaactaactgggccatgtcctgcttacatggctgtggggagaatctttccatcaggacccccatggctaaaaatggttataaactaaattgacagctttgccacaaaagtctaaaggagctcacaggaagaggaagattttattgttgatcagtggatgtcaggcaggtctctccaatgtcaatgagaatagataggttgcgacattaaaaaaaaaaaaaacttggagatcgttaagagaaccatcagggcccaagacccacattgcttacatctcttgccttctaaaggccaggtcactttcatgtcagaatgtaaggatcaacagagaaaaatgtgggcaaggcagcacagagggtatgaacactgacaaagtttcattatttataaaaatagggacaatatgacctgtgttataggggattaaacttatcagaggataagtaaaatctgaacctaaaaactcagtaagagggatttacctaaaaattttacataacataaaacacaaaaagaccaaat

SEQ ID NO: 62632 - DNA, 601 bp, Human
cgattgtcgtgatgtttgtattgtgcaaataacaccaatagcaaagccttgcactaagcatgttttgcctactaggttagtaatcaggttatttaaaaaaaaaggcatcaacgcttattatttaagctgctgtgtcacaagacatcaaactttcaagtggactaaatattttgggtcaatttgaataaacgtgtcatcctgtcagtcagagctgtctgaaactgaagtgagtttccttgtgaaaaagtgagtttcccatcatcagaactgtatgggcaaagagctttctccagcccattcygtacagagtccttcgcagtcactcagaaactgaatccgacaggcttgggagcttcctgagctgaattctcgcagtggccgaattgcataagggcttcttgatttctgtcccccgtgacagtcataaccatgcaaccatctctataacaactgaagcacggagcttgggagtcatccttgatatcacactcaccctcctccatgccaacataaaactgatcttggcactacctgccttaaaaatactgtaattggtttctcatagtcctcagaataaacaccaactctctttcacagtatc

SEQ ID NO: 62633 - DNA, 601 bp, Human
tgatctcaggcaaataagttacttatgcatcccttggactgtttagagaattaaatgagatcatacagcaacatgcatagtacttggcacatcaaatacactcaacaaatgcttttagctgtacttagtgttattgctgtcactattgtaacaatgaacaataaaataacaaatgtatgcttggtttgattaaacttttatgactccctcctagccattcaatgctggcaatatacaagtagcagaaattagttttattgaaagtatttgacatgaaggattacttatctttagaaaatcmatacacaggctatggaagcatttaaataaaatgtctatcctaatgtggaatgcacgtgcatcaaaaggaagacaaaaataaatctagtgttgaaattccactattttgagtgtgtgacttaagcttttaagaattttgttaaagctcagttttatttaaactgctagaaagggaaatttaagtacaggttggccttcctcctgaccctaaagcttaaacaaaacatacatttagtaccgaatggaaagagagtaaagaaactgtgtgttacctgacatactctaacttatgtgatgggtc

SEQ ID NO: 62634 - DNA, 601 bp, Human
tacctgactctgaatcctagttctaatgtctgctactaggtgatctcaggcaaataagttacttatgcatcccttggactgtttagagaattaaatgagatcatacagcaacatgcatagtacttggcacatcaaatacactcaacaaatgcttttagctgtacttagtgttattgctgtcactattgtaacaatgaacaataaaataacaaatgtatgcttggtttgattaaacttttatgactccctcctagccattcaatgctggcaatatacaagtagcagaaattagttttattgmaagtatttgacatgaaggattacttatctttagaaaatcaatacacaggctatggaagcatttaaataaaatgtctatcctaatgtggaatgcacgtgcatcaaaaggaagacaaaaataaatctagtgttgaaattccactattttgagtgtgtgacttaagcttttaagaattttgttaaagctcagttttatttaaactgctagaaagggaaatttaagtacaggttggccttcctcctgaccctaaagcttaaacaaaacatacatttagtaccgaatggaaagagagtaaagaaa

SEQ ID NO: 62635 - DNA, 601 bp, Human
ggatggagttggaggccattatccttagcaaactaacacaagaacagaaaaccaattactgcatgttcttatttataagtgggagctaaataatgagaacacatggacacagaggggaacaacacacgctgacgcctatgtgagtgtggagcatgggaggagggagagcaaaaaaaaataactattgggtactaggcttagtacctgggtgataatataatttgtacaaaaagcccccatgacacaagtttacctatataacaaacctgcacatgtacaccgaacctagaaaaaaaatttaaaaaaaaaaaataaaagttaaaagctagtcatattcttacatttcagccacagcactggacttagtagaaattaattaattaagttccattagccagatttctatttaaggcctataagtatcagttaggaacagtctggtggaccaaaaaaagagcctcaggctccaaaaaagaaaatgtcctgaggaccccctacaggacaatagccccgtggggccttgctggtcagcagagcagctattcgaatgcagttccaccaacagcctcaggggcactgtgctggtgtgaatttggggctg

SEQ ID NO: 62636 - DNA, 601 bp, Human
tggatggagttggaggccattatccttagcaaactaacacaagaacagaaaaccaattactgcatgttcttatttataagtgggagctaaataatgagaacacatggacacagaggggaacaacacacgctgacgcctatgtgagtgtggagcatgggaggagggagagcaaaaaaaaataactattgggtactaggcttagtacctgggtgataatataatttgtacaaaaagcccccatgacacaagtttacctatataacaaacctgcacatgtacaccgaacctagaaaaaaaattwaaaaaaaaaaaataaaagttaaaagctagtcatattcttacatttcagccacagcactggacttagtagaaattaattaattaagttccattagccagatttctatttaaggcctataagtatcagttaggaacagtctggtggaccaaaaaaagagcctcaggctccaaaaaagaaaatgtcctgaggaccccctacaggacaatagccccgtggggccttgctggtcagcagagcagctattcgaatgcagttccaccaacagcctcaggggcactgtgctggtgtgaatttggggct

SEQ ID NO: 62637 - DNA, 601 bp, Human
ccaacagcaaagacatggaatcaacctaaatgcccatcaatgacagactggttaaagaaaatgtggtacatacacaccaaggaatactatgtagctataaaaaaatgagatcacatcttttgcagaaacctggatggagttggaggccattatccttagcaaactaacacaagaacagaaaaccaattactgcatgttcttatttataagtgggagctaaataatgagaacacatggacacagaggggaacaacacacgctgacgcctatgtgagtgtggagcatgggaggagggagagcaaaaaaaaataactattgggtactaggcttagtacctgggtgataatataatttgtacaaaaagcccccatgacacaagtttacctatataacaaacctgcacatgtacaccgaacctagaaaaaaaatttaaaaaaaaaaaataaaagttaaaagctagtcatattcttacatttcagccacagcactggacttagtagaaattaattaattaagttccattagccagatttctatttaaggcctataagtatcagttaggaacagtctggtggaccaaaaaaagagcctcaggctccaa

SEQ ID NO: 62638 - DNA, 601 bp, Human
aaagcaggggttgttcctggacaaagagaaaacagtgtctcactgccaccaagccctgtcaggtgtggcaggaggtgtgagggggataggaagatgcacagagggactgccctccatagcttgggtctccctgaaactggatcttcccttgtggagtcggggaaggaagtatcgctgcttgtgggtttcaaagatgcaagggaagttcatggactgggtgtccaaggctgcccaggagaggggaggtctgggtgctctgtgtatgtggccaggtggatggactcgtaacaccaatcaggcrtggccagtgccatgggccaagacacccaggacaaatacctcatcagttctttaaaatcaaagctaaaaaatcaaaatcacaatgagataccattgtacaccagtcacaatggttattagtaaaaagtcaaaaaaataacagatgctggtgaggttgtagagaaaaaggaatgcttatacactgttggcgggggtataaattagttcagccattgtggaaagcagtgtggcaattcctcaaagagctaaaaatagaactaccatctgacccagcaatcccattactggttaatatacacaa

SEQ ID NO: 62639 - DNA, 601 bp, Human
atgagaaaagctcagaaacacacacctaagaagcttctttcattctgactgttctgagcctgagaaatagaacccaacctcagtcaggcaggagcccagagggagccatttctcaaggaaaacacgaagttggtagaggactggtcatctgttgataggtcatgatttctgccaaagtgggcgattttagcagaaaggtggatggagttgcttaggtctgactccccataggcatggacctctcccatcattagtgttctgagataaatgcctctgcctgcaggccaagctccctgtgcayggcagcaagcagaaacatgactactcctgactccacttcagactgaacgtctgctcatgcatttatcaaaaggaaatgtttactaagcacttgtgtgctaaacactgtgtactggagacagcaggcacacagatatgagtgagacatgatttctgttctgaggaacttcatgagttggggagaaagccatggaaatacataactgttcatacagcaccaaggtgtcaatggggtaggatattgcttttttccacctagcatccatttcccttctggttaggagaataattttgctttaga

SEQ ID NO: 62640 - DNA, 601 bp, Human
tgagtatgatccaaatttaatgaaactcaaagaatgaatgaatgaagaaactattaattgaatatttgtaagagttttttccattcattcatccattctatctgtgcctaaatgcctaatgtgaatttcaggaaggcaaaacaaacaaacaaccccaaaaaagaaaaaacatgttatttattaggaagatgttatatatcaagcttgtccaactcatggcctgtgggctgcatgtggcccaggatgactctgaatgtgccccaacacaaattcataaactttcttaaaatactatgaagtkttttcttggtgattttttttagctcatcagctattgttaatgtagtttatgtgtggcccaagacaattcttcttccaatgtggcccagggaagccaaaagattagagatccctgtatatattatatataaaaattactgagttttttttttttttttcttgagacagggtgtcactctgtcactcaggctggagtgcagtggtgcaatctcggctcactgaagtcttgaatttctgggctcaagtgatccttccacctccgccttcctcagctgggactataggaatgcaccaccacgcc

SEQ ID NO: 62641 - DNA, 601 bp, Human
agaaagctttggtttcttttttaaagctgacaaagatgtcccctttgccttcaagtcttaattttagaagggtgacgattaaaattgtattttccaagcacccctgggaaccagcttggagctgttaactccaaccaaggtggatggagttaacaaacacatttcactctggaaatcacctaaattagagggagaatgaatggatcttgccaaaaggactcaaacaggcaataactttacaattaaaaagagaaaagtgtcaatagcaatataagaaagacaaaattgcatcaggacacayattgcaaatatgagctcacaaaaggaagcaggtagtagatcttcacctatttgtcctactgagagggacagagaatatataaagagtagttaaagagtgagaatttaatgtatttttctcctcattttacctgagagacaaatgggctaagaaaagatggtacaagccagaacatttttgttctgacggctctgctcaaattagcgtgtttcataaccttgaagtactagggtaattattctggcctgactaatttaaattataatatcaacaagattccaagactgagtcttaaaacgg

SEQ ID NO: 62642 - DNA, 601 bp, Human
ttctcccttccctcttgcttcttcttgcctattaaactctctctgctccttaaaaataaaaaaaactatatttgaaacatttctataattacatgactggtcgtttataactaaatgactggaattctcagaagagaaagccatttattcagagccaagctattcaggtaagtatggctatcctgttctttgaagtggttcacttcaactcaacaaactgccaatataaatatgaccttgctctctccttcccagcagacaggcccaactaacacacgtccttctccaatttcccaccttaaaacaattcctgtatctcacagaatggcaactgtggccacaagagaaaaatatatacacttgtgggcttttctaaagaaatatagttagagctaactggtttggtgattttgtatgtatgtgattgctgaagatgaaggttcaaaaaggaggaaatcaggacctgagcctggaaggataatgaagaatagttactggggaagaatcctgggcacactgttatgctagccctgctctaattagatttaaatgttctgcgagtgttaacatgaactaaaccctacacagaaaatttaaaaaa

SEQ ID NO: 62643 - DNA, 601 bp, Human
gcttcttccttctcccttccctcttgcttcttcttgcctattaaactctctctgctccttaaaaataaaaaaaactatatttgaaacatttctataattacatgactggtcgtttataactaaatgactggaattctcagaagagaaagccatttattcagagccaagctattcaggtaagtatggctatcctgttctttgaagtggttcacttcaactcaacaaactgccaatataaatatgaccttgctctctccttcccagcagacaggcccaactaacacacgtccttctccaattycccaccttaaaacaattcctgtatctcacagaatggcaactgtggccacaagagaaaaatatatacacttgtgggcttttctaaagaaatatagttagagctaactggtttggtgattttgtatgtatgtgattgctgaagatgaaggttcaaaaaggaggaaatcaggacctgagcctggaaggataatgaagaatagttactggggaagaatcctgggcacactgttatgctagccctgctctaattagatttaaatgttctgcgagtgttaacatgaactaaaccctacacagaaaa

SEQ ID NO: 62644 - DNA, 601 bp, Human
agactgagtcaaggaaacttattttaaactatttatggcctttaataattgagtaaggtgtactcctatgaacaaaatttgaagcatgtttatttctctgcctggttcctctagaatttggaaattatctgtctggaagctctgagtttatcttgggacctcaagaggagaggatcacccaactcacagcaatcaaactccaaatggtgctataaactgaaccacacatggacacgtcagtcttccgaggacccttagatcaaccccaggaggagccctagctgctgttccccattcgacrcccctttccagcaggaagtagccagaagacatcgtcgcccaaacctctaacagcagttagtgcggcatctccacaggggggaatgttgtaggagttattgataaattattttaggcagatagagaggaaaaggggtccttaggaagtttttgttttttaaagcacgtctggaaaagtttcttgtaaagctccagctcttaaagccaggccagttacccgatatccaaatgccagccattagaaagtgggtccacccaaacatggcgattcctgtggacttcttgccctttccccacattc

SEQ ID NO: 62645 - DNA, 601 bp, Human
gtgggaaatagaccaaggactatctagatggtggacatgaaaatacttggtccaaacacatacttgaaagcccttaactagaccaggggtagttgagaacaataccaatattgttacagtttcaactgtagactaaaatattttcactgtctatctaatgtctatctaaattctaacagctctatcttaggtactatgtgaggaataatgggctgttactagttactagaagagaatgtcattgctgtgtctatttgtgcaattaaagttcaaaacacagtgttcttttttacagtaaaayaatctgcatgcatgaatgcaggccttgcctctggcccagctgtgtcactaaggatagaaacgctgggtatgtgatgatggctaaagtagcacagttgacaatctatcatctagatataggttattacttaagtagactgaatctgattataaatcaggtttcatgcattccctatgtgccaggtttcttgatacagagaacatttgtagggaaaacatttaattaagacatggctttccataaaatgtgctagcctatcacgccatttcttcctttttaatatttgaggggttgcctctc

SEQ ID NO: 62646 - DNA, 601 bp, Human
ggaatattactcagcaacaaaaaggaacaaactattcatacatgcaacaacacaaacggatctcaaaaacattatgctgagtgagagaagccttatgtgaagcagtacatactgtttgattccatttatatgaagttcaaaaagttagtcaaaccaatctatggtgaaaaaaatcagaactgtggttgctttcgggagtggatattagaatcaactgagaaggggcaggagggcctctggtgtgatggtcatgttctacatctggatagtgatttgagttataaaggtgtgtacatgcatyaaaattcattgaaaggtacatttgagattttgcgtttcactgtatgaaaagtttacctaaatacagtaagcaactattgaactctaatgctatgcatgtaaacgaatctaggtgtaaaatgtactgatgtctgctaccttgaaatgcataaaaacataaggccagatacggagatgaagagatgtaaatataggaaaatgtttactaaatggcaagtatatgagtgttgtactgttcattcaatttttctgaatatttgaaaaattttaacataaaatcttgagaaaaagtaaactgtag

SEQ ID NO: 62647 - DNA, 601 bp, Human
aaggatcaaacaagaagatgtagtagaagcaatgaagcaccatgcctagcatatattaagaattcaataaaaagctgaattcatgtcctttcttcactctaaagaagccaaaaacaaagattgatgcaattaaccttattgctttaacctacattcttggcaggaaatgctaactgaagggttgaacaggctctatatactgatatttactttgggagatgaattctgtaaaaccattttcaaaatcaaggcattaaaagattgcaggaatcctctattgttctctgaacctgtattgcarttcagtgaacatgaaggaagcatctgttgtgtgtaaaggatcaggccaggtcatgggcatacaggtgggcaggctcagtcacaacatgaagagtgagagtagtcggctgggcagaactgcatatccatacggcagaaaactagccttgactcctactgcataccatacataaaaactaatttgagatggtcacagacctaagtgtaaacactaaaattattatcttaaaaaaaccgcatgaagtatctttgtgaccctgaagtaggtatagtttcttaggacacagaaagcaatgcataa

SEQ ID NO: 62648 - DNA, 601 bp, Human
gcaagaacattttataaagtcatgggcagtgtgtgggccttggagctatttataattttaatgtatttttactatcaaatccatccttagcttagagatttaggcctaaatatatttcctaagggctattatttttgcatatatgactatacccttagagactgatattagaagactgatttttttttagttatctttgactgggatgattcacaatttaacaagtttaattacatatcaagttttgttatcaagttctatacactttacaatcaattagatgttaattcttttatagaawtcttatatcagaatcaagttattggctctcctccagatttccctgtcccagagaactcctagctttgcaacttagtaactgtgtaacgcagaagtcacttaaaatctctggcatccaaatttcctacaaggttgctataaggatcaaacaagaagatgtagtagaagcaatgaagcaccatgcctagcatatattaagaattcaataaaaagctgaattcatgtcctttcttcactctaaagaagccaaaaacaaagattgatgcaattaaccttattgctttaacctacattcttggca

SEQ ID NO: 62649 - DNA, 601 bp, Human
agaaaagtgggcccaggggaccggcgctcagcatacagaggacctgcaccggcaccagtctctgagtttcctcagtattcattaattactattttcactatctcagcaagaggaatgcggcaggacagcaaggtgatagtggggagaaggtcagcaagaaaacgtgagcaaaggaatctgggtcacaaataagttcaagggaaggtactatgcctggatgtgcacgtaggctagttttatgcttttctccacccaaacatctcggtggagtaaagagtaacagagcagcattgctgccaayatgtctcgcctcctgccacagggcggcttttctcctatctcagaattgaacaaatgtacaatcgggttttataccgaaacattcagttcccaggggcaggcaggagacagtggccttcctctatctcgactgcaagaggctttcctcttttactaatcctcagcacagacccttcacgggtgttgggctgggggactgtcaggtctttcccatcccacgaggccatatttcagactatcacatggagagaaaccttgggcaatacccggctttccagggcagaggtccctgcggctttcc

SEQ ID NO: 62650 - DNA, 601 bp, Human
acgtgagcaaaggaatctgggtcacaaataagttcaagggaaggtactatgcctggatgtgcacgtaggctagttttatgcttttctccacccaaacatctcggtggagtaaagagtaacagagcagcattgctgccaatatgtctcgcctcctgccacagggcggcttttctcctatctcagaattgaacaaatgtacaatcgggttttataccgaaacattcagttcccaggggcaggcaggagacagtggccttcctctatctcgactgcaagaggctttcctcttttactaatcctsagcacagacccttcacgggtgttgggctgggggactgtcaggtctttcccatcccacgaggccatatttcagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcacgttctgcacagctctagatcccttaaaccttgattccatacaacacatgtttctgtgagctcaaggctg

SEQ ID NO: 62651 - DNA, 601 bp, Human
aggggcaggcaggagacagtggccttcctctatctcgactgcaagaggctttcctcttttactaatcctcagcacagacccttcacgggtgttgggctgggggactgtcaggtctttcccatcccacgaggccatatttcagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcaygttctgcacagctctagatcccttaaaccttgattccatacaacacatgtttctgtgagctcaaggctggggcaaagttacagattaacagcatcttagggcaaagcaattgttcagggtacaggtcaaaatggagtgtgttatgtcttccctttctacatagacacagtaacagtctgatctctcttttccctacagtccttgagggtgacagacttaggagtgccttgggggcctctctgaggagcagctgatattcacgggtcaggaggaagcatttccattagaggggcagccggt

SEQ ID NO: 62652 - DNA, 601 bp, Human
cagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcacgttctgcacagctctagatcccttaaaccttgattccatacaacacatgtttctgtgagctcaaggctggggcaaagttacagattaacagcatcttagggcaaagcaattgttcagggtacaggtcaaaatggagtgkgttatgtcttccctttctacatagacacagtaacagtctgatctctcttttccctacagtccttgagggtgacagacttaggagtgccttgggggcctctctgaggagcagctgatattcacgggtcaggaggaagcatttccattagaggggcagccggtggccagcctcacttggaaggtctttgaacctcgggggtgcagggaggtggcagtggtgcaggttgccttctcctgggttccttgaggtgccctcttgtacccggctcacacccttcccctccccgagtttcctgctcag

SEQ ID NO: 62653 - DNA, 601 bp, Human
tgtctgagaaccgtgacttctgtgcttgcttgtgtctggtcagcttgctacacggacatcccaaagattatttacgcctccaggacccactcgcaactcacacaggtcatcaacgagcttcggaacacctcctaccggtgggtcagacgagtttacacctgtctcggggtcctcaagagaaccagcttggcatggtgctgagtccacagccccatgctgtgctgtggtggagggtggtggtctttctagacgctcccccgaagtgtgcagagcgctggtgcccaggggtggggtgcggccygggctgcctccaatgcccattacttgtgaggaagcagctttgcatctgtgtgctgaccttgggcgggcgtcctgagctcctcgcaggtgctgttgtagcagctgtgcagtaggtcagggctggcccccagtgcagctttgcacatgaagtaggaggaggccctgctgcttgtcagagcccagcagagtcttggtgttctgtcgggttcctgtggccggaccagtggcagggtgctgtggaagctgtcgaatctcctccctctgtccagtacccccgctcgtcttctagctccctcctacg

SEQ ID NO: 62654 - DNA, 601 bp, Human
ccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcccgctccggctcagtgtccgacaggcgagtgctgctgggtgtccagagccccaggctgcgctcccrctgggctagggtttgaagttcactgggggactgcaggggaggacctggtgggggtggggactggcttcggtcctttcttggccgtgcttcagctgcgcactctgcccttcctcccacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccggtggggcggccagtgcggccatgta

SEQ ID NO: 62655 - DNA, 601 bp, Human
tgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcccgctccggctcagtgtccgacaggcgagtgctgctgggtgtccagagccccaggctgcgctcccgctgggctagggtttgaagttcactgggggacygcaggggaggacctggtgggggtggggactggcttcggtcctttcttggccgtgcttcagctgcgcactctgcccttcctcccacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccggtggggcggccagtgcggccatgtacctgggccctgtcttctgactcggggccaccc

SEQ ID NO: 62656 - DNA, 601 bp, Human
gtcctagagacagtggcagggtgcacccccgttggctgcccttacagtttctgtgacctgagggtggcatctgtgcagtcggcgcggtctgtgcttctgtgggatcagggttccctctgtttcctgcctcagttggggctcaagcctcaggtgaggtggccccggagcactcagaaggcatcggcggtcctgtgggctgctttctgcactcacgtttgctgagtgctcagtgtgccaggactgaggaccctgaagctgctcttgtatttagggcggcgctcccctggcagagactgagccrggtggtcccgcatgacccactaccaggcgtttctgggccctggcccttggagggacagggtgggcggaacatgggcctgcagggaggctcccgcttactggaggcatgtgctgtgttgctggagacatcctctgtgttgcttcttgttcgctgtggtttttggtctggtggcaccaaggaccctcagtcatcttgatgtgtggttgtccaggcctttttgttggtcctaagaaggggctctgcctttgtgcccccaggttccctgacaggagctgccggctcgtcccggtgatgcctgca

SEQ ID NO: 62657 - DNA, 601 bp, Human
agtgctcagtgtgccaggactgaggaccctgaagctgctcttgtatttagggcggcgctcccctggcagagactgagccaggtggtcccgcatgacccactaccaggcgtttctgggccctggcccttggagggacagggtgggcggaacatgggcctgcagggaggctcccgcttactggaggcatgtgctgtgttgctggagacatcctctgtgttgcttcttgttcgctgtggtttttggtctggtggcaccaaggaccctcagtcatcttgatgtgtggttgtccaggcctttttgwtggtcctaagaaggggctctgcctttgtgcccccaggttccctgacaggagctgccggctcgtcccggtgatgcctgcaggacgtgactctgggacggggggttgggcagatgtgctgatggaaattctcaagcaggcgtcatttccgaggtcctcacctggatttccaggacaggagtgcctgctgggtgtccccagtcccatgcagcgggggtccttgggatagcatggaacgctgagcatgggcctggccggccgtggtcctggacaagggcagtgccccggtggctgctgggcctg

SEQ ID NO: 62658 - DNA, 601 bp, Human
attcttgtggttccagtttggggggcctgtactgtagaggcaagggaggggcaggacatcccccagactctgacttctgaagccttttctgcccggggcctctccgccagtacaggcagtgtcctttgccagggctgccatgctgcagaggggagtgggccactgtttagcccaggaaaacctggctctcccttagctggaagttctgggcctgttgtggttggcagggaagctgagtgacggtgctaatcacaggggcacctgcaggggtttgtgggagatgcctctgtgggttggggcrataggctgaggggctgttcttccctgccctgaggagggctgagtgtagccgccactcctgtcctgtcttgggctgtctcggagaggatgcgtagaaccctcgggatcctgctggcctccgtctggtccaccctgaacctcaggccttctgggggcagaggaggattccctcaggatcactcgggtgggggcctctcttgggcacctgagaccctcagtgggtgctttgtggcgcgttcacggttggtgggggacgcccagccctgcccgccgtgtaggagccgttctgtcctgggcatcc

SEQ ID NO: 62659 - DNA, 601 bp, Human
gtctcctgagctcgagagttccacctgccttggcctcccaaagtgctgggattacaggcgtgagaccccatgcctggccagctctttttttttttttttttttttttgagacggagtctcgctctgtcgcccaggctggagtgcagtggtgcgatctcggctcactgcaagctccgcctcccgagttcacgccattctcctgcctcagcctcccgagtagctgggactacaggtgcccgccaccacgtctggctaattttctgtatttttagtagagacggggtttcaccgtgttagccargatggtctcgatcttctgaccttgtgatccgcccacctcggcctcccaaagtgctgggattacaggagtgagccaccgcgcccggcccagctctgctttttcttagtggttctgcgttgtgtttgtttctatccaggaatagggttggttttacttttccatcgagtttttaaagagacgacgatttacatggtcggaaactcacgaggactccccatcccttggtcggaaactcacatggactccccatcccttggtcagaaactcacgtggactcccatccatcccaggcagcagctt

SEQ ID NO: 62660 - DNA, 601 bp, Human
gttttttgacaaacatgccaatttaattgagagaggaaatgaaggttgatttctggttttctgaaaaaatggtgctaagaacagctggatatctgttcggaaaacagtgaatcttaactcttgttttaccctgtataaacctaaatgtaaaagctaaactaaaagttatagaaaggaacatgggggaggtctttgcaactttggggtaggcagagatttcttagtatggatacacaaggcactagccatgaagaaaaacattaaaatttagacttcaccaaaatttaaagcttcaactctktggaagagttgagaaaatgaaaaagcagttaaagaaagggagaaaatacttctttcaaaggacttaaaaaattttttcagccctcctctgatttgaaaggacctttgaccagagtatgtaaaattctcccataactaagcaaacaacccacttaaccactgggaagggatctggacagacgtttcaccaagatgggtggaatggccagttaaccactgggagagcatccggacagacgtttcgccaagatgggtggaatggccagttaaccactgggagagcatccggacagacgtttcg

SEQ ID NO: 62661 - DNA, 601 bp, Human
caaaactgggaagcagcccgcgtgagcccatccacaggtgaatggacagaccgtggtacccgaacactaacagcagccacgggcgtggactgtggtcacacagcagcagggagccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccragtagctgggactacaggcacccgccaccacacccggctaatttttgtattttcagtagagacggcagttcgccatgttggccaggctggtcccaaactcctgaccttgtcatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtga

SEQ ID NO: 62662 - DNA, 601 bp, Human
agccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccgagtagctgggactacaggcacccgccaccacacccggctaatttttgtattttcagtagagacggcagttcgccatgttggccaggctggtcccaaactcctgaccttgtsatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtgaaatttttttttttgagacggggtcttgctctgtcacccaggctagagtgcagtggtgcgatctccactcactgcaagctctgcctcctgggttcacgccattctcctgcct

SEQ ID NO: 62663 - DNA, 601 bp, Human
caaagtgctgggattacaggcgtgagccaccgcgcctggctgggagttgggtttgtaaatctccctgagtggggctggggcagggaactgctgggtctgggtcttcctggctcctctggtctgtggcttcctgactgcggtggccgggggctcccagggcatcgtggccgtctgtcttgctgagcgtggcacgtgcctttccatgctgtggaggagcgtctcccggtatggcgaactgctggttagggtggggcggtgttgccaggtcatccaggtctggcctctgctctcgacatcgccrgcgctgttgctcatctgcgcttgtgatgttcgatgcctgctgcacatgtcttggcttccctctttcccggcctctgtgagctccagcgctgcgtcccttctcttcctcctgtagagccgcagagcacacaacattgacctgaaggggacagtcgtgatctttgacgaagctcacaacgtggtgagtctccgctggcctcctaaacacctcctattgcttctggcctttttgtcaagagccacgcaaacctttctggaggggctctggccaaactcctgaagccctaggtgcccaggactg

SEQ ID NO: 62664 - DNA, 601 bp, Human
tggcctcttcctttccatgttggtgtccttttttccatgccaggaatcctggttctcaagggcggggttgttggcacgagcgtgatgcagactgcctttgctgcctttctcttgcccagggctgaacatggagctggaagacattgcaaagctgaagagtaagtgttgccctccccgcctccttgcagctgggtggggcctcctccttgcgaggaggtgggtgacacctcctcgacccacagtgatcctgctgcgcctggagggggccatcgatgctgttgagctgcctggagacgacagyggtgtcaccaagccagggaggtgagaggcggggagccagccccttcactgcaggcccagcctagagctagaaacgggccatggtgcagtcctgggctgtcacatcacgagtgaggcctgttttcaggcctgttttccctttttgagacctgggaggagcacctgctttgcatgatctggttgctgagatgttgagaggagcagcacacactcccacgggacagcacacagccccccacggaacggcacacacacccatggaacagcacacacactcccacgaacagcacacacactccca

SEQ ID NO: 62665 - DNA, 601 bp, Human
cgccctgctgccctccaggtgctggagtgttcaccaacacggccggactgcagaagctggcggacattatccaggtggggcctgctcctctgtggcatctccttccctgatggaagccgggcgggtgccttctcctgctgtattagttaactgattctagacttggggatgggagaaaggcccctacaccacctgtttctgattggcaaactctcggctcctttccagtgccctaaacccacactgggcctcctgcagggatgggggaggacgaggtctggtggcacatgcccagggtgaygctggtgagggaggacgcaaaggacagtgggggccggggagccgctcctgccctgtccgggccctcaggccaggggggacccactgctggcagccccagcagccccagctgcacgcagatgaagagctctggacacacgcggcttcctgaacagcttctccagggacagacaaatggggaccctgcaggttcccggcaggggtgtccctgggagcccatgattgggggtgcgaccctggcccccttctcattggccccgtcctgtcctgcaatgcccgtcccatgtgaggtctgcttctg

SEQ ID NO: 62666 - DNA, 601 bp, Human
ctgattggcaaactctcggctcctttccagtgccctaaacccacactgggcctcctgcagggatgggggaggacgaggtctggtggcacatgcccagggtgatgctggtgagggaggacgcaaaggacagtgggggccggggagccgctcctgccctgtccgggccctcaggccaggggggacccactgctggcagccccagcagccccagctgcacgcagatgaagagctctggacacacgcggcttcctgaacagcttctccagggacagacaaatggggaccctgcaggttcccggcrggggtgtccctgggagcccatgattgggggtgcgaccctggcccccttctcattggccccgtcctgtcctgcaatgcccgtcccatgtgaggtctgcttctggctccatgcctatggcagcacctgctttccctggcgtagaggtgcttgtccggtttgtggagggcacgccccattttgggtgctctgggcacgttgcctctccggggcctcggtggcttttttagaagcagactcagaagtccctgactggggaagccaaggcacaggtggctgtgtggagccctgtgaggcctcctc

SEQ ID NO: 62667 - DNA, 601 bp, Human
ttctccagggacagacaaatggggaccctgcaggttcccggcaggggtgtccctgggagcccatgattgggggtgcgaccctggcccccttctcattggccccgtcctgtcctgcaatgcccgtcccatgtgaggtctgcttctggctccatgcctatggcagcacctgctttccctggcgtagaggtgcttgtccggtttgtggagggcacgccccattttgggtgctctgggcacgttgcctctccggggcctcggtggcttttttagaagcagactcagaagtccctgactggggaarccaaggcacaggtggctgtgtggagccctgtgaggcctcctctgtgctgcccacgctgtacctgctggccacacgagatcatggcagggttaggcagggctgcccagcgctatgacagcttcatgagtgtccatctggcctgtggggtgcttgagctgggggaggccgcagaagaaccctgggatgcatggctggcctgtgcatgctgctgggcatggagctgcagatcccggaacaagcaggcactgccttctccttcacagacgcagctctgagcgggggcgagacctgggcagggac

SEQ ID NO: 62668 - DNA, 601 bp, Human
ctctctaagttctgaggatcccatgccgacatacatattctttccttgtctcatgctggtcattttttccattttcatgacaggtttggtgaacacatgtttccttgttgtcagatttttgttctgagcttgtgcctcccgaccaagatgctaaaccgggtcttgtgtattctccaaactgcactgtagagtgacggagctttgtgtctgggcctccatgccttctgacgtcacctgtgggggtgtgaaaggcagactctaccttgatttttcccagcacgccacaccggtggttctgtgygctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtaga

SEQ ID NO: 62669 - DNA, 601 bp, Human
tctctaagttctgaggatcccatgccgacatacatattctttccttgtctcatgctggtcattttttccattttcatgacaggtttggtgaacacatgtttccttgttgtcagatttttgttctgagcttgtgcctcccgaccaagatgctaaaccgggtcttgtgtattctccaaactgcactgtagagtgacggagctttgtgtctgggcctccatgccttctgacgtcacctgtgggggtgtgaaaggcagactctaccttgatttttcccagcacgccacaccggtggttctgtgckctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtagag

SEQ ID NO: 62670 - DNA, 601 bp, Human
cctgacgttttttccatagtgcatcttggagtcagcgtgtctacttcctgtaaaaatcttactgtgattttgactagaatgtgttgaattcctgttttttttttgagtcagggtctctctgttgcccaggctggagtgcagtgggaccatcacagctcactgcagcctcaacctcctgggctcaggggatcctctcagctcaacctcccaagtagctgggaccacaggcacatgccaccatgcccggctaggtttttttttttttttttttggtgaacaccctggggttgcaccatgttgyccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgccgcattttcagtgcatggagatggcctatgttgggggaacacagagctcaccgggggtccctgcagggaggagaaagggtcaggcaggtgccagctcctgtccattggcctggggctg

SEQ ID NO: 62671 - DNA, 601 bp, Human
aggggatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgcygcattttcagtgcatggagatggcctatgttgggggaacacagagctcaccgggggtccctgcagggaggagaaagggtcaggcaggtgccagctcctgtccattggcctggggctgcatgatggcaggggccggtgaaccgatgacccctgggtgtcctgtgaccttctgtgtatgcggctgatgctgcagaaagtcgggtggcctcaggctcctgacggggctgcacttcctctgcctttcagattgtgttcagtgtggacccctccgagggcagccctggttccccagcagggctgg

SEQ ID NO: 62672 - DNA, 601 bp, Human
gatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgccgcaktttcagtgcatggagatggcctatgttgggggaacacagagctcaccgggggtccctgcagggaggagaaagggtcaggcaggtgccagctcctgtccattggcctggggctgcatgatggcaggggccggtgaaccgatgacccctgggtgtcctgtgaccttctgtgtatgcggctgatgctgcagaaagtcgggtggcctcaggctcctgacggggctgcacttcctctgcctttcagattgtgttcagtgtggacccctccgagggcagccctggttccccagcagggctgggggc

SEQ ID NO: 62673 - DNA, 601 bp, Human
acgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacastgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccg

SEQ ID NO: 62674 - DNA, 601 bp, Human
cactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcscatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtcc

SEQ ID NO: 62675 - DNA, 601 bp, Human
gcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggamccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatg

SEQ ID NO: 62676 - DNA, 601 bp, Human
caggcagctccctggtgtgtcccctaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccrgcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatgg

SEQ ID NO: 62677 - DNA, 601 bp, Human
tgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcrccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggaggcgactcacctggctttgtgcgcttcccctcccacctccaaaggctgcctctccctcctagggcagggcccccac

SEQ ID NO: 62678 - DNA, 601 bp, Human
ccccaggcaaggatgccccccgaggctgagactccccccaatagcagggaggacacccacaggcaggaccccaagtgctgggactctcccccaagaggggctttgccacaggcagggaccccagctggggccccccgtgggcttcactgcgcactcgggtgcccctgcagggtcaccagctgccggggaccccgagagtagcctgtgtgtggagtatgagcaggagccagttcctgcccggcagaggcccagggggctgctggccgccctggagcacagcgaacagcgggcggggagcccyggcgaggagcaggtacagttccagggccttgggatggacacagaccctctgtctcctgaggccaacccgaccccgcccatctggcctcaggcacctccccacacacccctgtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaa

SEQ ID NO: 62679 - DNA, 601 bp, Human
gtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaaggtcgggtgcccctgccactggctgcgcttgaggctggcctttctccaggaatgtgctgcgggtggaacccaggttccttcttccttggggccttttgccccagaagcccrtaattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggc

SEQ ID NO: 62680 - DNA, 601 bp, Human
tccaggaatgtgctgcgggtggaacccaggttccttcttccttggggccttttgccccagaagcccataattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggacmaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacac

SEQ ID NO: 62681 - DNA, 601 bp, Human
ctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgsgaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgcatgggaacgcagccgtgggtgcccccagccacggctggtcccgatgggaccagggaatccacccccaggag

SEQ ID NO: 62682 - DNA, 601 bp, Human
cttggccctggcatttccctcaagtgtggatgcacacctgcctcatgtgagggacacagcccattcctagccttggatcaaagaacggagttatagccggagccaggaagccccctgcctgctggaaaaccccaagtgtggcggcctttgtccatgtcccttggcttctgggaagaactgggtggtgcccaggcagggctggtgccatcaggaagtgggtggctgctgaggggcctgggctggcgagggcctgggtggggagtgcctgggccgcccctgccttggtttccacgtttccgtrttggtctggggtgtgtagagagatgggcactgctcatccggaagcccctccttgtgcgctgccatcctgggagcctcagccgcatccgctgtggggcagggggcttgagggaggaggagagagacgggccatgcaggacccctggcttgaggcagagccaatctaccctttgcccattcactgctctcagttccctgccagcctctcactgtgtgacctcagacgggcccagccccacagctttcttcccgcagcccctccctatgtccatccagccagccagtttctcaggcagcagcc

SEQ ID NO: 62683 - DNA, 601 bp, Human
ccatccagccagccagtttctcaggcagcagccccacctcggcagtcactgtcccagggaacgctcaatgttccaaggaaggctctgcagccccagggaccagatgatgaggctggccctgatggagcctcgggcctgtgtcctgcaggaggagcccgtggctggtgcacagacggacagggccaagctcttcatggtggccgtgaagcaggagttgagccaagccaactttgccaccttcacccaggccctgcaggactacaagggttccgatgactttgccgccctggccgcctgtctyggccccctctttgctgaggaccccaagaagcacaacctgctccaaggtgccctggcttgcagaggccacccaccctgagggcagtgctgccgccgcgtgtggggtgggggccatctgggtccaaggtggtctctgttctctagagaaaaaggggcagatggggacagacgccccttcctctacaggcttctaccagtttgtgcggccccaccataagcagcagtttgaggaggtctgtatccagctgacaggacgaggctgtggctatcggcctgagcacagcattccccgaaggcagcg

SEQ ID NO: 62684 - DNA, 601 bp, Human
aacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaarctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctgggga

SEQ ID NO: 62685 - DNA, 601 bp, Human; identical to SEQ ID NO: 62649

SEQ ID NO: 62686 - DNA, 601 bp, Human; identical to SEQ ID NO: 62650

SEQ ID NO: 62687 - DNA, 601 bp, Human; identical to SEQ ID NO: 62651

SEQ ID NO: 62688 - DNA, 601 bp, Human; identical to SEQ ID NO: 62652

SEQ ID NO: 62689 - DNA, 601 bp, Human; identical to SEQ ID NO: 62653

SEQ ID NO: 62690 - DNA, 601 bp, Human; identical to SEQ ID NO: 62654

SEQ ID NO: 62691 - DNA, 601 bp, Human; identical to SEQ ID NO: 62655

SEQ ID NO: 62692 - DNA, 601 bp, Human; identical to SEQ ID NO: 62656

SEQ ID NO: 62693 - DNA, 601 bp, Human; identical to SEQ ID NO: 62657

SEQ ID NO: 62694 - DNA, 601 bp, Human; identical to SEQ ID NO: 62658

SEQ ID NO: 62695 - DNA, 601 bp, Human; identical to SEQ ID NO: 62659

SEQ ID NO: 62696 - DNA, 601 bp, Human; identical to SEQ ID NO: 62660

SEQ ID NO: 62697 - DNA, 601 bp, Human; identical to SEQ ID NO: 62661

SEQ ID NO: 62698 - DNA, 601 bp, Human; identical to SEQ ID NO: 62662

SEQ ID NO: 62699 - DNA, 601 bp, Human; identical to SEQ ID NO: 62663

SEQ ID NO: 62700 - DNA, 601 bp, Human; identical to SEQ ID NO: 62664

SEQ ID NO: 62701 - DNA, 601 bp, Human; identical to SEQ ID NO: 62665

SEQ ID NO: 62702 - DNA, 601 bp, Human; identical to SEQ ID NO: 62666

SEQ ID NO: 62703 - DNA, 601 bp, Human; identical to SEQ ID NO: 62667

SEQ ID NO: 62704 - DNA, 601 bp, Human; identical to SEQ ID NO: 62668

SEQ ID NO: 62705 - DNA, 601 bp, Human; identical to SEQ ID NO: 62669

SEQ ID NO: 62706 - DNA, 601 bp, Human; identical to SEQ ID NO: 62670

SEQ ID NO: 62707 - DNA, 601 bp, Human; identical to SEQ ID NO: 62671

SEQ ID NO: 62708 - DNA, 601 bp, Human; identical to SEQ ID NO: 62672

SEQ ID NO: 62709 - DNA, 601 bp, Human; identical to SEQ ID NO: 62673

SEQ ID NO: 62710 - DNA, 601 bp, Human; identical to SEQ ID NO: 62674

SEQ ID NO: 62711 - DNA, 601 bp, Human; identical to SEQ ID NO: 62675

SEQ ID NO: 62712 - DNA, 601 bp, Human; identical to SEQ ID NO: 62676

SEQ ID NO: 62713 - DNA, 601 bp, Human; identical to SEQ ID NO: 62677

SEQ ID NO: 62714 - DNA, 601 bp, Human; identical to SEQ ID NO: 62678

SEQ ID NO: 62715 - DNA, 601 bp, Human; identical to SEQ ID NO: 62679

SEQ ID NO: 62716 - DNA, 601 bp, Human; identical to SEQ ID NO: 62680

SEQ ID NO: 62717 - DNA, 601 bp, Human; identical to SEQ ID NO: 62681

SEQ ID NO: 62718 - DNA, 601 bp, Human; identical to SEQ ID NO: 62682

SEQ ID NO: 62719 - DNA, 601 bp, Human; identical to SEQ ID NO: 62683

SEQ ID NO: 62720 - DNA, 601 bp, Human; identical to SEQ ID NO: 62684

SEQ ID NO: 62721 - DNA, 601 bp, Human
ccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgygcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggtgagagctgggcgaggggaggg

SEQ ID NO: 62722 - DNA, 601 bp, Human
gctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgygcctgccgctgccgcaccggcttcttcgcgcacgctggtttctgcttggagcacgcatcgtgtccacctggtgccggcgtgattgccccgggtgagagctgggcgaggggaggggcccccaggagtggtggccggaggtgtggcaggggtcaggttgctggtcccagccttgcaccctgagctaggacaccagttcccctgaccctgttcttccctcctggctgcaggcacccccagccagaacacgcagtgccagccgtgccccccaggcaccttctcagccagcagttccagctcaga

SEQ ID NO: 62723 - DNA, 601 bp, Human
caatgtgccaggctcttcctcccatgacacgctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggrgagctctgggaaagtgggcagcaatctcctaactgcccgaggggaaggtggctggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaag

SEQ ID NO: 62724 - DNA, 601 bp, Human
gtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggggagctctgggaaagtgggcagcaatctcctaactgcccgaggggaaggtggctggctcctctgacacggrgaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaaggtccgagtggccgctcctgccccctaggcctttgctccagctctctgaccgaaggctcctgccccttctc

SEQ ID NO: 62725 - DNA, 601 bp, Human
agtgggcagcaatctcctaactgcccgaggggaaggtggctggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaaggtccgagtggccrctcctgccccctaggcctttgctccagctctctgaccgaaggctcctgccccttctccagtccccatcgttgcactgccctctccagcacggctcactgcacagggatttctctctcctgcaaaccccccgagtggggcccagaaagcagggtacctggcagcccccgccagtgtgtgtgggtgaaatgatcggaccgctgcctccccaccccactgcaggagctgaggagtgtgagcgtgccgtcatcgactttgtggctttccaggacatctccatcaagaggctgcagcggctgctg

SEQ ID NO: 62726 - DNA, 601 bp, Human; identical to SEQ ID NO: 26972

SEQ ID NO: 62727 - DNA, 601 bp, Human; identical to SEQ ID NO: 26973

SEQ ID NO: 62728 - DNA, 601 bp, Human; identical to SEQ ID NO: 26974

SEQ ID NO: 62729 - DNA, 601 bp, Human; identical to SEQ ID NO: 26975

SEQ ID NO: 62730 - DNA, 601 bp, Human; identical to SEQ ID NO: 26976

SEQ ID NO: 62731 - DNA, 601 bp, Human; identical to SEQ ID NO: 26977

SEQ ID NO: 62732 - DNA, 601 bp, Human; identical to SEQ ID NO: 26978

SEQ ID NO: 62733 - DNA, 601 bp, Human; identical to SEQ ID NO: 26979

SEQ ID NO: 62734 - DNA, 601 bp, Human; identical to SEQ ID NO: 26980

SEQ ID NO: 62735 - DNA, 601 bp, Human; identical to SEQ ID NO: 26981

SEQ ID NO: 62736 - DNA, 601 bp, Human; identical to SEQ ID NO: 26982

SEQ ID NO: 62737 - DNA, 601 bp, Human; identical to SEQ ID NO: 26983

SEQ ID NO: 62738 - DNA, 601 bp, Human; identical to SEQ ID NO: 26984

SEQ ID NO: 62739 - DNA, 601 bp, Human; identical to SEQ ID NO: 26985

SEQ ID NO: 62740 - DNA, 601 bp, Human; identical to SEQ ID NO: 26986

SEQ ID NO: 62741 - DNA, 601 bp, Human; identical to SEQ ID NO: 26987

SEQ ID NO: 62742 - DNA, 601 bp, Human; identical to SEQ ID NO: 26988

SEQ ID NO: 62743 - DNA, 601 bp, Human; identical to SEQ ID NO: 26989

SEQ ID NO: 62744 - DNA, 601 bp, Human; identical to SEQ ID NO: 26990

SEQ ID NO: 62745 - DNA, 601 bp, Human; identical to SEQ ID NO: 26991

SEQ ID NO: 62746 - DNA, 601 bp, Human; identical to SEQ ID NO: 26992

SEQ ID NO: 62747 - DNA, 601 bp, Human; identical to SEQ ID NO: 26993

SEQ ID NO: 62748 - DNA, 601 bp, Human; identical to SEQ ID NO: 26994

SEQ ID NO: 62749 - DNA, 601 bp, Human
gactctcagaaaagcctgagaaaatgcatgccgttatcagtaggcaacactcaggaaaagaaatgaagccttaaagagaaacacacacgtaagacttttatgcaatggctgggggagaaaagctgaggaaagagactggtcagacaagccaaggaaggtatggactgggaggaaacggatgaaggaagcactgcctcatggacaactgcacacgaacaaaaacatcgtttcactccgttcaggcccaggaatttaactgggataacccgggcagccgttctccgggtgtcaggggaccaarcaccatcagcccaacatctcctccatcctgttctccctcttcttgaaacccgtagaaatcaatggctggcagagactccgatacgcaccggcgactcgccaaggcacaggaacaaacctactccggttatttgcccccaaatttcagcagcagacccttcactcacctccacaggagccaagatggcggtaagagaaggacgaggccccgccgcgtggccttgtgggattaaacatctttcgactccgccctcaatttaggcatcttctccaaacgccagaaaaacaatcctcggaaatc

SEQ ID NO: 62750 - DNA, 601 bp, Human
aaaaacatgtactggccaggtgctgtggctcacacctgtaatcccatcactttgggaggcctaggcgggcagatcctaaggtcaagagatagagaccatcctggccaacatggtaaaaccctgtctctactaaaaaatacaaaaatcagctgggcatggtggtacgtgcctatagtcccagctacgcaggaggctgaggcaggagaatcgcttgaacctgggagcttgcagtgaggcaagatcccaccactgcactccagcctggtgacagaatgagactctggtctcaaaaaaaaaaaaagaaaaagaaaaacatgtactgaaggtacatttaattttgcttcttctaaagacagagtaaaagcctcctctgttgataaaccctaatgaaccacttagcagggttcaacagtaccccctggccccaagaatacatggtatgcatatattcttggtcccaagaatatacagtctacattccaaaatggaccctaaagaaaaagtacgaactatttgagaaaaattacaggagaaaattgagaaaaatttagagtccaaggctggcaccaaagacctgagacctaggaacatgagagtctgt

SEQ ID NO: 62751 - DNA, 601 bp, Human
gaccttggcacctgccgttccctgtgtcagagtgttctccatccaggatacatccacgacactcatgccttcacttccttcaagtctgctgaaatgtcaccttcccctctgcacgcctagcattccctatccctcctccctgcgtcacgtctcacccctccactcatcaccatttgacatagaccacgcggaaccgtttgtccgcaacctgccgcagacacagtacaactcctcagaatcctcccacggagggtggcacacggaatgtgttctgttttgcacctagcgccgggtctggcaygtgacaggcctgcaatcatgttcactgaatgaatgactgaattctatcaatgattgacctttacatagtcatgaaggagcttgttaaaaactagaatttcttggtcctgcccattgcccagtttcatcttcaccgtcaccctgggaggtattgtccccatttcacagagagggacgctgaggctagtagtggagctggaactcaaactcaagtcctccaattccaaaatagccctccttttataaaccacactgcccaggaaggagggcccaggtaggcactgcccagctgccagcacac

SEQ ID NO: 62752 - DNA, 601 bp, Human
ctgtgacctctctgccctcacccggttattctctgcctctctcattccatcccagccacacctgcctcctcactgctcctcagacaggcctgcagcttccacccccaggaccttggcacctgccgttccctgtgtcagagtgttctccatccaggatacatccacgacactcatgccttcacttccttcaagtctgctgaaatgtcaccttcccctctgcacgcctagcattccctatccctcctccctgcgtcacgtctcacccctccactcatcaccatttgacatagaccacgcggarccgtttgtccgcaacctgccgcagacacagtacaactcctcagaatcctcccacggagggtggcacacggaatgtgttctgttttgcacctagcgccgggtctggcacgtgacaggcctgcaatcatgttcactgaatgaatgactgaattctatcaatgattgacctttacatagtcatgaaggagcttgttaaaaactagaatttcttggtcctgcccattgcccagtttcatcttcaccgtcaccctgggaggtattgtccccatttcacagagagggacgctgaggctagtagtgg

SEQ ID NO: 62753 - DNA, 601 bp, Human
tccctgtgacctctctgccctcacccggttattctctgcctctctcattccatcccagccacacctgcctcctcactgctcctcagacaggcctgcagcttccacccccaggaccttggcacctgccgttccctgtgtcagagtgttctccatccaggatacatccacgacactcatgccttcacttccttcaagtctgctgaaatgtcaccttcccctctgcacgcctagcattccctatccctcctccctgcgtcacgtctcacccctccactcatcaccatttgacatagaccacgckgaaccgtttgtccgcaacctgccgcagacacagtacaactcctcagaatcctcccacggagggtggcacacggaatgtgttctgttttgcacctagcgccgggtctggcacgtgacaggcctgcaatcatgttcactgaatgaatgactgaattctatcaatgattgacctttacatagtcatgaaggagcttgttaaaaactagaatttcttggtcctgcccattgcccagtttcatcttcaccgtcaccctgggaggtattgtccccatttcacagagagggacgctgaggctagtag

SEQ ID NO: 62754 - DNA, 601 bp, Human
ctctaacttgaaaaaaactcaaaggcaaggtatttctccaaccaaaattgcttcggtggctcccatctcagtcagaacagagcctgagtgacccctgtgacctgtccaacctcagcctgagtgatccctgtgacctctctgccctcacccggttattctctgcctctctcattccatcccagccacacctgcctcctcactgctcctcagacaggcctgcagcttccacccccaggaccttggcacctgccgttccctgtgtcagagtgttctccatccaggatacatccacgacactcaygccttcacttccttcaagtctgctgaaatgtcaccttcccctctgcacgcctagcattccctatccctcctccctgcgtcacgtctcacccctccactcatcaccatttgacatagaccacgcggaaccgtttgtccgcaacctgccgcagacacagtacaactcctcagaatcctcccacggagggtggcacacggaatgtgttctgttttgcacctagcgccgggtctggcacgtgacaggcctgcaatcatgttcactgaatgaatgactgaattctatcaatgattgacctttaca

SEQ ID NO: 62755 - DNA, 601 bp, Human
acttgtctaattcattccttagtacaaattaccagtagaggaattcctgagtcaaaagttatgcactttttttctctttgtgtgtgtgtatgacaaaatatacataatataagccactttaactgttcttaagtatacagttcagtggcattaagtatattcacaacgttgtgccaccatcaccaccattcatctccagagctttttcatcatcccagaccgaaactctgtacacgttaaacactaactccccattcccctctctccccagcccctggtaggtgtgattctactttctgtytctatgcatttgcctattctaggtaccttatgaaagtgtaattatacagtgcttatctctttgtgcctggcttatttcactcagcatgcatgcctccaagattgatccaggtcatagcatgaattcccttctttttgaaggctacgtactattcccttgtgtgaacctaccactttctgtttatctgttcatctgttcatggatattttggttgtttccacctttggggtatgcacattttttaaatacgcatttccaaattgttctccaaaactcttgcaccaatctgcattcctgaca

SEQ ID NO: 62756 - DNA, 601 bp, Human
tacaagggtattgggtgctacacaaagagcaccattggggtttatccagtggcatgagaagccattcatagtatatttttctttcttttttcttttctttttttttttttttttttttgagatggagtcttgttctgttgtccaggctggagtgcagtggcacagtctcggctcactggaacctccacttcccgggttcaagcgatcctcccacctcagcctccggagtagctgggaccacagacagacccggctaattttaactttttttttgtagagacgggagaaggggagggtctcrctatgctgcccaggctggtctcgaactcccgggctcaggcgatcctcctgcctcagcctcccgaagtgctcactacttaacgaaggactgtggacctttcagaacagcctggctgaaaaatcaatgctgactatgaacaaaacctctcctttggggcccggcgagcccaccctggcaaggacgggttccaccgcggtctccaccgcgcagcggcgttggggcggcccgggcgtccgccgcgggggtgggcgtggcgctgcgcgggagggacccgcagacggcagagggtccgcggggagc

SEQ ID NO: 62757 - DNA, 601 bp, Human
ggatacctgtgttccaaaagttgttgcaggtcgtccagggcagctcagaggtgaaggagctgaacaggtagaagagagcccaggcaaggatgatgatgtagtagacattcaaatatgactcgatgaccacagatgccagaccaatgccttccagagtgggggagagatggggagggacaagagagatcaatgttagcaaaaaagtcacatagaagctgccagttgaggttacaagggtattgggtgctacacaaagagcaccattggggtttatccagtggcatgagaagccattcatagyatatttttctttcttttttcttttctttttttttttttttttttttgagatggagtcttgttctgttgtccaggctggagtgcagtggcacagtctcggctcactggaacctccacttcccgggttcaagcgatcctcccacctcagcctccggagtagctgggaccacagacagacccggctaattttaactttttttttgtagagacgggagaaggggagggtctcactatgctgcccaggctggtctcgaactcccgggctcaggcgatcctcctgcctcagcctcccgaagtgctc

SEQ ID NO: 62758 - DNA, 601 bp, Human
aaagtccgtgcaatgctctgttggggacaaggttagggacaagatggagagagatgctcttataccctagtccccctggccctctggccttgcagcctagtggtcctcaccactcctagccccaagagcttcttttggagcccccactctccagggcatcaggaggctcatagggccagctcttcctccccctgctcttgttccctgtgaatctgcctgctcacctggctgccctgccaacctcagacagtatccagacttcagatctactcagtcccctcatgggcggctggtacggaaygcactctccccgcttgcccgttctgacttcctgtctctccacttggcaggccaagggactgcggccctgcacctgctcttccccctgcttggaatgctgcccccatgctgggctctctctcacttcaggcctcagatgacacttctccctccccttgttctatggtttctgcagtttcgttcacctatcacaatttgtagtggttgtgtttatttgtctgttcttaccaccagactgtaaacacagtgaaggctgggtccctgctgcttttgctcagcctcgtaccaatctccagccctt

SEQ ID NO: 62759 - DNA, 601 bp, Human
ctttttttttttttttttttttgagacggagtctggctgtcgcccaggctggagtgcagtggcgctatctcggctcactgcaagctccgcctcccgggttcacgccattctcctgcctcagcctcctgcatagctgggactacaggtgcccaccaccacgcccggctaattttttgtatttttagtagagacggggttttaccgtgttagccaggatggtctcgatctcctgacctcgtgatccgcccgcctcggcctcccaaagtgctgggattacaggcgtgagccactgcacccggcmgccctgaatattcttatgtaaaccggacttttaaagtcatattgaaaaagaaagactttccttgcatcgagctaagctccgccttcctgtggctccccctgttctcactaggcatctcccctgccctgctcaggaagtgtagtttcttaatagaaagaaatcagttctccagagggtccccctcaagtgtccccgtagactctgggggccaaagggagcttcccaggaggcaggacatctcaccttgcctgtggacttgacccccttccagatgcagaaatagcagatgacccaggcgag

SEQ ID NO: 62760 - DNA, 601 bp, Human
agggattagctccaacaatgagatttttctgtttctaatttgccctgaatattctttttttttttttttttttttgagacggagtctggctgtcgcccaggctggagtgcagtggcgctatctcggctcactgcaagctccgcctcccgggttcacgccattctcctgcctcagcctcctgcatagctgggactacaggtgcccaccaccacgcccggctaattttttgtatttttagtagagacggggttttaccgtgttagccaggatggtctcgatctcctgacctcgtgatccgccmgcctcggcctcccaaagtgctgggattacaggcgtgagccactgcacccggccgccctgaatattcttatgtaaaccggacttttaaagtcatattgaaaaagaaagactttccttgcatcgagctaagctccgccttcctgtggctccccctgttctcactaggcatctcccctgccctgctcaggaagtgtagtttcttaatagaaagaaatcagttctccagagggtccccctcaagtgtccccgtagactctgggggccaaagggagcttcccaggaggcaggacatctcaccttg

SEQ ID NO: 62761 - DNA, 601 bp, Human
cacataatggatacagacacacacacatacgtatgagagaaaccagaaggcaacacagcaaaaatgaacagagattagcagtgccaacctgccagcagggattagctccaacaatgagatttttctgtttctaatttgccctgaatattctttttttttttttttttttttgagacggagtctggctgtcgcccaggctggagtgcagtggcgctatctcggctcactgcaagctccgcctcccgggttcacgccattctcctgcctcagcctcctgcatagctgggactacaggtgcccrccaccacgcccggctaattttttgtatttttagtagagacggggttttaccgtgttagccaggatggtctcgatctcctgacctcgtgatccgcccgcctcggcctcccaaagtgctgggattacaggcgtgagccactgcacccggccgccctgaatattcttatgtaaaccggacttttaaagtcatattgaaaaagaaagactttccttgcatcgagctaagctccgccttcctgtggctccccctgttctcactaggcatctcccctgccctgctcaggaagtgtagtttcttaat

SEQ ID NO: 62762 - DNA, 601 bp, Human
ctcactctccccctgcacagattgtaagtgtgtgagaccaaccagcctggcacgcagtcatgcattggctcagtgaatcgggcttcttccccttcctggtgtaggacatggtcaccccctggctgttgcagcattcagtatggtagctatctcagtctgagggggccaggctgctggcggaagtcagtgaaaggcagaattcacctcagtacaggagagaaatgcataaatggaaaagactccctcaaaaacacaggaatgagctccctgtccatggaagtactcagagtctgggtgatcrcctcgttgttggaaaggcagtgtgggagtttgcggaggatcgggctaagtggcaataaacgtcccttctgactaagattcccagtggcacagggcctcaggccacctccatatcgaggacactgtgcgctgtgcactgttattgatcattctctcactgttgaaggaaatccattttgtcatcattacagctctgcttgctgccatgaaaatgccaggcttcccagccacgggtaaatttcccagtaagaagaagcagggcaacagcgcaaagacacacagaaaccaggggaccagagaa

SEQ ID NO: 62763 - DNA, 601 bp, Human
ctccagaggaaccacctctgagttcccaaaaaagcatggtaagaaggttaatttgtgtttagtgaaaacattgactggctgtattttttgttgtttcactcctgcagtttccacatttgctgtagttctaggcagagccagtcttctaagaagcaaagaatcactgaatggtaaagatacttggagggcctctctaccttcccacccaaaataccttcccaccgatccctgatgcatgaaatcacaccattaaagagtggttcctttgactgtgaaaagccaaagttaaaagccagatatkgccaggtgagtgaagcatgttgaggcttatcagccattcacacctgttgtgaccaagtttagcaggtcctctctgagaagttttgaaaaggagttggggaaattcggaaggcatcagatgcctgaggtgagaaggaaggaacgtctccatggagaggaaaggacacaagtgggaaggcttagggcagcaaaataaagtcttttctactcatggctgttcctgaggccctactgtgtggcacccactggccctctgccctgaaccttgtgacattggcactgggttcccccaagcggtgca

SEQ ID NO: 62764 - DNA, 601 bp, Human
tgagcccaaaatggggctcaatggttagacaaacgcctgtttacccgggtagcagagatgaatttggttcaagccaaaacagcaaaacaacaaggctcccgctgttcagacacatcatagaaaactcatagagggctagagggctactgggaacagaacggtggtctagattgcagactccagaggaaccacctctgagttcccaaaaaagcatggtaagaaggttaatttgtgtttagtgaaaacattgactggctgtattttttgttgtttcactcctgcagtttccacatttgctgtrgttctaggcagagccagtcttctaagaagcaaagaatcactgaatggtaaagatacttggagggcctctctaccttcccacccaaaataccttcccaccgatccctgatgcatgaaatcacaccattaaagagtggttcctttgactgtgaaaagccaaagttaaaagccagatatggccaggtgagtgaagcatgttgaggcttatcagccattcacacctgttgtgaccaagtttagcaggtcctctctgagaagttttgaaaaggagttggggaaattcggaaggcatcagatgcct

SEQ ID NO: 62765 - DNA, 601 bp, Human
tgcactgcagcacgtctgtaaggtggaagagtaaaagcccctgcaaatcccaggccaaggcatcattcacatcacagacggagacaggaggcgatacaaaggaagggaggggctcggaagagcatcattcacatcacagacggagacaggaggcgatacaaaggaagggaggggctcggaagagcatcattcacatcacagacggagacagggggtgatacaaaggaagggaagggctcagaagagaagctcagacagacaggagaccaaccatcgagaaatcaggcagaagcaggaggcmctgtgaggaagggatggagccggaagtaggaagtagaacaagattctacttatgggtggatgagatggccccagaaagaagagcagggaaggcaacatagaacaggaaatggaccaggccccacgggagactggacaggtggggaaagagccctgcatgtcagccgtcctttccctcatctctggagtcttctgggggcaggaaggaatagaggggcagctggtgggcacataccaggcaaagtccaggggtcaggaagagccaggagatcttcaccaggggccatggccggtagccaat

SEQ ID NO: 62766 - DNA, 601 bp, Human
ggtgagatagggggcgactgaaaccctctccgcagctacgtacagccaaggacagaggacaagtcaggtgcactgcagcacgtctgtaaggtggaagagtaaaagcccctgcaaatcccaggccaaggcatcattcacatcacagacggagacaggaggcgatacaaaggaagggaggggctcggaagagcatcattcacatcacagacggagacaggaggcgatacaaaggaagggaggggctcggaagagcatcattcacatcacagacggagacagggggtgatacaaaggaagggargggctcagaagagaagctcagacagacaggagaccaaccatcgagaaatcaggcagaagcaggaggccctgtgaggaagggatggagccggaagtaggaagtagaacaagattctacttatgggtggatgagatggccccagaaagaagagcagggaaggcaacatagaacaggaaatggaccaggccccacgggagactggacaggtggggaaagagccctgcatgtcagccgtcctttccctcatctctggagtcttctgggggcaggaaggaatagaggggcagctggtgggcacat

SEQ ID NO: 62767 - DNA, 601 bp, Human
tagatttctacctttgtgggtcattggctatagctccttccaggaggatatgtcccaaactctagacagggagcctcttgcgtgtgtccccaggcagagttaagaaaagaagccaggagcctgtgtgtggagtgaactgtgcttgctggttatcagttttccgagggcaaggaatctatagtcttgtaaaccttctgtgtctgggcaccttcctgttcatgtttgtgacttagttttctcctgaacctttcagcagtttgccctccgttagcctgcccagatcatccatgggaggtcagaktctgtaggtctaggactctaggacttttcagagcatttctgaaaagccactggactggtcttcaaagttcgtctcgttaagattctgtgagactgaagggctgccccacactcagagtttgtgtctgctccctggccccagttgtgtgtcctgccccaagtccagcctctctcagtgccctcctttaagaggtcactctcccctacaccacctaccttcctgaaaggaccccgagtcttcaggagggtgatgacgacgaagagtgggacacagaccatggaggacagagccaggaaccag

SEQ ID NO: 62768 - DNA, 601 bp, Human
agagcggagcacatggccagcaccgcacagtatgagtgagtcaatgaatgaaccgtttgaggtgagaagggaggcagcaataccgtgactacgaatgagtgtgcgctgcctgggttccagtcctggctctgctgccgacctgcgccacctaaggctgctcacttaacccctctgttaatccccctcaattttcttacctgtaaattgagaataatagtagaatgcacctcacagaacagtgcttggcacagagtaagtgatcaataaatatctatttttgttattgtcattattgttattactattattatgtgctcaataagtatctattatttttcttcttatcagtggtactgctacgactgttggtggtggtggtggtggtgccatctgctccctccttcttgccttgaatgcagatgtgatgactggaatcgtgacagccatcttgtgaccatgaggtgataaacgtgatgatgaaaacacagcatgcccaggatggaagtgtagaaatgcaggaaaagtctggtccctaagggcctctttaagcagccaaaccaaataccagcagccctaatctctgaccttcttgaaacataaa

SEQ ID NO: 62769 - DNA, 601 bp, Human; identical to SEQ ID NO: 29251

SEQ ID NO: 62770 - DNA, 601 bp, Human
ggcatgagccaccatgcccggccccatttccaccatcttcagaggccaaatgccgggatgctgtgagttgaggaagaccctggtgggtgggcctgggaacccaggcaccttttaaaaagtcacattagtcccaaaccagtgactcagaagcttctggaacacagcccactgtaagctggggcctcctgccttcgatctcaggctcccaatcggaccttgagagctctctgcccctcctgctctgttcccaaagctgcctcccaggcactgcttgcatgccaaggtcaggctcccctgggaygctaatatttttattcttgatttctatctttttttttctgttttctaagttttagggttttatgtcttagcaatactcaaaggagaacaatcatgagtttagaagtgatctccgagtagccacgtggtggggcacccaggccccggcccagccctgtggccataccttctcagtccttttccctggaagctccaggagcctcaaaataagctccttgtccacctgaggagatggagctagagagaccagtcatcctcagacctcagaccttagaacctgggatgcctgggcatggtggct

SEQ ID NO: 62771 - DNA, 601 bp, Human
agtggtgcgatctcggctcactacaatctctgcctcctaggttcaagtgattctcctgcctcagtctcctgtgtagctgggattataagcacgccccatcacacctggctaatttttgtatttttagtagagatgcggtttcgccatgttggccaggctggtcttgaactcctgacctcaggtgatccgcccgcctcagcctgccaaagttctgggattacaggcatgagccaccatgcccggccccatttccaccatcttcagaggccaaatgccgggatgctgtgagttgaggaagacyctggtgggtgggcctgggaacccaggcaccttttaaaaagtcacattagtcccaaaccagtgactcagaagcttctggaacacagcccactgtaagctggggcctcctgccttcgatctcaggctcccaatcggaccttgagagctctctgcccctcctgctctgttcccaaagctgcctcccaggcactgcttgcatgccaaggtcaggctcccctgggatgctaatatttttattcttgatttctatctttttttttctgttttctaagttttagggttttatgtcttagcaatactc

SEQ ID NO: 62772 - DNA, 601 bp, Human
gtgaatgattgctgtgtaatttgcaggtgtgaaagaaactgcacatccacagcttcctcatgttttacttggtgaaaaaaggtcttaacaggctcttcattccatgagagaattttgctcccaaatagcctttctgctctgaagtaagggtacaaaatatttgtcagcagttcctagtccctactttgccaaatgctaaaggcacgccccgcccaccaccacccccaaccatcctggctgccttccccattgtccgcactcattggccgctggtcctgcaggtcctggtcctgagcccagycccctccttcctcctcacccagcccaggggcagtttagggcagtaaagggcaagtaattccgtaacaggtcctggggcaggacccaggccaggggagcgaaatgggcaaacactgccagcctcggctcctcctgatccatctgtcctcccttccggctgctctgggcctgtgttgcctcttgggatgggggacccatggagcagcaatcagtgctccatggaacacagacaaatgagccctgggctgggagtcaacgcctgggctcccgtcctgtttctgccaccaaagtgatgggtgac

SEQ ID NO: 62773 - DNA, 601 bp, Human
tccctacggcagctccctccagcccctaggagcaaatgttcctttgctgggtgaatgattgctgtgtaatttgcaggtgtgaaagaaactgcacatccacagcttcctcatgttttacttggtgaaaaaaggtcttaacaggctcttcattccatgagagaattttgctcccaaatagcctttctgctctgaagtaagggtacaaaatatttgtcagcagttcctagtccctactttgccaaatgctaaaggcacgccccgcccaccaccacccccaaccatcctggctgccttccccatwgtccgcactcattggccgctggtcctgcaggtcctggtcctgagcccagtcccctccttcctcctcacccagcccaggggcagtttagggcagtaaagggcaagtaattccgtaacaggtcctggggcaggacccaggccaggggagcgaaatgggcaaacactgccagcctcggctcctcctgatccatctgtcctcccttccggctgctctgggcctgtgttgcctcttgggatgggggacccatggagcagcaatcagtgctccatggaacacagacaaatgagccctgggctggga

SEQ ID NO: 62774 - DNA, 601 bp, Human
gaccctccactgatgcccatctgcatactctccacggagggatgacggcttctttcccgtcccgggtcagtggaggagcccagggccaaagagccaggactggcttgagtttgcctcctcttgctctgtgtcctgcacacctctccctgcagcctgcttcctgaaggctgaaagcccccaggcctgctgcttcctgcccaccgcacctcacaccagctcctgtcccgattcagccccctgcctttctcaagtactcctggccacgtgcccacagggaacatcgtcatgggcttctcccttcttgcatccaattcccatggggagaagggggtgcctcctgttataccttagggactgccatctcttggcactgttcagctacgttgcttagcaaagacatttgggggcagccagaaaagtaggaggcccagatgcctgggttccagagaaagagaggctttcagggaagtcccccaacccacctttctcactcatcagtgacccctcccctgtaatccagccccactacctcctctcaacctcactgagcctcagtccccttatctgtgaaatggagccagtaacatccaggattaaatgg

SEQ ID NO: 62775 - DNA, 601 bp, Human
gtgtgcctgcatgtgcatataaaactacccagttacccacccctggcccagccctgggcttccgtttcctctctagaaaaactcgctgactataaagcgctgatttaaaataataaacacgaggagtccagtgttcacagcaaaatgtcagggaaataatgtggatgaaaggtggggcctaaattgcatatgcatgatgatgacaaactgggaaagctctgtttatacacagatcggggtcagaaaaggccacagaaagctgcgacagggaaaggatggaggggttgattttctgcaaagytgtttacatgttcaatgactgattattcctcctcacatgcagctgaatctgatggccctgcagtccccttctacgcacgtcatcattgttctggtccctggaccctccactgatgcccatctgcatactctccacggagggatgacggcttctttcccgtcccgggtcagtggaggagcccagggccaaagagccaggactggcttgagtttgcctcctcttgctctgtgtcctgcacacctctccctgcagcctgcttcctgaaggctgaaagcccccaggcctgctgcttcctgccca

SEQ ID NO: 62776 - DNA, 601 bp, Human
tgaagaaactgcagaatgccaataaccctggcatcccagccattccatctgacggagggtttacccagaaggctgggcagaccaagcccaggagtgagcacgcatgtgtgtgtgtgtgtgtgtgtgtgtgtgtgtgctgtgtgtgtgtgtgtgcatgtgtgtgtgtgtgtgtgtgcctgcatgtgcatataaaactacccagttacccacccctggcccagccctgggcttccgtttcctctctagaaaaactcgctgactataaagcgctgatttaaaataataaacacgaggagtccartgttcacagcaaaatgtcagggaaataatgtggatgaaaggtggggcctaaattgcatatgcatgatgatgacaaactgggaaagctctgtttatacacagatcggggtcagaaaaggccacagaaagctgcgacagggaaaggatggaggggttgattttctgcaaagttgtttacatgttcaatgactgattattcctcctcacatgcagctgaatctgatggccctgcagtccccttctacgcacgtcatcattgttctggtccctggaccctccactgatgcccatctgcatactc

SEQ ID NO: 62777 - DNA, 601 bp, Human
ctgggcaacatggtgaaactctgtctctatttgaaaaaaaaaaaaaggaagaagaaaaagaaaaaaagaaaaaacaaaaagaatgtgtaatttggtgggggggcagccaggggcagagggtggtgttggaatatttacccagcattagaccaccctcgtgggatttgctgtttgtttatgaagaaactgcagaatgccaataaccctggcatcccagccattccatctgacggagggtttacccagaaggctgggcagaccaagcccaggagtgagcacgcatgtgtgtgtgtgtgtgtgygtgtgtgtgtgtgctgtgtgtgtgtgtgtgcatgtgtgtgtgtgtgtgtgtgcctgcatgtgcatataaaactacccagttacccacccctggcccagccctgggcttccgtttcctctctagaaaaactcgctgactataaagcgctgatttaaaataataaacacgaggagtccagtgttcacagcaaaatgtcagggaaataatgtggatgaaaggtggggcctaaattgcatatgcatgatgatgacaaactgggaaagctctgtttatacacagatcggggtcagaaaaggccac

SEQ ID NO: 62778 - DNA, 601 bp, Human
gcctgggcaacatggtgaaactctgtctctatttgaaaaaaaaaaaaaggaagaagaaaaagaaaaaaagaaaaaacaaaaagaatgtgtaatttggtgggggggcagccaggggcagagggtggtgttggaatatttacccagcattagaccaccctcgtgggatttgctgtttgtttatgaagaaactgcagaatgccaataaccctggcatcccagccattccatctgacggagggtttacccagaaggctgggcagaccaagcccaggagtgagcacgcatgtgtgtgtgtgtgtgagtgtgtgtgtgtgtgctgtgtgtgtgtgtgtgcatgtgtgtgtgtgtgtgtgtgcctgcatgtgcatataaaactacccagttacccacccctggcccagccctgggcttccgtttcctctctagaaaaactcgctgactataaagcgctgatttaaaataataaacacgaggagtccagtgttcacagcaaaatgtcagggaaataatgtggatgaaaggtggggcctaaattgcatatgcatgatgatgacaaactgggaaagctctgtttatacacagatcggggtcagaaaaggcc

SEQ ID NO: 62779 - DNA, 601 bp, Human
atgggcctcgacctacgcacaatgtgtctctgagtctccgtgttggtgatagcacatacccgtggaatctattatcaagaacgtgtaatttggtgatggctgggcatggtggctcacacctgtaatccagcactttaggaggccgaggtgggtgaaccgcctgagctcaggagttcaggcccagcctgggcaacatggtgaaactctgtctctatttgaaaaaaaaaaaaaggaagaagaaaaagaaaaaaagaaaaaacaaaaagaatgtgtaatttggtgggggggcagccaggggcaragggtggtgttggaatatttacccagcattagaccaccctcgtgggatttgctgtttgtttatgaagaaactgcagaatgccaataaccctggcatcccagccattccatctgacggagggtttacccagaaggctgggcagaccaagcccaggagtgagcacgcatgtgtgtgtgtgtgtgtgtgtgtgtgtgtgtgctgtgtgtgtgtgtgtgcatgtgtgtgtgtgtgtgtgtgcctgcatgtgcatataaaactacccagttacccacccctggcccagccctgggcttccgtttc

SEQ ID NO: 62780 - DNA, 601 bp, Human
agctcactgcactctctgcctcccaagttcaagcaattctcctgcctcagcctccccagtagctgggactacaggcgtgcatcaccacgcccggctgattttttgtattttaatagagatagggtttcaccatgttggccaggatggtctcgatctcctgacctcatgatccacccacctcggccttccaaagtgccgggattacaggtgtgagccaccgcgcctggccttaatattttcttgatgagttggtcaccattatgcacatcagttactatgctgtcctataatgtaacaacgyctcctacagccagagaaggtgcatatgagggctgttggttgcaacactcaacaccccagacatctctgttccttgaagatgcccccaaaaacacctcctcatcccccaaattgcaccttctaacgcttgtgggttgagaaaccaaaaccctaaccccgttggaactatctcaacaggctccgagggaagatataagggttctttttttttttttttttttttttgagatggggtctcactgttccccaggctgcagtggggtggtatgatcagagctcactgtaacttcaaactcctggg

SEQ ID NO: 62781 - DNA, 601 bp, Human
tccattcccgaggaaaatgtttttagatactacactacactttatgctaaatgcaatttaatatttcctttcttttcttttctttttttttttttttgtgagacagagtctccctctgtcaccaggcacaatctcagctcactgcactctctgcctcccaagttcaagcaattctcctgcctcagcctccccagtagctgggactacaggcgtgcatcaccacgcccggctgattttttgtattttaatagagatagggtttcaccatgttggccaggatggtctcgatctcctgacctcrtgatccacccacctcggccttccaaagtgccgggattacaggtgtgagccaccgcgcctggccttaatattttcttgatgagttggtcaccattatgcacatcagttactatgctgtcctataatgtaacaacgtctcctacagccagagaaggtgcatatgagggctgttggttgcaacactcaacaccccagacatctctgttccttgaagatgcccccaaaaacacctcctcatcccccaaattgcaccttctaacgcttgtgggttgagaaaccaaaaccctaaccccgttggaac

SEQ ID NO: 62782 - DNA, 601 bp, Human
gcccaagttagccacatggagaggtcaggaggaggagctctgaggctccagacatgagtaaaggcttcttagaacttgccagcatagctggcaactgaatgctgcaggtgaatgaaacagcgcaggtggacaaatgagtgaccccagcccatgccacgtgaagcacaaaaaccacccagctgaacagtcaacccacaggatcatgagaaacaataaactgtcattctttttttattcttttttgagaccggtcttgctctgtcacccaggctggagtgcagtgtcacgatcatggctcatygcagcatccggggctcataatcctcccacctcagccttctgagtagctgggactactggcacatgctaccatgcctggctgatttttgtaccatttgtagagacaagagttttgccatgttgcccaggtttaaactgttactcttttaagcctccaaattttggggctgtttgttacacagcagtggataactaaaacacatggtgaataaatggacatatactcagtaacactgagtaatgagccatcccacattactgaatttccaaatataatccttatttgttcaaacttgtgtta

SEQ ID NO: 62783 - DNA, 601 bp, Human
gaagcattctgtggtcacagagtattttggaccctacccaatctcatggctttaattagttccgtctccccagcatcccccatgtgcctcctggtttctcagacagcctcagaagacagctgctatcaattcattccctcccttacacacgctactcaaacatcaaaagatagaatcaatttcctcttgcatctgagttagcctggacttcttgtagccgatagtgatgagcctaacctttaaaaactgtgatagcttccaccttctctctgagaccaccatgctgtgaggaagcccaagktagccacatggagaggtcaggaggaggagctctgaggctccagacatgagtaaaggcttcttagaacttgccagcatagctggcaactgaatgctgcaggtgaatgaaacagcgcaggtggacaaatgagtgaccccagcccatgccacgtgaagcacaaaaaccacccagctgaacagtcaacccacaggatcatgagaaacaataaactgtcattctttttttattcttttttgagaccggtcttgctctgtcacccaggctggagtgcagtgtcacgatcatggctcatcgcagcat

SEQ ID NO: 62784 - DNA, 601 bp, Human
ctcaaatctgcaactctagacctttcttctccagatcttgagtacaaggtctggtatacagaaggtgttcaataactttccactgaataatctgaaagttccacttggatgtcccacgggcaactcaaaccaaactcatcttctccatcccctacgtccgtcctggtgggtggccctcatggtgccacgcctggactccctcaccagcctcctgcaccatgtcgacttcattcaggtccaccaagatgatccccctaaatgcaaacccaatcctatctggtgtttctgaagcttgtgcacmtgcaaatctctacctcctgggaaaggaatacaaacatcagagccaagctgccaacctaagctgaggagagaaaggggcaggaatggtgctggggtccatgattaagccacacatcctgtcacctagggcagtgtcctggacacaggggccgttgcatgcttgagaaggtaagagaatgacttctcacccaaataaggcaaggcaaagtctatacagatgaattctgagccaccatttctctctgtacaatgcagtttctgaaactttctaaaaatcttagaaatgatgtattggatccta

SEQ ID NO: 62785 - DNA, 601 bp, Human
ccagcacaggctacctgggacaatcatgggtcccggcaggaagcaggggcgggttacagatgtcccatgctgagggcccccccgacacacattggctgctccacgtgttggattctaagcccccttcctttttgattctacacactctccccaggcaacccctcagcctccctacagttttaggtgccacttaaatgccgatgattctcaaatctgcaactctagacctttcttctccagatcttgagtacaaggtctggtatacagaaggtgttcaataactttccactgaataatctgmaagttccacttggatgtcccacgggcaactcaaaccaaactcatcttctccatcccctacgtccgtcctggtgggtggccctcatggtgccacgcctggactccctcaccagcctcctgcaccatgtcgacttcattcaggtccaccaagatgatccccctaaatgcaaacccaatcctatctggtgtttctgaagcttgtgcacatgcaaatctctacctcctgggaaaggaatacaaacatcagagccaagctgccaacctaagctgaggagagaaaggggcaggaatggtgctgggg

SEQ ID NO: 62786 - DNA, 601 bp, Human
aaataactagcatctgcacagtgctttgtagtttaaagcgcctctatataattacccacccctcccccaaccaggtaacacagtcacactcccgtgcccttgtttgccagttagaactgtgggaagcagtccctcaactggcaccatggccccaccttggctaggcttaagtctccccaatgcaagagcatcaatcgtgcaaaacaccatcagacagacactgcttcctgcttcctaatggccgatctacccagcacaggctacctgggacaatcatgggtcccggcaggaagcaggggcrggttacagatgtcccatgctgagggcccccccgacacacattggctgctccacgtgttggattctaagcccccttcctttttgattctacacactctccccaggcaacccctcagcctccctacagttttaggtgccacttaaatgccgatgattctcaaatctgcaactctagacctttcttctccagatcttgagtacaaggtctggtatacagaaggtgttcaataactttccactgaataatctgaaagttccacttggatgtcccacgggcaactcaaaccaaactcatcttctc

SEQ ID NO: 62787 - DNA, 601 bp, Human
ccccatctctactaaaaatgcaaaaattagctgggcatggtggcgcatgcctgtaaccccagctactcgggaaggctgaggcaggagaatcacttgaacctggaaggcagaggttgcagtgagctgagattgcaccattgcactctggcctgggcaacaagagcgaaactccgtctcaaaaaaaaagaaagaaaaaaaagtagacaaatgccctacagaaaaggaatagtacaatattctgcaatattattcagcattttataatttgaaacattcttaacaataatcctttcacaatgargaaaaagagctagttgattacgcagaaaagagatgaaaaaaggataatgaagaaacttggtctgattcattcatagttcaaagatcagagatggtctgccaagattaaatgtaataaagaaataactagcatctgcacagtgctttgtagtttaaagcgcctctatataattacccacccctcccccaaccaggtaacacagtcacactcccgtgcccttgtttgccagttagaactgtgggaagcagtccctcaactggcaccatggccccaccttggctaggcttaagtctccccaat

SEQ ID NO: 62788 - DNA, 601 bp, Human
tcaagaccagcctggccaatatggagaaaccccatctctactaaaaatgcaaaaattagctgggcatggtggcgcatgcctgtaaccccagctactcgggaaggctgaggcaggagaatcacttgaacctggaaggcagaggttgcagtgagctgagattgcaccattgcactctggcctgggcaacaagagcgaaactccgtctcaaaaaaaaagaaagaaaaaaaagtagacaaatgccctacagaaaaggaatagtacaatattctgcaatattattcagcattttataatttgaaayattcttaacaataatcctttcacaatgaagaaaaagagctagttgattacgcagaaaagagatgaaaaaaggataatgaagaaacttggtctgattcattcatagttcaaagatcagagatggtctgccaagattaaatgtaataaagaaataactagcatctgcacagtgctttgtagtttaaagcgcctctatataattacccacccctcccccaaccaggtaacacagtcacactcccgtgcccttgtttgccagttagaactgtgggaagcagtccctcaactggcaccatggccc

SEQ ID NO: 62789 - DNA, 601 bp, Human
aaaaaaaaaataaaaagaaccaccctagattgggctcttcatggaaataaagagtgaatatcccaaatttgtccctggagatgggcaatatgatattaacaactacaagcccaactacaggaggaatgtgtgttccagagcactcagtgctgcaccaatgaaaggtaaactgtaagcatgggcaggagtagagcaaaaaggcactgaagggtgaggctgtgtgccactccttgggctggctccagctgacagggttgtccacagtagaaaatgtgcctgtgggcagtggggtcggcccccrgccccacgtgggaggatgaacaaccctcggcaccatgccatgcgctttgctcagattccccttcaggaaattactgatttggtttcttaggaattggcagcaaatatgtaccaaatgacacacatggtattaccaccccctgctcccaccccgctgccctccagagaaggtgggaaggtccacctaccataagcaggttggtgaccaggccttgagcaatctgtcttataagaatcaggctcaagactggacgtggtggctcacgcctataatctcagcagtttgggaggcagaggcagg

SEQ ID NO: 62790 - DNA, 601 bp, Human
gtgaaggccagcaggtctgagacacaatggaagggataggaaatgccacctgtaatcccagcactttgggaggctgaggcgggcggatcacctgaggtcaggagatcgagaccagcctggccaacatggtgaaaccccgtctctactaaaactacaaaaactagccagtcgtggtggtgcacgcctgtaatcccagctacttgggaggctgaagcaggagaatctcttcagcccaggaggtggaggtttcagtgagctgagatgatgccactgcactccagcctaggcgagagagtgagattgtttaaaaaaaaaataaaaagaaccaccctagattgggctcttcatggaaataaagagtgaatatcccaaatttgtccctggagatgggcaatatgatattaacaactacaagcccaactacaggaggaatgtgtgttccagagcactcagtgctgcaccaatgaaaggtaaactgtaagcatgggcaggagtagagcaaaaaggcactgaagggtgaggctgtgtgccactccttgggctggctccagctgacagggttgtccacagtagaaaatgtgcctgtgggcagtggggtcgg

SEQ ID NO: 62791 - DNA, 601 bp, Human
ggggagggatgtcaggtccgccccaaccagggaggcaagggcagggcttgaagccaccaggcgcccttgagacatcctggaagaagcctggggctgctcttccctcccttgtggttgggccaggcttttctacaattccttatcagagccaataatcatcacaatgacagtgacagccagagaaacagccatttctagtgcttgccgcctatcccagtgaaaaaggtattattatcacacccattttgcagaaggagaaaccaggcaaagaggttaaataacttaccccagatctcacagytggtaagtgggggagctcctggtggttcaagtcgaatgactgtgacgccagtgctttgacccagagtccaaagcagaaagccacccggggtgagggtcgaccaagactcacaaggtcccttcactacgccgtaattgtgaaggccagcaggtctgagacacaatggaagggataggaaatgccacctgtaatcccagcactttgggaggctgaggcgggcggatcacctgaggtcaggagatcgagaccagcctggccaacatggtgaaaccccgtctctactaaaactacaaaaactag

SEQ ID NO: 62792 - DNA, 601 bp, Human
tagggccaagcggggagggatgtcaggtccgccccaaccagggaggcaagggcagggcttgaagccaccaggcgcccttgagacatcctggaagaagcctggggctgctcttccctcccttgtggttgggccaggcttttctacaattccttatcagagccaataatcatcacaatgacagtgacagccagagaaacagccatttctagtgcttgccgcctatcccagtgaaaaaggtattattatcacacccattttgcagaaggagaaaccaggcaaagaggttaaataacttaccccrgatctcacagttggtaagtgggggagctcctggtggttcaagtcgaatgactgtgacgccagtgctttgacccagagtccaaagcagaaagccacccggggtgagggtcgaccaagactcacaaggtcccttcactacgccgtaattgtgaaggccagcaggtctgagacacaatggaagggataggaaatgccacctgtaatcccagcactttgggaggctgaggcgggcggatcacctgaggtcaggagatcgagaccagcctggccaacatggtgaaaccccgtctctactaaaact

SEQ ID NO: 62793 - DNA, 601 bp, Human
gcctcggcctcccaaagtgctgggattacaggcgtgagccactgtgcccagccgtttttacattttttaagacaaaaattgtctaggaaagttgaatatggctatttattaaacaggggctgagggtccgacaccccagtcaggggttgggaaacaatgatagggtggatagggccaagcggggagggatgtcaggtccgccccaaccagggaggcaagggcagggcttgaagccaccaggcgcccttgagacatcctggaagaagcctggggctgctcttccctcccttgtggttgggcyaggcttttctacaattccttatcagagccaataatcatcacaatgacagtgacagccagagaaacagccatttctagtgcttgccgcctatcccagtgaaaaaggtattattatcacacccattttgcagaaggagaaaccaggcaaagaggttaaataacttaccccagatctcacagttggtaagtgggggagctcctggtggttcaagtcgaatgactgtgacgccagtgctttgacccagagtccaaagcagaaagccacccggggtgagggtcgaccaagactcacaaggtccct

SEQ ID NO: 62794 - DNA, 601 bp, Human
ggagtgcagtggcacaatctcagctcactacaagctctgccccctgggttcacaccattcccctgcctcagcctcccgagtagctgggactacaggcacccaccaccacacccggctgatttttttgtatttttaatagagacggggtttcaccatgttagccagtatggtcttgatcccctgacctcatgatccgcccgcctcggcctcccaaagtgctgggattacaggcgtgagccactgtgcccagccgtttttacattttttaagacaaaaattgtctaggaaagttgaatatggstatttattaaacaggggctgagggtccgacaccccagtcaggggttgggaaacaatgatagggtggatagggccaagcggggagggatgtcaggtccgccccaaccagggaggcaagggcagggcttgaagccaccaggcgcccttgagacatcctggaagaagcctggggctgctcttccctcccttgtggttgggccaggcttttctacaattccttatcagagccaataatcatcacaatgacagtgacagccagagaaacagccatttctagtgcttgccgcctatcccagtgaaa

SEQ ID NO: 62795 - DNA, 601 bp, Human
cctgacctcaggtgatctgcctgcctcagcctcccaaagtgttaggattacagatgtgagccaatgcgactggtcagtttcttctattttgcctcctatgcgccattcctctattgtgttgtttttgctttttccctgattattagagttattaaccaaagccctgtccagcaagcaaagccatgatcactatagagagatgggaaggtacagtttggtctttcttagttactgtggggaaatggtgaataattgaaagtgtgtttttgcatttttttttttttttgaggcagagtcttgytctgtctcccaggctggagtgcagtggcacaatctcagctcactacaagctctgccccctgggttcacaccattcccctgcctcagcctcccgagtagctgggactacaggcacccaccaccacacccggctgatttttttgtatttttaatagagacggggtttcaccatgttagccagtatggtcttgatcccctgacctcatgatccgcccgcctcggcctcccaaagtgctgggattacaggcgtgagccactgtgcccagccgtttttacattttttaagacaaaaattgtctag

SEQ ID NO: 62796 - DNA, 601 bp, Human
gacagcatctctgtcgcccaggctggaatgcagtggcacaatctcggctcattgcaacctctgcctcctgggttcaagcaattctcctgcctcagcctccctagtagctgggattacaggcatgcaccaccacgtccagctaattttgtatttttagtagagacagggttgcaccatgttgaccaggctggtcttgaactcctgacctcaggtgatctgcctgcctcagcctcccaaagtgttaggattacagatgtgagccaatgcgactggtcagtttcttctattttgcctcctatgygccattcctctattgtgttgtttttgctttttccctgattattagagttattaaccaaagccctgtccagcaagcaaagccatgatcactatagagagatgggaaggtacagtttggtctttcttagttactgtggggaaatggtgaataattgaaagtgtgtttttgcatttttttttttttttgaggcagagtcttgctctgtctcccaggctggagtgcagtggcacaatctcagctcactacaagctctgccccctgggttcacaccattcccctgcctcagcctcccgagtagct

SEQ ID NO: 62797 - DNA, 601 bp, Human
acccagcttgtaagtttcttctctctttttttaagacagcatctctgtcgcccaggctggaatgcagtggcacaatctcggctcattgcaacctctgcctcctgggttcaagcaattctcctgcctcagcctccctagtagctgggattacaggcatgcaccaccacgtccagctaattttgtatttttagtagagacagggttgcaccatgttgaccaggctggtcttgaactcctgacctcaggtgatctgcctgcctcagcctcccaaagtgttaggattacagatgtgagccaatgygactggtcagtttcttctattttgcctcctatgcgccattcctctattgtgttgtttttgctttttccctgattattagagttattaaccaaagccctgtccagcaagcaaagccatgatcactatagagagatgggaaggtacagtttggtctttcttagttactgtggggaaatggtgaataattgaaagtgtgtttttgcatttttttttttttttgaggcagagtcttgctctgtctcccaggctggagtgcagtggcacaatctcagctcactacaagctctgccccctgggttc

SEQ ID NO: 62798 - DNA, 601 bp, Human
cgggaggcagaggctgcagtgagccgagatcgtgcccctgcactccagcctgagcgacagagtgaaattccatctcaaaaaaaaagaaaagaaaagaaaaaagtacatgattctttgtctctgtggagaacttcatgtggaaagcatattctctccgacatttagaaggcaaccaaaaaaaacggtgacccagcttgtaagtttcttctctctttttttaagacagcatctctgtcgcccaggctggaatgcagtggcacaatctcggctcattgcaacctctgcctcctgggttcaagcrattctcctgcctcagcctccctagtagctgggattacaggcatgcaccaccacgtccagctaattttgtatttttagtagagacagggttgcaccatgttgaccaggctggtcttgaactcctgacctcaggtgatctgcctgcctcagcctcccaaagtgttaggattacagatgtgagccaatgcgactggtcagtttcttctattttgcctcctatgcgccattcctctattgtgttgtttttgctttttccctgattattagagttattaaccaaagccctgtccagcaagcaaag

SEQ ID NO: 62799 - DNA, 601 bp, Human
atatccacctcacagagtgggtgtgaggactaagtgacataatgagataaaaagcgcttcaatgatccatgcaaatgttatttgtaactagtcctcagagagtcatcagacccattaggccatcgtgaagggaagtgggtgaggggcggggaggaatgggagcaggggtaggagggtgcgggggcaccatggcagggctccagcacggctcgccagctgaacagggagcgccatgatccctttcttccctaaatgcaactcgaagcctcaggtgttgtgcgtcactaaccctgccgaggaygaagattctaaagctcaggggaacaaagtgaggccatctagggccacagggacatcctaaccccaggttctccatatgaaaggaaccgagctccatgcagctcacatgatctgacctaatgaaaggacatacctggcttcctccactacagccatgccagcagccttcttcaccatgtctcccacccacaaccaactcttcacgcattcctcccaaagacggagcataaagagaaaagacattaagtgaaaggccattgccaaaatgcaaaaaggaaggaaggaaggagacagagagaga

SEQ ID NO: 62800 - DNA, 601 bp, Human
gagaccagccgggtctgcgcttcccggggggagcctgggcgccttcttcaccctctgttcctcctccactttcttttctataaaatgccagtgacaagaatatccacctcacagagtgggtgtgaggactaagtgacataatgagataaaaagcgcttcaatgatccatgcaaatgttatttgtaactagtcctcagagagtcatcagacccattaggccatcgtgaagggaagtgggtgaggggcggggaggaatgggagcaggggtaggagggtgcgggggcaccatggcagggctccrgcacggctcgccagctgaacagggagcgccatgatccctttcttccctaaatgcaactcgaagcctcaggtgttgtgcgtcactaaccctgccgaggacgaagattctaaagctcaggggaacaaagtgaggccatctagggccacagggacatcctaaccccaggttctccatatgaaaggaaccgagctccatgcagctcacatgatctgacctaatgaaaggacatacctggcttcctccactacagccatgccagcagccttcttcaccatgtctcccacccacaaccaactcttc

SEQ ID NO: 62801 - DNA, 601 bp, Human
cctttttcatgtacagtacaattcccttttttggtgtacagttctatgttctgacacacagtcatgtaaccacttccacaaccgtctgtctcgatctcctcagagaagacgacttctgacttgcatttggatctggaagtcttggccctgagaccagccgggtctgcgcttcccggggggagcctgggcgccttcttcaccctctgttcctcctccactttcttttctataaaatgccagtgacaagaatatccacctcacagagtgggtgtgaggactaagtgacataatgagataaaawgcgcttcaatgatccatgcaaatgttatttgtaactagtcctcagagagtcatcagacccattaggccatcgtgaagggaagtgggtgaggggcggggaggaatgggagcaggggtaggagggtgcgggggcaccatggcagggctccagcacggctcgccagctgaacagggagcgccatgatccctttcttccctaaatgcaactcgaagcctcaggtgttgtgcgtcactaaccctgccgaggacgaagattctaaagctcaggggaacaaagtgaggccatctagggccacaggga

SEQ ID NO: 62802 - DNA, 601 bp, Human
tttctcctcctcctcagctactcaacgtgaagatgcagatgaagaccttttgatgatccacctccacttaatgaatagtcaatatattttcctggccaggcgcagtggctcgtgcctgtaatcccagcactttgggaggccgcggtgggtggatcacctgagggcaggagttcgagaccagcctggccagcatggtgaaaccccgtctctactaaaaacacaaaaaattagccgagtgttgtggcacatatttgtggtcccaggtacttgggagactgaggcaggaggatcacttgagccyaagaggttgaggctgcagtgagccgtgatcacaccataaaaattagcttggtgtggtggcgggcgcctatagtcccagccactcaggaggctgaggcaggagaatcacttgaacccgggaggcgaagattgcagtgagccaagatcgcgccactgcactctagcctgggtgacacagagagagactctatctccaaaaaaaaaaaaaaaaaaagttatacatggatgttgactgtgtggggggcagcacccctaacgcctgtgtggttcaagggtcaactgtatgctgaagccatctttt

SEQ ID NO: 62803 - DNA, 601 bp, Human
atgacacacaacacatcccagctgcaaaagaaggccataggagggggtggtggctaacaccggtggtcctagctactcaggaggtcaaggtgggaggatcacttgaacccaggagctcaagcccaacctgggcaacatagcaagacctcatctttaaaaaaaaaaaaaagaagaaggaaaaagaaaaaggccacaaggaataccaaacagagtacctatataaaaaggaaagaactttcccttcaacaaaagattggcaaatgactgtatagctaaatgttttcaattaaaacaaactatytaaaatacatataaatgtatatatgtatgcacaatttttgtgattcctgtattttactgactttttataaaacctactgaattttagtagatggcacacattttaactctgtgtgtgtgtgtgtgtgtgtgtgtgtgtgtgtgtgtgtgtagttttttttttttttttttgagacagggtctcactctgttacccaggttggagtacagtgttgtgatcatggctcactgcagcctcaacctcctgggctcaagcgatcctcctgcctcagtctccctagtgtctgggaccacaagtgtg

SEQ ID NO: 62804 - DNA, 601 bp, Human
aagaaattgctgttgaattcaaggtaggcaagacagtaacaatttggccaaaaagaaagaacagtaataaaaatgtagggggattctgtacccaggttccttccaagtgacttttaattcttactccactttaaggaaactggaaatgacacacaacacatcccagctgcaaaagaaggccataggagggggtggtggctaacaccggtggtcctagctactcaggaggtcaaggtgggaggatcacttgaacccaggagctcaagcccaacctgggcaacatagcaagacctcatctttaaaaaaaaaaaaaagaagaaggaaaaagaaaaaggccacaaggaataccaaacagagtacctatataaaaaggaaagaactttcccttcaacaaaagattggcaaatgactgtatagctaaatgttttcaattaaaacaaactatttaaaatacatataaatgtatatatgtatgcacaatttttgtgattcctgtattttactgactttttataaaacctactgaattttagtagatggcacacattttaactctgtgtgtgtgtgtgtgtgtgtgtgtgtgtgtgtgtgtgtgtagttt

SEQ ID NO: 62805 - DNA, 601 bp, Human
aaaatatggatgtgaaagaaagcgcgttgtttctaaaaaaagtaaagtgagtattttgaacatttttgacaaatataagtagctagaagaaattgctgttgaattcaaggtaggcaagacagtaacaatttggccaaaaagaaagaacagtaataaaaatgtagggggattctgtacccaggttccttccaagtgacttttaattcttactccactttaaggaaactggaaatgacacacaacacatcccagctgcaaaagaaggccataggagggggtggtggctaacaccggtggtccyagctactcaggaggtcaaggtgggaggatcacttgaacccaggagctcaagcccaacctgggcaacatagcaagacctcatctttaaaaaaaaaaaaaagaagaaggaaaaagaaaaaggccacaaggaataccaaacagagtacctatataaaaaggaaagaactttcccttcaacaaaagattggcaaatgactgtatagctaaatgttttcaattaaaacaaactatttaaaatacatataaatgtatatatgtatgcacaatttttgtgattcctgtattttactgactttttata

SEQ ID NO: 62806 - DNA, 601 bp, Human
actgacgttacacgtgccgcaggcaagctcctctctaggaaggccatgcatttatttctgctccaactttcggagtattttccaagaatcacttatgtttagtcccaaacctgtttatgccagttgtttttggtattatatttacataacttaattaaatataacctacacagataaaatatggatgtgaaagaaagcgcgttgtttctaaaaaaagtaaagtgagtattttgaacatttttgacaaatataagtagctagaagaaattgctgttgaattcaaggtaggcaagacagtaamaatttggccaaaaagaaagaacagtaataaaaatgtagggggattctgtacccaggttccttccaagtgacttttaattcttactccactttaaggaaactggaaatgacacacaacacatcccagctgcaaaagaaggccataggagggggtggtggctaacaccggtggtcctagctactcaggaggtcaaggtgggaggatcacttgaacccaggagctcaagcccaacctgggcaacatagcaagacctcatctttaaaaaaaaaaaaaagaagaaggaaaaagaaaaaggccaca

SEQ ID NO: 62807 - DNA, 601 bp, Human
accaagatagtccagtccctccagaaatcaactgacgttacacgtgccgcaggcaagctcctctctaggaaggccatgcatttatttctgctccaactttcggagtattttccaagaatcacttatgtttagtcccaaacctgtttatgccagttgtttttggtattatatttacataacttaattaaatataacctacacagataaaatatggatgtgaaagaaagcgcgttgtttctaaaaaaagtaaagtgagtattttgaacatttttgacaaatataagtagctagaagaaattgytgttgaattcaaggtaggcaagacagtaacaatttggccaaaaagaaagaacagtaataaaaatgtagggggattctgtacccaggttccttccaagtgacttttaattcttactccactttaaggaaactggaaatgacacacaacacatcccagctgcaaaagaaggccataggagggggtggtggctaacaccggtggtcctagctactcaggaggtcaaggtgggaggatcacttgaacccaggagctcaagcccaacctgggcaacatagcaagacctcatctttaaaaaaaaaa

SEQ ID NO: 62808 - DNA, 601 bp, Human
cactggatccaccaagatagtccagtccctccagaaatcaactgacgttacacgtgccgcaggcaagctcctctctaggaaggccatgcatttatttctgctccaactttcggagtattttccaagaatcacttatgtttagtcccaaacctgtttatgccagttgtttttggtattatatttacataacttaattaaatataacctacacagataaaatatggatgtgaaagaaagcgcgttgtttctaaaaaaagtaaagtgagtattttgaacatttttgacaaatataagtagctaraagaaattgctgttgaattcaaggtaggcaagacagtaacaatttggccaaaaagaaagaacagtaataaaaatgtagggggattctgtacccaggttccttccaagtgacttttaattcttactccactttaaggaaactggaaatgacacacaacacatcccagctgcaaaagaaggccataggagggggtggtggctaacaccggtggtcctagctactcaggaggtcaaggtgggaggatcacttgaacccaggagctcaagcccaacctgggcaacatagcaagacctcatcttt

SEQ ID NO: 62809 - DNA, 601 bp, Human
agtgtttgtgtcccgcagctaggcaggatggacaaggttctgtgagcagcctgggcaaacaggagaaggcagtcctgagcaatgcgctttagtctacacctagagaaagtgcccaggaccatgtaaggtctggaaaccatgtcgcctgaggacttcttgaaaaagggagatgggcgaggctgaagaggagatccagggagagcaacatagctgaattcaaacactggaagggctgctgtgtagaaaacaagaagtagacatgcattacttcctgtggacaaattagaaccaggaaagggtrgctcatgcctgtaatcccagcagtttgggaggccgagacgggtggatcacctgaggtcaggagttcaagaccagcctggccaacatggtgaaaccccatctctactaaaaatacaaaaatcagctgggcgtggtagtgggcacctgtaatcccagctacttgagaggctgaggcaggagaatcgcttgaactcaggaggcagaggttgcagtgagccgagatcatgccattgcactccagcctgggcgacaacagtgagactccgtctcaaaaaaaaggaaaatgaaagaaccaggaatg

SEQ ID NO: 62810 - DNA, 582 bp, Human
cagcctggggcaaaagagccagactctgtctcaaaaaaaaaaaaattaaataaaaaattttttaaaaacgtaaatgtttatgtagacaatagctctatcattaaggcctgacatataaactttccagaaatgggggggccatacccccaatcttaaatgtatagctacagaatttctacctgcagtgtttgtgtcccgcagctaggcaggatggacaaggttctgtgagcagcctgggcaaacaggagaaggcagtcctgagcaatgcgctttagtctacasctagagaaagtgcccaggaccatgtaaggtctggaaaccatgtcgcctgaggacttcttgaaaaagggagatgggcgaggctgaagaggagatccagggagagcaacatagctgaattcaaacactggaagggctgctgtgtagaaaacaagaagtagacatgcattacttcctgtggacaaattagaaccaggaaagggtggctcatgcctgtaatcccagcagtttgggaggccgagacgggtggatcacctgaggtcaggagttcaagaccagcctggccaacatggtgaaacccca

SEQ ID NO: 62811 - DNA, 438 bp, Human
cagcctggggcaaaagagccagactctgtctcaaaaaaaaaaaaattaaataaaaaattttttaaaaacgtaaatgtttatgtagacaatagctctatcattaaggcctgacatataaactttccagaaatggggggrccatacccccaatcttaaatgtatagctacagaatttctacctgcagtgtttgtgtcccgcagctaggcaggatggacaaggttctgtgagcagcctgggcaaacaggagaaggcagtcctgagcaatgcgctttagtctacacctagagaaagtgcccaggaccatgtaaggtctggaaaccatgtcgcctgaggacttcttgaaaaagggagatgggcgaggctgaagaggagatccagggagagcaacatagctgaattcaaacactggaagggctgctgtgtagaaaacaagaagt

SEQ ID NO: 62812 - DNA, 346 bp, Human
cagcctggggcaaaagagccagactctgtctcaaaaaaaaaaaaawtaaataaaaaattttttaaaaacgtaaatgtttatgtagacaatagctctatcattaaggcctgacatataaactttccagaaatgggggggccatacccccaatcttaaatgtatagctacagaatttctacctgcagtgtttgtgtcccgcagctaggcaggatggacaaggttctgtgagcagcctgggcaaacaggagaaggcagtcctgagcaatgcgctttagtctacacctagagaaagtgcccaggaccatgtaaggtctggaaaccatgtcgcctgaggacttcttgaaaa

SEQ ID NO: 62813 - DNA, 601 bp, Human
cagttaccatagaggggtgtgtagagctttgcttccccgatttgcataagcttatataaagaatgtatctgtcctaaatgtgcatagagtcacataaatatgcaattcacagaaagatctctggaagtatccacaccaaacatttggcaatgggtacctatgagaaggggagcaagggaaggaaggaggactttcacttttattctttgtactcctgtctaggttgaattattttcttacaatagtgcttcataatatagaagaaaactgatattcgtttaagagaagcctcaatgttaayagcagttatccttcagaaataatattatgggtaatattttttcatactacatagtattttccaggctttccacagtgaatacatttgttacttttatgttagattgaatcatatgaaatgaagttgcctttttttttttctttttgagaacaggagtcttgctctgtcaccccaggctggagtgcagtggtgaaatctcgactcactgcaacctccgcctcccaggttcaagcaattctcctgggggggcctcctgagtagctgggattacaggtgtgcgccaccacccaggaggcgaag

SEQ ID NO: 62814 - DNA, 601 bp, Human
atggaggcagggctgcagacggcagaggcatctcatccccttgagaggaaactacagttaccatagaggggtgtgtagagctttgcttccccgatttgcataagcttatataaagaatgtatctgtcctaaatgtgcatagagtcacataaatatgcaattcacagaaagatctctggaagtatccacaccaaacatttggcaatgggtacctatgagaaggggagcaagggaaggaaggaggactttcacttttattctttgtactcctgtctaggttgaattattttcttacaatagtscttcataatatagaagaaaactgatattcgtttaagagaagcctcaatgttaatagcagttatccttcagaaataatattatgggtaatattttttcatactacatagtattttccaggctttccacagtgaatacatttgttacttttatgttagattgaatcatatgaaatgaagttgcctttttttttttctttttgagaacaggagtcttgctctgtcaccccaggctggagtgcagtggtgaaatctcgactcactgcaacctccgcctcccaggttcaagcaattctcctgggg

SEQ ID NO: 62815 - DNA, 601 bp, Human
actccctaggcagctgacccacagaggcccagggaggtcagctgcgctgcccagggccccaggcatccaactctgggccacgcttccctcctcctggcacaccgcctccttctccccaaaccaccatccgctcttctgccctgtgaggtgatgactgtattgattttgatgccttcttcaatcccaataaataaaccattctcttgcgaccaaagcccatgtttgtctaagagcgggacctcactctcggctggaatgctgctgtcaccccagccacctctgccaccagcctgccaggccraactgtccctggatttcctgcccagtaggcccttgaaagatgccttcttgctgctgcagatggaagcaagcagaagcagcttgctagaccagccctgactcttcctcagctcgagaggtggctgtggctcaaggaggccaccagtgtggacctcgagtggcaccacccagctgatggaggcagggctgcagacggcagaggcatctcatccccttgagaggaaactacagttaccatagaggggtgtgtagagctttgcttccccgatttgcataagcttatataaagaatgtatctgtc

SEQ ID NO: 62816 - DNA, 601 bp, Human
aactccctaggcagctgacccacagaggcccagggaggtcagctgcgctgcccagggccccaggcatccaactctgggccacgcttccctcctcctggcacaccgcctccttctccccaaaccaccatccgctcttctgccctgtgaggtgatgactgtattgattttgatgccttcttcaatcccaataaataaaccattctcttgcgaccaaagcccatgtttgtctaagagcgggacctcactctcggctggaatgctgctgtcaccccagccacctctgccaccagcctgccaggcmgaactgtccctggatttcctgcccagtaggcccttgaaagatgccttcttgctgctgcagatggaagcaagcagaagcagcttgctagaccagccctgactcttcctcagctcgagaggtggctgtggctcaaggaggccaccagtgtggacctcgagtggcaccacccagctgatggaggcagggctgcagacggcagaggcatctcatccccttgagaggaaactacagttaccatagaggggtgtgtagagctttgcttccccgatttgcataagcttatataaagaatgtatctgt

SEQ ID NO: 62817 - DNA, 601 bp, Human
aggaaaccgcacagctcccggctccaggtctctggggagacaacccttgcctggggaagcctgggaggttcggggaagcaaacagaattcctaagactgggagaacaaaagcaaaatttaccacgcaaccaacagcagctcagcagtgggaggtctgcagcctggggatagctccagttcacactggaaaccctttcaccgccagagaactccagcgcggacgccaagcacgaccacggcaggtgacctgccctccctccagctccaccaccattctccctgttctcaccacacaaccacrcactcaatagcctccaaacactccactgtcccctcatgccccttgtcaccctgaatcccggtgtcactggcttccaatgtccccctacccctcccaccttttcccagctcacctgtctctacctctgctccctaggcagagccactaggcagttgccaactgcctaggcaactccctaggcagctgacccacagaggcccagggaggtcagctgcgctgcccagggccccaggcatccaactctgggccacgcttccctcctcctggcacaccgcctccttctccccaaaccaccatccg

SEQ ID NO: 62818 - DNA, 601 bp, Human
ggagtcagaactgtctcatatggcttttactcctccccatttcagatcccaaataaccttccaggcttctttgttactactgcacccaactctccagtcagaggttctccactaccccgtctatgttcacccccagacctttgttcacaagccactgccactgcccctcccctactgacctcaggatcgaaatccaacgtgcccttcacggcccagctcagtactcctcctcctgaggggcttttctctccactctcccagttcgtgcgccacagaggcccccggggaggctcgaggacckcctttccatcaccgtggggtgagccccaccctcgcaccgagaagaaaggaagggagtggacctactgtctgcgggatgggagtcgggacactgactgtgtgggaatgcacctatgcagggctgtcctcggggagaggggcttcgtgtacttcacacagtgcttcatgaaggggtgagtcaggcgccatctctcctttttccaaaaggaaaaatgagccacaccacagattaagtcaattacactcagccagaggaaatatcctccgaagatcttcactctcaaatcagcctctcaatgga

SEQ ID NO: 62819 - DNA, 601 bp, Human
gcctgctccaaagctttcaatggctgcccactgtctacaaaatggagtcagaactgtctcatatggcttttactcctccccatttcagatcccaaataaccttccaggcttctttgttactactgcacccaactctccagtcagaggttctccactaccccgtctatgttcacccccagacctttgttcacaagccactgccactgcccctcccctactgacctcaggatcgaaatccaacgtgcccttcacggcccagctcagtactcctcctcctgaggggcttttctctccactctcmcagttcgtgcgccacagaggcccccggggaggctcgaggaccgcctttccatcaccgtggggtgagccccaccctcgcaccgagaagaaaggaagggagtggacctactgtctgcgggatgggagtcgggacactgactgtgtgggaatgcacctatgcagggctgtcctcggggagaggggcttcgtgtacttcacacagtgcttcatgaaggggtgagtcaggcgccatctctcctttttccaaaaggaaaaatgagccacaccacagattaagtcaattacactcagccagaggaaa

SEQ ID NO: 62820 - DNA, 601 bp, Human
tgtgttgaaatcttcacactcacacgggaagttcagcaaggacaacaacccagacttttccattttgcaccttctaatatgctgagcaccagcaggccctccgtctatgctggctgaacgaatccctctctctcctatacccgcttcggtggctcaggtcagctccttgtatcccgccacgttcaggcaggttctcacatactctgctgctcacagccatcaccgttcgctgccagaatcatcttcctgaaaggtagcagggctcaggtcaactgcctgctccaaagctttcaatggctgyccactgtctacaaaatggagtcagaactgtctcatatggcttttactcctccccatttcagatcccaaataaccttccaggcttctttgttactactgcacccaactctccagtcagaggttctccactaccccgtctatgttcacccccagacctttgttcacaagccactgccactgcccctcccctactgacctcaggatcgaaatccaacgtgcccttcacggcccagctcagtactcctcctcctgaggggcttttctctccactctcccagttcgtgcgccacagaggcccccg

SEQ ID NO: 62821 - DNA, 601 bp, Human
ggtgcttggtcagtgttcctcccaactctaccatcacgatgtcacatgtggctggctgttctcttcctccaccttctcatgggtgatttgaaatagtctctcatcagtttatggggagtgtgttgaaatcttcacactcacacgggaagttcagcaaggacaacaacccagacttttccattttgcaccttctaatatgctgagcaccagcaggccctccgtctatgctggctgaacgaatccctctctctcctatacccgcttcggtggctcaggtcagctccttgtatcccgccacgtwcaggcaggttctcacatactctgctgctcacagccatcaccgttcgctgccagaatcatcttcctgaaaggtagcagggctcaggtcaactgcctgctccaaagctttcaatggctgcccactgtctacaaaatggagtcagaactgtctcatatggcttttactcctccccatttcagatcccaaataaccttccaggcttctttgttactactgcacccaactctccagtcagaggttctccactaccccgtctatgttcacccccagacctttgttcacaagccactgccactgccc

SEQ ID NO: 62822 - DNA, 601 bp, Human
acagtgcccggcgcgaaacaggtgcttggtcagtgttcctcccaactctaccatcacgatgtcacatgtggctggctgttctcttcctccaccttctcatgggtgatttgaaatagtctctcatcagtttatggggagtgtgttgaaatcttcacactcacacgggaagttcagcaaggacaacaacccagacttttccattttgcaccttctaatatgctgagcaccagcaggccctccgtctatgctggctgaacgaatccctctctctcctatacccgcttcggtggctcaggtcagstccttgtatcccgccacgttcaggcaggttctcacatactctgctgctcacagccatcaccgttcgctgccagaatcatcttcctgaaaggtagcagggctcaggtcaactgcctgctccaaagctttcaatggctgcccactgtctacaaaatggagtcagaactgtctcatatggcttttactcctccccatttcagatcccaaataaccttccaggcttctttgttactactgcacccaactctccagtcagaggttctccactaccccgtctatgttcacccccagacctttgttc

SEQ ID NO: 62823 - DNA, 601 bp, Human
taattccaggctgtcctgctcactctcgactggaagcagaagtctcatcatcttttcgcaagatgacatcatggtagatcagaggaagaaagagaccagccacccaccctctttcaaccatatccctcttgcctaccatacctgtaccccatctttccctaactgccattcctggtctctaattcagccacaccctcctcctccttccccttctcctttttctcctcctcccccttctcctcctcctcctcctccctcttctctctctctttgtctctctccctctctctttctgggactycttatagaatgtacccccacctccattgctaccactaacttcaaggcctggttcaaagccccctgcccttggcataaagagccaagactctgaaactggacagagcagaagctgaacaccagcctcacctgccaagggcctgtgtgtccctgagaaagcacctcagtctctctctgaaatctccccagggttggggagaggatcagagcacctgacacagtgcccggcgcgaaacaggtgcttggtcagtgttcctcccaactctaccatcacgatgtcacatgtggctggctgttctct

SEQ ID NO: 62824 - DNA, 601 bp, Human
taatgaacgatagggctcactcggttagtcttctttttccaaggaatcacagtccaccattgcctggtccctatattttatccagctcctagttgtttacagtgggagaataattccaggctgtcctgctcactctcgactggaagcagaagtctcatcatcttttcgcaagatgacatcatggtagatcagaggaagaaagagaccagccacccaccctctttcaaccatatccctcttgcctaccatacctgtaccccatctttccctaactgccattcctggtctctaattcagccayaccctcctcctccttccccttctcctttttctcctcctcccccttctcctcctcctcctcctccctcttctctctctctttgtctctctccctctctctttctgggacttcttatagaatgtacccccacctccattgctaccactaacttcaaggcctggttcaaagccccctgcccttggcataaagagccaagactctgaaactggacagagcagaagctgaacaccagcctcacctgccaagggcctgtgtgtccctgagaaagcacctcagtctctctctgaaatctccccaggg

SEQ ID NO: 62825 - DNA, 601 bp, Human
ttttcctttttgttttctttctggttacttttatgagtgtatctttattaagcaatctgattacaatgtgccttgatgtaattatcttcatttttctttttcttttttttgagatggagtcttgctctgtcgccaggctggagtgcagtggtgcaatctcggctcactgcaacctcctcctcatgggttcaagcgattctcctgcttcagcctcctgagtaactgggactacgggcacacaccaccacgcccagctaatttttgtatttttaggagagacggggtttgaccatgtttgtcaatggtctcgatctcttgacattgtgatccgcccacctcagcctcccaaagtgctgagattacaggcatgagccaccacgcctgaccaattctcttcattcttattccttatatttgtttgtattctgttgagcttcttgagtcatgggttgagttttcatcaaatttggacgttttcccaccattatttcttcaaatatttttttctgtctttctctctgttcttttgagacttcaattaaacatattagggtctgttatattgtcccacatgccagtgatgctctgagtattacctttt

SEQ ID NO: 62826 - DNA, 601 bp, Human
ttcatttttgaaggatatttgtgttgggtatagaattctagattgacctactttctttttcagttctactgtcttctgccttgaataatttctgaccacacatctgctgtcattcttatctttgttcctctctatgtcgtgtgtcttttttttcctttttgttttctttctggttacttttatgagtgtatctttattaagcaatctgattacaatgtgccttgatgtaattatcttcatttttctttttcttttttttgagatggagtcttgctctgtcgccaggctggagtgcagtggygcaatctcggctcactgcaacctcctcctcatgggttcaagcgattctcctgcttcagcctcctgagtaactgggactacgggcacacaccaccacgcccagctaatttttgtatttttaggagagacggggtttgaccatgtttgtcgatggtctcgatctcttgacattgtgatccgcccacctcagcctcccaaagtgctgagattacaggcatgagccaccacgcctgaccaattctcttcattcttattccttatatttgtttgtattctgttgagcttcttgagtcatgggttg

SEQ ID NO: 62827 - DNA, 601 bp, Human
ctcaaatgatcctcccatctcagcctcacaaacagctgggactacaggcacacaccactactcctggctaactttagtattttttgtagagataggttttcaccatgttgcccaggctggtcttgaactcttgagctcaatctgtcctcctcagcctcccaaagtgctgggattacaagcgtgagccactgccaatatctgcctattaaactgaatatttatatcacttacatttaatattatcaatatggctatatttaaaactgttgtcttgttttttgtcttctacttatcttactgktctttgttcctttttcccactttctttgccatcttttgaatgatttttgtttaccattctattttatctccattattggcttatgagtcatatctctttgttacgctttttcagtgattactctgggacttagagtaaacattaacttagtacagtctagttcaaatattctattactttgcatataagaaaattacagccaagtgtggtggctcacattgtaatcccagccctctgcgaggccatggtgggagaactgcttgaggccaggagttcaagaccagcctgggcaacgtggtg

SEQ ID NO: 62828 - DNA, 601 bp, Human
tcttttttcaagacaaggtctcactctgtcgcccaggctggagtgagtgacaccatcacagctcactgcagcttcgacctctcaggctcgctcaaatgatcctcccatctcagcctcacaaacagctgggactacaggcacacaccactactcctggctaactttagtattttttgtagagataggttttcaccatgttgcccaggctggtcttgaactcttgagctcaatctgtcctcctcagcctcccaaagtgctgggattacaagcgtgagccactgccaatatctgcctattaaaytgaatatttatatcacttacatttaatattatcaatatggctatatttaaaactgttgtcttgttttttgtcttctacttatcttactgttctttgttcctttttcccactttctttgccatcttttgaatgatttttgtttaccattctattttatctccattattggcttatgagtcatatctctttgttacgctttttcagtgattactctgggacttagagtaaacattaacttagtacagtctagttcaaatattctattactttgcatataagaaaattacagccaagtgtggt

SEQ ID NO: 62829 - DNA, 601 bp, Human
cttgaacccaggaggcaagggttgcagtgagccgagatcacgctgctgcactccagcctgggcagcagagcgagaaaatttctttttgtagagacagggtctcttttttgtgtacagacagggtcttgctctgtcacccaggctggtcttgatctcccggcctcaagcaatccttgcacctgggcatcacaaagcactgggattgaaggcatgagctgccacacccagtctatctgtgtctttatatttaagatgagtttctttatgatagttgatagttggttcttgctttgttatccaytgcacaatacctgtcttttttttttttcttttttcaagacaaggtctcactctgtcgcccaggctggagtgagtgacaccatcacagctcactgcagcttcgacctctcaggctcgctcaaatgatcctcccatctcagcctcacaaacagctgggactacaggcacacaccactactcctggctaactttagtattttttgtagagataggttttcaccatgttgcccaggctggtcttgaactcttgagctcaatctgtcctcctcagcctcccaaagtgctgggattacaagcgtga

SEQ ID NO: 62830 - DNA, 601 bp, Human
ttttgagatggagtctggctctgtcacccaggctggagtgcagtggcgcgatctcggctcactgcaagctctgcctcctgggttcacgccattctcctgcctcagcctcccaagtagctgggattacaggcgcttgccaccaagtgggcccggctaattttttgtattttagtagagacagggtttcactgtgttagccaggatggtctcgatctcctgacctcgtgatccacccgcctcggcctcccaaagtgctgggattataggcgtgagccaccactcccagccaaagtgtattgastcttgttttgtaacaggttgtgtgtctttgagaacatttcagtgcacttgaaaagaatgtatgttctctagttcttgggtgcagggttctataaatattcctttggtacagctttgtcattaggtgcatacatatttagaattatgatgtcttttgatgaattgattcctctgtcattatgaaatgtccctcgctatccctgataatatttcttgttccaaagtatatattgtctggtacttatagccacaccatctttatttatttatttatttattttggtagagatggggttttgcc

SEQ ID NO: 62831 - DNA, 601 bp, Human
ttcattttcatttaattcaatatgttttctaagatctcttgtgatttttttccttcctttaggcatgtgtttccaaatattttgggatttttaaagatatagtctgttacttctacttccatccatttttgtcagagaatatactttatatgagttcaatcttttaaagtgtattgagtctttttttttttttgagatggagtctggctctgtcacccaggctggagtgcagtggcgcgatctcggctcactgcaagctctgcctcctgggttcacgccattctcctgcctcagcctcccragtagctgggattacaggcgcttgccaccaagtgggcccggctaattttttgtattttagtagagacagggtttcactgtgttagccaggatggtctcgatctcctgacctcgtgatccacccgcctcggcctcccaaagtgctgggattataggcgtgagccaccactcccagccaaagtgtattgagtcttgttttgtaacaggttgtgtgtctttgagaacatttcagtgcacttgaaaagaatgtatgttctctagttcttgggtgcagggttctataaatattcctttggtacag

SEQ ID NO: 62832 - DNA, 601 bp, Human
tctgctctgtcctccaggctggagcgcagtggcacgatctcggctcactgcaacctccacctcccaggttcaagcaattctcatgcctcagcctcccaagtaagtgggattacaggcatgccaccacacccagcaattttttcatattttagtagagatggggtttcgccatgttggccaggctggtctcgaactcctgacctcaaggatgcacctgcctcggcctcccaaagtgctgggattacaggcatgagccactgcgcccggcctagacctttcttctttattaatacagtagtcycccttatctgtggcttcactttttgcattttcagctacccaaggtcaatcacagtccaaaaatattaaatgaaaaatttaagaaataaataattcataagttttaaattgagtagtgtgatgaactctagtacaattttgctctgtcccactagagatgtgagtcagccctttgtccaacatatccccactatccatgctacccacctgtgagtcacttggtagctgtctcggttatgagattgactgacaaggtactgcagtgcttctgttcaagtagcccttattttactttataatg

SEQ ID NO: 62833 - DNA, 601 bp, Human
caatctaaaggtttaagcttctaaggtagaagcttccatcacagactttagacctttcttcttttttttttgagatagagtctgctctgtcctccaggctggagcgcagtggcacgatctcggctcactgcaacctccacctcccaggttcaagcaattctcatgcctcagcctcccaagtaagtgggattacaggcatgccaccacacccagcaattttttcatattttagtagagatggggtttcgccatgttggccaggctggtctcgaactcctgacctcaaggatgcacctgcctyggcctcccaaagtgctgggattacaggcatgagccactgcgcccggcctagacctttcttctttattaatacagtagtctcccttatctgtggcttcactttttgcattttcagctacccaaggtcaatcacagtccaaaaatattaaatgaaaaatttaagaaataaataattcataagttttaaattgagtagtgtgatgaactctagtacaattttgctctgtcccactagagatgtgagtcagccctttgtccaacatatccccactatccatgctacccacctgtgagtcacttg

SEQ ID NO: 62834 - DNA, 601 bp, Human
gtattcatgctcacctgcatcccggtactggtcatttgtgtcctccctcattttcccaatcatctagctagaggattatctattttactgaccttttcaaataaccagctttggagtcactgatttgtaatgttttcccactaatttttttttctgcttctttctctggatctagtttttctacttcaatctaaaggtttaagcttctaaggtagaagcttccatcacagactttagacctttcttcttttttttttgagatagagtctgctctgtcctccaggctggagcgcagtggcaygatctcggctcactgcaacctccacctcccaggttcaagcaattctcatgcctcagcctcccaagtaagtgggattacaggcatgccaccacacccagcaattttttcatattttagtagagatggggtttcgccatgttggccaggctggtctcgaactcctgacctcaaggatgcacctgcctcggcctcccaaagtgctgggattacaggcatgagccactgcgcccggcctagacctttcttctttattaatacagtagtctcccttatctgtggcttcactttttgcattttcag

SEQ ID NO: 62835 - DNA, 601 bp, Human
actgtctttggagccaaactggcttgtgttctatcactccttagaaagtcccttaaaacctccctctgcaaccttctcacatggaaaattgcctcacatggcaattagtatttcttggctcatatgtatatatgtattttattttaccaaaatggtggaaagggcctggtgtggtggctcaggcctgtaatcccagtactttgggaggtcaaggtgggtagatcacctgaggtgaagagtttgagatcagcctgaccaatatggtgagaccccgtctctactgaaaatacaaaaattagcygggcatagtggcatgtgcctgtagtcccagctactcgggaggctgaggcaggagaattgcttgaacccgggaggcagaggttgcagtgagctgaggtcacaccactgcactctagcatgggcgacagagcgagactctgtctcaaaaacaaaaacagtggaaaggctgcagaaaactcaactgtttttatttcatttattgatacacgcaccttctgctaacactatcttcagcttataatgcgtgaggaaggaatgaaagctattagggtgtgtcctaccttcccttttatttctgtgt

SEQ ID NO: 62836 - DNA, 601 bp, Human
caagtcctcctccagcccctacaacaggagggagtgtgatgccgtggaataagcactgtctttggagccaaactggcttgtgttctatcactccttagaaagtcccttaaaacctccctctgcaaccttctcacatggaaaattgcctcacatggcaattagtatttcttggctcatatgtatatatgtattttattttaccaaaatggtggaaagggcctggtgtggtggctcaggcctgtaatcccagtactttgggaggtcaaggtgggtagatcacctgaggtgaagagtttgagaycagcctgaccaatatggtgagaccccgtctctactgaaaatacaaaaattagctgggcatagtggcatgtgcctgtagtcccagctactcgggaggctgaggcaggagaattgcttgaacccgggaggcagaggttgcagtgagctgaggtcacaccactgcactctagcatgggcgacagagcgagactctgtctcaaaaacaaaaacagtggaaaggctgcagaaaactcaactgtttttatttcatttattgatacacgcaccttctgctaacactatcttcagcttataatgcgtg

SEQ ID NO: 62837 - DNA, 601 bp, Human
atgcaaataaccacaggcccatctcagggtgggttggagactcctctatgatgtgtgtaaagagcccagcatcagactgtgccagatacacaatacatctaagtgttacctattattgttaggcatattataaattcccaaggttactcctgaatttattcccaattctccagctttctgagtctgcttgagtgagtcaaggtcattttcatcacctgggaaggcaatgtgtgtcaatggtccccaaatttggctgtgctgacattctaaggctccatcctcaaacactgccttgtacacrgtaggtcctctgtatccacagattcaacaaaactcaaatttcatcacaaacattcaaacacattcggaacatcaaaaacattcaaaccacaacagctctcaagtaagttcccatcccctggtcctcccccattgcctgtccagcctctgaggtggaatgctgcctgtgtcactgtgcactggctgggttttgggccctgcagtgtagctgcacatcctggccccaggaccctgccacccagctggacggctcagctcctgtcccatccctttccacgtctcattatcgggaagaccctca

SEQ ID NO: 62838 - DNA, 601 bp, Human
tgggtgtgagctgcgctgccaggccagttctcgccactcatcatccagctcccagcagcgcaaaagctctactctccttagaaactggagctggttccgggcgatgcccacggactcactgctctcactcactcggatgagcctgccctggggaggggaagggggaagcccagctggcaaggaggctgccatgtgccctgagtgggtgaggttagctgctgcacaaggcaagccggtccctggggctctgctaggcagatgctgggcctggctggcacaaaggggtgcaaatcaccaactygacagtcccccacaagtgacaccccgtggctcactcttggtcttaacttctccctagcagccccagctttcttcctgtattagtccgtttttgtactgctataaataactgcctgtgaccgggcaatttataaaggaaagaggtttaactgactcacagttcagcatggctgggaaggcctcaggaaatttacaatcatggcgaaagggtcacaaaacacctccttcacaaagcagcaggaagacgtgccgagcgaaaggggaagagccctttataataccatcggatcttgtgagaact

SEQ ID NO: 62839 - DNA, 601 bp, Human
acattggctgaacgcctgaaccagcgccagcctgctctctctcactgagctcctttctgtgcctccagcaggtccttcatcccagctggtctttccaggtaaaagcctctgggtctcctttttcctcactcttgctgccaccacctggctcacacccttacttcccacagggctggggacagactcatctccctggtcctgccaatccaccctggaacacattaatcttccaaaataatatttttgcaagtaccaccttctgctcaaaacacctcaatagctgccaattgtccaagagttmaaaatcttcattctggcattcagggtcctatatactctgggctttaccatgaacttgaatctaaaccccgcccccacagctgcctgaggtaaaccatctgctttagccaagctgacgtcctcagcatgtcaccaactggcctcctgacctcggcacatgctgtagcccctattttgagagctcttaaacttccccacgaaagtgcctggggaggaagcttctcattttacttgctaatatatgtggattctgcattctgttcaataaaatccatgtttgtatttgtatttttaagtgttt

SEQ ID NO: 62840 - DNA, 601 bp, Human
gacagagacttccaaattccaaaattcaagttcaaggccctggtgaactatcacctctcctaaattccagttcctcagcctccactgtcttgatgagcaccacctgcaggtgctcacttcaccctcactcagcagatcccaactttggctgtgccttagaatcacctggggagttatgcccaggcagagtccacaaaagtggaaccagaggcccagacactggtattgctgaaaagtttccaggagaccttatggcgggaccaggagtggaaaacgctaaagtcaatgtgaacacccaagsttgtcatggtctcccctaaccagccctgatccacaggtctcacttctgccaacactacgccccagctaggaacacagcacccaacacggcgcaggtcctcagtaacattggctgaacgcctgaaccagcgccagcctgctctctctcactgagctcctttctgtgcctccagcaggtccttcatcccagctggtctttccaggtaaaagcctctgggtctcctttttcctcactcttgctgccaccacctggctcacacccttacttcccacagggctggggacagactcatctccctgg

SEQ ID NO: 62841 - DNA, 601 bp, Human
catggcaggtcatggaccaggcctctcaatgcactctcttagtcacatgacagagacttccaaattccaaaattcaagttcaaggccctggtgaactatcacctctcctaaattccagttcctcagcctccactgtcttgatgagcaccacctgcaggtgctcacttcaccctcactcagcagatcccaactttggctgtgccttagaatcacctggggagttatgcccaggcagagtccacaaaagtggaaccagaggcccagacactggtattgctgaaaagtttccaggagaccttayggcgggaccaggagtggaaaacgctaaagtcaatgtgaacacccaagcttgtcatggtctcccctaaccagccctgatccacaggtctcacttctgccaacactacgccccagctaggaacacagcacccaacacggcgcaggtcctcagtaacattggctgaacgcctgaaccagcgccagcctgctctctctcactgagctcctttctgtgcctccagcaggtccttcatcccagctggtctttccaggtaaaagcctctgggtctcctttttcctcactcttgctgccaccacctgg

SEQ ID NO: 62842 - DNA, 601 bp, Human
ctatttttcttctatgcatttattgtctttattttctaataatcttttttttttttttttttttttgagacggagtctcactctgtcacccaggctgaagtgcagtggtgcaatctcagctcactgcaacctccgcctcccaggttcaagcgattcttctgcctcagcctcccgagtatctgggatttacaggtgcccgccaccacgcccggctaatttttgtatttttagtagagacagggttttgccacgttggcctggctggtcttgaactcctgacctcaagtgatctgcccgcctyggcctcccaaagtgctgggattacaggtgtgagccacagcgcccagccctcattttctaacagtcttctgatccctggttcaccctcaccctgagttaggtacccttttaccatcttttttcccttctgaccagcatgtctcccacacattcaaagctccacccacggcggtgctttccacctgttgatgctgcttcatgtctcctgcgtttaattcagttccctggttttcaattcagatttaaagtcctttccaattttccttcttcttgtcctgagagactctggtctggaaggacc

SEQ ID NO: 62843 - DNA, 601 bp, Human
cctatcccctatttttcttctatgcatttattgtctttattttctaataatcttttttttttttttttttttttgagacggagtctcactctgtcacccaggctgaagtgcagtggtgcaatctcagctcactgcaacctccgcctcccaggttcaagcgattcttctgcctcagcctcccgagtatctgggatttacaggtgcccgccaccacgcccggctaatttttgtatttttagtagagacagggttttgccacgttggcctggctggtcttgaactcctgacctcaagtgatctscccgccttggcctcccaaagtgctgggattacaggtgtgagccacagcgcccagccctcattttctaacagtcttctgatccctggttcaccctcaccctgagttaggtacccttttaccatcttttttcccttctgaccagcatgtctcccacacattcaaagctccacccacggcggtgctttccacctgttgatgctgcttcatgtctcctgcgtttaattcagttccctggttttcaattcagatttaaagtcctttccaattttccttcttcttgtcctgagagactctggtctg

SEQ ID NO: 62844 - DNA, 601 bp, Human
ccttctaggggtttctcagcaattccctcttccctacagcctctcacagccttcccagggacattcagcattttttttttccagtcactggttctgatgcaacccttctggcgttgttcctgagttgctgtttttccagttcagtgtttctgggccaggtgcaccagcgtcccaaagggagctggttaaaatgggagattccagggtcctagcccacagaatccccggcatctgcatctgtgccctcctccaggtgattctcttctacagaatcactgttcaaggtggagtagtagatatraaaacaaggcaaagagcttccagccttcctgggtctttaaaccaaactctcatgctgctgccttaggccatcttcctatgcctatcccctatttttcttctatgcatttattgtctttattttctaataatcttttttttttttttttttttttgagacggagtctcactctgtcacccaggctgaagtgcagtggtgcaatctcagctcactgcaacctccgcctcccaggttcaagcgattcttctgcctcagcctcccgagtatctgggatttacaggtgcccgccaccacgcccgg

SEQ ID NO: 62845 - DNA, 601 bp, Human
ctggcagtaaagaagctagcagtggccgggcaccgtggctcatgcctgtaattccagcactttgggaggccgaggcgggtggatcgcctgaggtcaggagttcgagaccagcctgggcaacttggtgaaaccccgtctctactaaaaatacaaaaattagctgggtatatggtggcacatgcctgtagtcccaagttatttgggaggctgaggcacaagaactgcttgagcccgggaggcagaggttgcagtgagccgagatcacaccactgcactccagcctggatgatggagtgagacyctgtctcaaaaaaagggccaggcgcggtggctcaagcctgtaatcccaacactttgggaggcagaggcgggcagatcacgaggtcaggagttcaagactagcctggccaatatagtgaaaccccgtctctactaaaaatataaaaattagctgggcatggtggcgggcacctgtagtcccagctacttgggaagctgaggcagaagaatcgcttgaacccgggagtcggaggttgcagtgagctgagatctcaccactgccctccagcctgggcgacacagagagactctgtctcaaaaa

SEQ ID NO: 62846 - DNA, 601 bp, Human
ctgggccctggagattataaaattacctcaaggagctgactctactggcagtaaagaagctagcagtggccgggcaccgtggctcatgcctgtaattccagcactttgggaggccgaggcgggtggatcgcctgaggtcaggagttcgagaccagcctgggcaacttggtgaaaccccgtctctactaaaaatacaaaaattagctgggtatatggtggcacatgcctgtagtcccaagttatttgggaggctgaggcacaagaactgcttgagcccgggaggcagaggttgcagtgagcmgagatcacaccactgcactccagcctggatgatggagtgagaccctgtctcaaaaaaagggccaggcgcggtggctcaagcctgtaatcccaacactttgggaggcagaggcgggcagatcacgaggtcaggagttcaagactagcctggccaatatagtgaaaccccgtctctactaaaaatataaaaattagctgggcatggtggcgggcacctgtagtcccagctacttgggaagctgaggcagaagaatcgcttgaacccgggagtcggaggttgcagtgagctgagatctcacca

SEQ ID NO: 62847 - DNA, 601 bp, Human
agatcacatccaatcagggtgatgctgaggatggcttcacgaagacgtgagcattaaagaaagatgggggtctctctgaaacacgaagacgagctcagacaccacactgggtgagtggcacacaggagactcctccctctctggaatcatgaagagcaacttattcccagggctcccgctcaaagtgttctgcacacacacaggcaccatctgaccaccagacagagagggaagaggctccttggcctggggcgagacagctggcgctcgaagccttacttctgggcccaagggcaacagmtgtacctgggagctgactgcactgcccagtcccgggtcctggggtgactcaccaaacccatgaggttgagaagcctgctctggacaccaccaaagtcacctcttcttgccccgtggtcccctttagactgcacagcacgatcaggctctgtggtgacagaggtccacagcccctggggtctctatttatagatctttttacaagtttcttaatcctaaagttttcctggaaataacttatttcaaaagaattgttctgcttttttaaaatatacaacatttttagaataataaaatgcat

SEQ ID NO: 62848 - DNA, 601 bp, Human
cctcacatctgtgtcctcagcccatcctggccccatccagccctaggtgcccaggaagcctcacgctgttgggtggcacagatgtgggttacgactctacactcacagactcaccacccacccctccccccttcagcctctggtcagcaggcgagctgagcagaagccatcagtaaacatgaccttctggccctagatccttcctgggacccagctttgctgcttctagccttccagtgagcatcccctacctaccccagtccacccccgcctgaagaacaaagaggaacaaggctcggtygctcccctgaggacagcggacagggtacattttgggagtgatctagaacatcagacagagcagaccaacaggcaggaggagaggtgtgaacagttggggagatcacatccaatcagggtgatgctgaggatggcttcacgaagacgtgagcattaaagaaagatgggggtctctctgaaacacgaagacgagctcagacaccacactgggtgagtggcacacaggagactcctccctctctggaatcatgaagagcaacttattcccagggctcccgctcaaagtgttctgcacacacac

SEQ ID NO: 62849 - DNA, 601 bp, Human
tgggcactgtcctcacatctgtgtcctcagcccatcctggccccatccagccctaggtgcccaggaagcctcacgctgttgggtggcacagatgtgggttacgactctacactcacagactcaccacccacccctccccccttcagcctctggtcagcaggcgagctgagcagaagccatcagtaaacatgaccttctggccctagatccttcctgggacccagctttgctgcttctagccttccagtgagcatcccctacctaccccagtccacccccgcctgaagaacaaagaggaacraggctcggtcgctcccctgaggacagcggacagggtacattttgggagtgatctagaacatcagacagagcagaccaacaggcaggaggagaggtgtgaacagttggggagatcacatccaatcagggtgatgctgaggatggcttcacgaagacgtgagcattaaagaaagatgggggtctctctgaaacacgaagacgagctcagacaccacactgggtgagtggcacacaggagactcctccctctctggaatcatgaagagcaacttattcccagggctcccgctcaaagtgttct

SEQ ID NO: 62850 - DNA, 601 bp, Human
tcccattctacccaacctggcccacttggcaggctcctgtccacctgggagccctgcagagacctcccatctgctccatcacttgtactgctgcacccaaggcagcccctcctcctcccccatgtcccccacacatggccctgccactgtgtgcgggaaggtgggcactgtcctcacatctgtgtcctcagcccatcctggccccatccagccctaggtgcccaggaagcctcacgctgttgggtggcacagatgtgggttacgactctacactcacagactcaccacccacccctccccscttcagcctctggtcagcaggcgagctgagcagaagccatcagtaaacatgaccttctggccctagatccttcctgggacccagctttgctgcttctagccttccagtgagcatcccctacctaccccagtccacccccgcctgaagaacaaagaggaacaaggctcggtcgctcccctgaggacagcggacagggtacattttgggagtgatctagaacatcagacagagcagaccaacaggcaggaggagaggtgtgaacagttggggagatcacatccaatcagggtgatgctgagg

SEQ ID NO: 62851 - DNA, 601 bp, Human
ctatattgcccaggctagtcttgaactcctgggctcaggtgatcctcctgcctcagttgcccaaaacaatgggactacaggcatgagccaccatacctggcctagagatttttaaaactgaaatttagatagtcacgaagatactagccctatagcacttaggtgtgagctgcacgcattttaaatctgaaacaatacttgcagattttccacagcctccatacacagtggtggccattatcatttccacagcttccatacacagtggtggccattatctctaagctaataagattcagamatttcctgtttcatattcataaatgtgtatctcacttagcaaaatgaatgtgcccctcaaaatatgtctgtaaaaagtaagtttcactctttcagcatgagcagggccctgagctggccctaggagggacggtggcgtgacatcgtccctgtccccagggccaggcaggtgtggccgcaggaagaacttgatgctgggtaagcagggcagctgccgttcctctaaaatgcatccatcaggatcgcctctcattacaggtgaagaactgaagacccaggaaaaaattctgcctctggggaa

SEQ ID NO: 62852 - DNA, 601 bp, Human
cctcacctgtatcctcacctcagcatcacaacattaagtcctagacacaagcacgcactttatcagcctcatctcctctaactttacaaccagtgctgaggcaggtgatgtcactctggttttacagaaggaattgagattaaattaaacaaggtgttaaaactagagggtgagatctcctccagcattcaaatctcattattctatggttcaaaacccctccctaaagcactcctcaacttatttacatatttcacaaccccatcttttcccagaaaggagtgtggacttctttttgggrggggggcggtggtgcagatagagacagggtctcactctgttgcccaggctgcactgcagtggcacattcagggctcaccacagcctcaaactcctgagctcaagcgaacctcccacctcagcctcttgagtagctgggatgacaggtgcacatcacttgtcccagctaattttattctttgtagagatggggtcttgctatattgcccaggctagtcttgaactcctgggctcaggtgatcctcctgcctcagttgcccaaaacaatgggactacaggcatgagccaccatacctggcct

SEQ ID NO: 62853 - DNA, 601 bp, Human
tttcctcacctgtatcctcacctcagcatcacaacattaagtcctagacacaagcacgcactttatcagcctcatctcctctaactttacaaccagtgctgaggcaggtgatgtcactctggttttacagaaggaattgagattaaattaaacaaggtgttaaaactagagggtgagatctcctccagcattcaaatctcattattctatggttcaaaacccctccctaaagcactcctcaacttatttacatatttcacaaccccatcttttcccagaaaggagtgtggacttctttttgggaggggggcggtggtgcagatagagacagggtctcactctgttgcccaggctgcactgcagtggcacattcagggctcaccacagcctcaaactcctgagctcaagcgaacctcccacctcagcctcttgagtagctgggatgacaggtgcacatcacttgtcccagctaattttattctttgtagagatggggtcttgctatattgcccaggctagtcttgaactcctgggctcaggtgatcctcctgcctcagttgcccaaaacaatgggactacaggcatgagccaccatacctgg

SEQ ID NO: 62854 - DNA, 601 bp, Human
ggtggcagcaccctggggtgctcacgcagcgacgggaggcgagggtggcagcagtgctcccaggcaacactgacgtgcagcctgggtggggagtccccctcccggcctcagtttcctcacctgtatcctcacctcagcatcacaacattaagtcctagacacaagcacgcactttatcagcctcatctcctctaactttacaaccagtgctgaggcaggtgatgtcactctggttttacagaaggaattgagattaaattaaacaaggtgttaaaactagagggtgagatctcctccagcrttcaaatctcattattctatggttcaaaacccctccctaaagcactcctcaacttatttacatatttcacaaccccatcttttcccagaaaggagtgtggacttctttttgggaggggggcggtggtgcagatagagacagggtctcactctgttgcccaggctgcactgcagtggcacattcagggctcaccacagcctcaaactcctgagctcaagcgaacctcccacctcagcctcttgagtagctgggatgacaggtgcacatcacttgtcccagctaattttattctttgtagag

SEQ ID NO: 62855 - DNA, 601 bp, Human
ggttgggaaggggaggcctctgtgacttgggggaggctccgggactggagccagcctaactctctggccaacctgggagctggccacctctccttccctccagcctccttcccggctgggcttctgtgggccaggtcttcttctggccttgcttttccccttggaagtgaggcggacaaagaccagacagtgtcagggctggagggagctttgaggggagctgattctcagctcaccggtgaaactggagctcagagtagtggttggacctggaaaattgcccagccggtgaggggcaggrtcagagtccagggttccccccgaatttatgtccccatattgtatgtacctacaagtgcagtgaaaaagcagattttatttttaaaaacttgcagatcaatgaaagaaatactgtcctacataggaggtcaccaggcatgagccaagcctgaccctgcttccagcctggggtcataatctttggtgattggtgtgaagtttttctgagacagttgttctggtgggctgcacagcaggtcttaggtagacaaccgagggggtaatgacagtaactccttgcacaagctcagtgctgttcact

SEQ ID NO: 62856 - DNA, 601 bp, Human
caggccacccagtcaacacctgaatggccagccttattggggccagaagggaactgtgagtgcaggttgggaaggggaggcctctgtgacttgggggaggctccgggactggagccagcctaactctctggccaacctgggagctggccacctctccttccctccagcctccttcccggctgggcttctgtgggccaggtcttcttctggccttgcttttccccttggaagtgaggcggacaaagaccagacagtgtcagggctggagggagctttgaggggagctgattctcagctcacmggtgaaactggagctcagagtagtggttggacctggaaaattgcccagccggtgaggggcaggatcagagtccagggttccccccgaatttatgtccccatattgtatgtacctacaagtgcagtgaaaaagcagattttatttttaaaaacttgcagatcaatgaaagaaatactgtcctacataggaggtcaccaggcatgagccaagcctgaccctgcttccagcctggggtcataatctttggtgattggtgtgaagtttttctgagacagttgttctggtgggctgcacagcagg

SEQ ID NO: 62857 - DNA, 601 bp, Human
ttctcacatgaattttctgggttctcttggttatgccatattccctgaactgtgttgtgtttcatcagagctgatcaacacttgccctgaggatcaaccaccaccacacccggcagaatgttcctgcagcctctgtggcactcaacaagggcccgttgcgtgacgaatcaggaggtcaggcgagtctcagtgctggtcagcaagtcaccgggtgtagattcccaagctctgctggcgtctggttccagcttgtaatgacctgttgacctcttgggtctgagcagccccagtcgcctacccygtttgtggggcaagtctgttggggcaggacaacccacccctgtctgagtggtcagtaccatatgtcctcaggccacccagtcaacacctgaatggccagccttattggggccagaagggaactgtgagtgcaggttgggaaggggaggcctctgtgacttgggggaggctccgggactggagccagcctaactctctggccaacctgggagctggccacctctccttccctccagcctccttcccggctgggcttctgtgggccaggtcttcttctggccttgcttttccccttggaagt

SEQ ID NO: 62858 - DNA, 601 bp, Human
catttgaccctcaagaaacctacaagacaaatgtcaatacctccactttgcagatgaggaaaagtgaggctctgtagggtggataacttatctaaattatctacacgagaacagccccagggtgaaacacagggccttcctcatcacaccagggggcctccacaagacggttcagtgtgagttaagatgtcctagattgtacaatatgagacagacaagatcaatgcagacagacatgctgaaaactgcgcaaatgttatataaaaagaatgctcgcctagctaggcggtgacacatgcattttttttttttaagtgcagagaacccagagggatgcctccacagtgcgagatcagatacaaacaagaaatgagacagtattaaaaaaaaacagagttgaagaatgcctttcaaggggctttacaagccaggaaaggaggattctttaaatatacacaggccacagcagctcctcaataaccacaggtcacagggcccaggggaaggggcgaatacgatgggctactaagcctggacctttgtcacaatggcagccagggaaaatcccctcctatgggggccttctgtaaggaatgagatt

SEQ ID NO: 62859 - DNA, 601 bp, Human
ccagtgggattcacatagattccttcttacccttaaaacaatctctcagcaggtcacggtggctcatgcctgtaaccccagcactttgggaagccgaggcgggtggatcacctgaggtcaggagttttgagaccagcctggccaacatggtgaaaccccgtctccactaaaaatataaaaaaaaaaaaaattagccaggtgtggtggcaggtgcttgtaatcccagctacttgggaagctgaggcaggagaatcgcttgaacccgggagacggaggttgcagtgagccgagattgtgccaytgcactctagcctgggtgacaagaccaagactccatgtcaaaaaaaaaaaaaaaaagaaagaaaaaaaaatctctcaaaagttttacatatggggatactgaagtccaaagaggggcagcaacgagcccaaggccacactcaggacagagcctggctagacaaattcatcccacttggagaattctaggctccggctgtgtgcccagctaggcctgaggatgcaccttacccctcaactccccccacacctctgcacctcccttccacctaacctggacctctccatcctggggccaatg

SEQ ID NO: 62860 - DNA, 601 bp, Human
aggaaaatggcaggcaggtttctctcttgaacagagacagaagacgtaaggagaatgtaggtaaatggaaactcacagggggcaggattccatccttcccaatggtaacagtgctttaccaatcccagtgggattcacatagattccttcttacccttaaaacaatctctcagcaggtcacggtggctcatgcctgtaaccccagcactttgggaagccgaggcgggtggatcacctgaggtcaggagttttgagaccagcctggccaacatggtgaaaccccgtctccactaaaaatataaaaaaaaaaaaaattagccaggtgtggtggcaggtgcttgtaatcccagctacttgggaagctgaggcaggagaatcgcttgaacccgggagacggaggttgcagtgagccgagattgtgccattgcactctagcctgggtgacaagaccaagactccatgtcaaaaaaaaaaaaaaaaagaaagaaaaaaaaatctctcaaaagttttacatatggggatactgaagtccaaagaggggcagcaacgagcccaaggccacactcaggacagagcctggctagacaaattcatcccactt

SEQ ID NO: 62861 - DNA, 601 bp, Human
aatggcgtgaacccgggaggcagagcttgcagtgagcctagatcgcgccactgcactccagcctaagtgacagagccagactccgtctcaaaataaataaataaatcagagataagaaatgtacaaagaaagcaacaaagattaacggtggtctgctgaacaggctaaaacaataagccttagcaagactgattaagaaaaattttaaaaaggcacaaattatcttcagtaatgaaaaaaaggaacatcattacccatttcagacaaaagataaaaagaaaatattaagaatattatgccraaattttgaaaatttgaatggacatgtttctgggggaaaaaaacctctctaaaacctatataaaaggaaatataaaatctgaacaaccttattatctatgacggaaacagaatcttcccctaaagaacactccaggcctataggacttcttcattagggccttttttatttttatttttttatttttaaagccaggatctcactttgttgcccaagctggagtgcagtggcacaatcatggctcactgcagcctcaacctcctgggctcaagcgatcctcccacctcagcctcccaagta

SEQ ID NO: 62862 - DNA, 601 bp, Human
aagaggcaatgacaaagtttaacttagagataagaggctgggcgcggtggctcacgcctgtaatcccagcactttgggagactgaggcaggcagatcacaaggtcaggagatggagaccatcctggctaacatggtgaaaccccacctctactaaaaaaaaaaaatacaaaaaaattagccgggcatggtggcaggcacctgtagtcccagctactcgggaggctgaggctggagaatggcgtgaacccgggaggcagagcttgcagtgagcctagatcgcgccactgcactccagcctargtgacagagccagactccgtctcaaaataaataaataaatcagagataagaaatgtacaaagaaagcaacaaagattaacggtggtctgctgaacaggctaaaacaataagccttagcaagactgattaagaaaaattttaaaaaggcacaaattatcttcagtaatgaaaaaaaggaacatcattacccatttcagacaaaagataaaaagaaaatattaagaatattatgccaaaattttgaaaatttgaatggacatgtttctgggggaaaaaaacctctctaaaacctatataaaa

SEQ ID NO: 62863 - DNA, 601 bp, Human
gagcaagattcagtctccaaaaaacaacaataaagttccattttaagaaggtaaaaaaggacacaaattaagcccaaagaaaaaagaggcaatgacaaagtttaacttagagataagaggctgggcgcggtggctcacgcctgtaatcccagcactttgggagactgaggcaggcagatcacaaggtcaggagatggagaccatcctggctaacatggtgaaaccccacctctactaaaaaaaaaaaatacaaaaaaattagccgggcatggtggcaggcacctgtagtcccagctactcrggaggctgaggctggagaatggcgtgaacccgggaggcagagcttgcagtgagcctagatcgcgccactgcactccagcctaagtgacagagccagactccgtctcaaaataaataaataaatcagagataagaaatgtacaaagaaagcaacaaagattaacggtggtctgctgaacaggctaaaacaataagccttagcaagactgattaagaaaaattttaaaaaggcacaaattatcttcagtaatgaaaaaaaggaacatcattacccatttcagacaaaagataaaaagaaaat

SEQ ID NO: 62864 - DNA, 601 bp, Human
gaactcaggaggtagaggttgcagtgagcctagactgcgccactgaactccagcctgggtaacagagcaagattcagtctccaaaaaacaacaataaagttccattttaagaaggtaaaaaaggacacaaattaagcccaaagaaaaaagaggcaatgacaaagtttaacttagagataagaggctgggcgcggtggctcacgcctgtaatcccagcactttgggagactgaggcaggcagatcacaaggtcaggagatggagaccatcctggctaacatggtgaaaccccacctctactaaaaaaaaaaaatacaaaaaaattagccgggcatggtggcaggcacctgtagtcccagctactcgggaggctgaggctggagaatggcgtgaacccgggaggcagagcttgcagtgagcctagatcgcgccactgcactccagcctaagtgacagagccagactccgtctcaaaataaataaataaatcagagataagaaatgtacaaagaaagcaacaaagattaacggtggtctgctgaacaggctaaaacaataagccttagcaagactgattaagaaaaattttaaaaaggcacaaa

SEQ ID NO: 62865 - DNA, 601 bp, Human
gctctttgaataccaagcagagcaactgcaaagaaaactcccaggcgcagcatcgtaaaactgctgagaaccaaaaacaaagagcattgggaaagcaaccacaggaaaaagtatgcattaatgtaacgggagcaacagtctatctgacaactggcatttcaacaggaatgaaggaagcgggaaggatagtgaaatgcttttaaagggctagaagtaaaaaatggcagcctagaattatctgcaaaaagtcttggcatgatttgaatgtgtctgttcaaaattcaggtgctgccaatgtaayactattaagaggtggggcctttaagaggggatcaggccatgagggttaaggctcttttaaaaggggcatcacataacattcagctagcccacccttctgccatgtatggacaccagagcaaatgctggtgccttgatcttggacttcccggcctctagaactgtaagtagtaaatttctgttctttataaattacccagtttcaggtattctgttgtagcagcacaaaacggatgaagacaggtatctttcgaaaatgaaagcaaaataagcacactcctaggtaatcagaaatggagag

SEQ ID NO: 62866 - DNA, 601 bp, Human
taattagctgggcatggtggcacacgcctgcagtcctagctactcaaaaggctggggtgggagttttgcttgagcccaggaactcgaagatgcataagccactgcactccagcctgagtgacaaagcaagaccctgtctcaaaaaaaaaaaaaaaaaaaaagaaaaaaaaaaaggccaagatgccaggtttcaacaacaaaaaaatgcatacccattggtattattatggttgtcagtcaggaactttaaaataaatgtttaatatattctaaaaaatagatgacaaaataggaatacatmgttagggacctaagtccagtttttaaaatcaaatggaaattctaggacagaaaaatatataattgaaattgatgactcaataaaagagctcaaccactgatctgacaaaccagaggaagacaggattagtaaactgtagattaggcccatcaaaacattgtctgaagtgcaaaaagaaaaaaagattcagaaaaagaagagagatacttctggaacatggtaaaaatgtctaacaaggatattgagtcctagaggaaaggagcgaatgggaagaagcaataaaaagatactggctgaaaa

SEQ ID NO: 62867 - DNA, 601 bp, Human
agaccccggggaaagagaaccatacaacagtgagtctgactttctgtacactattaccctttagtatttgcatggggcaagagaccaagaatccaagcagaaagtgagactaagaggctaagctttcagtagcctcacattgctgaggagttcaagataccatgagaaaagcaccagcctttcaggtaagacccctgagaagctatttcctatctgcccctgctctaaccatctgccacaagaaaagtaaatcttccctggagagacacaacattattcagaagcactactatttcccatycacaatatctagtatttaatttttaaaaatgccaggtggctaaagtgggaggattgcttgaggccaggagtttgagaccagtttgggcaacacagtgagactccatctctacaaaaaaccatttttttaattagctgggcatggtggcacacgcctgcagtcctagctactcaaaaggctggggtgggagttttgcttgagcccaggaactcgaagatgcataagccactgcactccagcctgagtgacaaagcaagaccctgtctcaaaaaaaaaaaaaaaaaaaaagaaaaaaaaaaa

SEQ ID NO: 62868 - DNA, 601 bp, Human
cgggtcccaagttttcttttgggggaagatgttgcggaactagctagaggtggtggtggcacaacatggtgagtgtactaaaccactttcaaggggtttcattttagctctataaaaaagaaaaaaaaatgaagcaaacctgagtttttctaactgcatatctaatttataataccatattcatttttaaaaattatttttcaaaaaaagtcccagattaagggaggttttggtggcctcttctacttttctatatcttcaaaattgtatccaacaatcatatgatggtagagagtttgartgtctatgtgcaggcactgtgcaataactacttaacacttatctcccctaaggccataggagaggggcagagactctggtacttggctctcagctgctatactatgtgagaggaaggtgttacatttataatctcttaatcaggataaaacatggctaggacactctcaaatatcaggaccaaaaaaaaggcttgaaggaatatgcctctgtgatggttaatactaagtgtcaacttgattggattgaaggatacaaagtattgatcctgggtgtgtctgtgagggtgttgccaaaggag

SEQ ID NO: 62869 - DNA, 601 bp, Human
tcagagaggctcagttttgtagctccacctggcagcaggtgtgtgctgagtgggttttctgggtgccgcctgttgccaggtggcggctggggtgcttagcaaccctcaaggtccccaactaacccctgaagtgtggtcacatgggaataaagacaaacaactccagttctgtcctctgggcctcctgctctaccctcacatgcccacagagccgggaggctggaccaaggtcagcatgcaccctggcggccccgcaccacagggaagcgccatggcactgcctgcgaagccagatatgtgytcggcagaggcaaagaggacgcttcgcatgccagggctgcaccaagagctccaaatccacaaggcctcagggcagggcaggctccactacctccctgaaggagactggagccagggaggttaaagcagcaaagccactggaatctgagacccttgccattacccaaatgctctgttgcctcaatgcaccctttgacatgtggacatgctcaccccagtgaggaggcagaaagggatgcctgtgcttgagggactgtgccgcctcaccctcctggaccatggctggctgcccacccatctg

SEQ ID NO: 62870 - DNA, 601 bp, Human
gcaagtgggttaaagcagaaggagaggtggggagaggcagctgtgtctctgtgcagtcccccaagacctgaatggaaacccacccagcgtccacctcagctgtctccccaggatcccaagggtgaagatggggatggctttctaccctagaccctgtgcagtctgccctgggctctccctctacgtgccctggctgcagcatcctcctgtctgagggtgggcactgtggacagtcctcacctccgagggaggaccaggcacagggccagttaaccacacaggacgcgtgtgaaggaagcayaggcctgcccctgtcatccctccatcttcccacatcctccgtcaaccatgttccgatccctgggaagtgattctgagtatgattcagagaggctcagttttgtagctccacctggcagcaggtgtgtgctgagtgggttttctgggtgccgcctgttgccaggtggcggctggggtgcttagcaaccctcaaggtccccaactaacccctgaagtgtggtcacatgggaataaagacaaacaactccagttctgtcctctgggcctcctgctctaccctcacatgcccacagagccggga

SEQ ID NO: 62871 - DNA, 601 bp, Human
ctctgactcccctctcccctaccaagcgcctataagaacagggctcagggttgatgacaccttgtcctaatagcaaaaggtcttgagggaaacagtgaccaggcttgggcaaaggttacagaggaagaacattcagaaaagcaagagatacaatccaagcttaggaaatggcagcctcccagtgtcccaagctccggggctcccaggagaggggcctgacgcttgtggtcaatgggcggttcttccctgtaagaccggcctgaaggaaaaacaccatccctagtaacaggtgaccctgcamgtgggttaaagcagaaggagaggtggggagaggcagctgtgtctctgtgcagtcccccaagacctgaatggaaacccacccagcgtccacctcagctgtctccccaggatcccaagggtgaagatggggatggctttctaccctagaccctgtgcagtctgccctgggctctccctctacgtgccctggctgcagcatcctcctgtctgagggtgggcactgtggacagtcctcacctccgagggaggaccaggcacagggccagttaaccacacaggacgcgtgtgaaggaagcatagg

SEQ ID NO: 62872 - DNA, 601 bp, Human
ctagaagcccaaccccaggccaagaggcaactggcctctggctctgactcccctctcccctaccaagcgcctataagaacagggctcagggttgatgacaccttgtcctaatagcaaaaggtcttgagggaaacagtgaccaggcttgggcaaaggttacagaggaagaacattcagaaaagcaagagatacaatccaagcttaggaaatggcagcctcccagtgtcccaagctccggggctcccaggagaggggcctgacgcttgtggtcaatgggcggttcttccctgtaagaccggcmtgaaggaaaaacaccatccctagtaacaggtgaccctgcaagtgggttaaagcagaaggagaggtggggagaggcagctgtgtctctgtgcagtcccccaagacctgaatggaaacccacccagcgtccacctcagctgtctccccaggatcccaagggtgaagatggggatggctttctaccctagaccctgtgcagtctgccctgggctctccctctacgtgccctggctgcagcatcctcctgtctgagggtgggcactgtggacagtcctcacctccgagggaggaccaggcacag

SEQ ID NO: 62873 - DNA, 601 bp, Human
atgccatgatgcagccacggtgcaacgagcaagacgcagagcagctatggatccacaggcagaggcacagccctcccactcgacaccagcttcgtctcctcttcccactcttagtggtccccctgccccgacctcactgttgccaggataacagtggcacggtggggcttggcactagaagcccaaccccaggccaagaggcaactggcctctggctctgactcccctctcccctaccaagcgcctataagaacagggctcagggttgatgacaccttgtcctaatagcaaaaggtcttgrgggaaacagtgaccaggcttgggcaaaggttacagaggaagaacattcagaaaagcaagagatacaatccaagcttaggaaatggcagcctcccagtgtcccaagctccggggctcccaggagaggggcctgacgcttgtggtcaatgggcggttcttccctgtaagaccggcctgaaggaaaaacaccatccctagtaacaggtgaccctgcaagtgggttaaagcagaaggagaggtggggagaggcagctgtgtctctgtgcagtcccccaagacctgaatggaaacccacccagcg

SEQ ID NO: 62874 - DNA, 601 bp, Human
aaaaatattagatatctttgtgggtggttctgtgaagaagatagcgagtacaatgcaaggctgatgctgggggtggggacgtgtctgtgtgtctcctgtgaagcagacaatggatttgacccattacattagacgcggagaatgccatgatgcagccacggtgcaacgagcaagacgcagagcagctatggatccacaggcagaggcacagccctcccactcgacaccagcttcgtctcctcttcccactcttagtggtccccctgccccgacctcactgttgccaggataacagtggcayggtggggcttggcactagaagcccaaccccaggccaagaggcaactggcctctggctctgactcccctctcccctaccaagcgcctataagaacagggctcagggttgatgacaccttgtcctaatagcaaaaggtcttgagggaaacagtgaccaggcttgggcaaaggttacagaggaagaacattcagaaaagcaagagatacaatccaagcttaggaaatggcagcctcccagtgtcccaagctccggggctcccaggagaggggcctgacgcttgtggtcaatgggcggttcttc

SEQ ID NO: 62875 - DNA, 601 bp, Human
cggagggttcgtatctgtgactggcggaaagcagaccctttgcattctctccttgacccagatgcagcaactcagtaccaccctgggcataaaggcccaagaaaattataccgacaaaatttccacctttacccacggcactccctaagctccgtcctctgctttctctccacagcccttcccagctcctgacatagcacatactcgtctgtttaatgtgtgttgcccacactagaatctgttctgctcacaactgtatccccagtgcctagaaaagtcctgaaatacttgtggtctgaattttttttttttttttttttttttaaagagacagggtcccgctgtctcccaggctggagtgctgaagtgtagtcacagctcactgcacactgatcttgctgggctcaggtgatcctcccgcctcagcctcccaagtagctgggactacaggtgcgcaccaccaccatgcctggattttttttaagtttttttgtagagataaggtcttgccatgtctggtgttggactcctgggctcaagaggggctcagtgacccagttagaatgtgaatgcaagtcttacttgcaacctttgttgacag

SEQ ID NO: 62876 - DNA, 601 bp, Human
gccaccatcctctagaacagcgctaatagaacttcctgcaatcacagaaatgttctgtatctttgctgtccaatatggcagccacatttagctactgagcacatgaaatgtggctagtgctactgaaagactaacattttctaattaattaagtttaatttaaatagctacatatgacaagtggctaccatactgctacctattgcagctctagaacactgtagtcacaagtactgtgccaactctgatgggcagagagcagctgcctcgagccctgtgttgagaaggatgcggagggttygtatctgtgactggcggaaagcagaccctttgcattctctccttgacccagatgcagcaactcagtaccaccctgggcataaaggcccaagaaaattataccgacaaaatttccacctttacccacggcactccctaagctccgtcctctgctttctctccacagcccttcccagctcctgacatagcacatactcgtctgtttaatgtgtgttgcccacactagaatctgttctgctcacaactgtatccccagtgcctagaaaagtcctgaaatacttgtggtctgaatttttttttt

SEQ ID NO: 62877 - DNA, 601 bp, Human
cctctcccggatgaggggacgaagtaccacaatgtgtgaaatctggaaactccaatactgccgccatttagactagggggcccacgtgtgctgcccctgcccaagagatgtgttccccacctcagtcactcgaaggacagtcactggtcatctatgcatgtccctgagctaaatgctgggaaggtcaaaggtaaacagtactccaaagagcttggatgggtggggcaatggtcacacgtgggagagactggtctcccagggcaggagtgcttcacagtcttcagccaaatgctgtaggaaygtagaggagggaggagctgcataactgtaaaagtcagcatatttggaaacaaggcctccagcatgagaacaggcaccagaccagtgtccccagagtccccagatcaacaggccccaagagaagcagggccacatttaatctcagtgttggcggggccagactaacaagccaccaggccatgtcatctggaacagtgcggaaatcacacagacccagggtcagcccagagctcttaccctgccagagcaggagaggggacaccgaacatgtgggacttctggtcactggcctggtctcctg

SEQ ID NO: 62878 - DNA, 601 bp, Human
tcctgggtaaagcaagaacctgcccagatcctgggaagaagcacccaggcctgcagtggggtagagagttgagaagggcctggggcaagatgctgggcctcctgggctgggatctcagctgagagcagatgtgttgagcttctcaccccagggcaatctgtcggcatggcctccacagggctccgagaaggaaccacccaagcccccttctactcagggatgactcatgccaggcctggttcgcactggctcaggacagagatagaagggggaggcagccagcactgttcccaggggcccragctgttacagctgaggctctgatgaggcattcaggagttaattacagcaaggaggccaggagggatttggataaatgaggttggctggtgagaagctaagtttctacaacatccttgtaagagggagacagttaggtcgagagagacccatagtgctcaggtggctgggaatgagtgtgaatgtggagagtgtgtgtgtgtgtgtccatgcgttagcgcttgcacatgtacacacatgcagctgcatgtacgtgtctactgtctacagtgtctgcatgaggtatgtatatgaagtctgt

SEQ ID NO: 62879 - DNA, 601 bp, Human
tgtagaaaagggacaagacttgctttggaggccccaagagagaaagctaatgaggaaaggctgctggggaacagaatgttgctttcagagaaggaagaatttttaaagagtcaaacagttcaaagaatgtgctgccctgagaggtggtgaactcccattcccagaaaccgagagagaagactgcgggaagagccgagcaggggtggaaggctggaccggaggagggggatgtggccaaaccctgggggccgaggcctgggtgcccagatgtggttctgcacagagaagaaggagggtaaastcttcattctcctcagccttcaagtccttgatggttatcctaaaaatacagcatggtaataaaagtcaaggccctgaccctctctgggaaaagaatcaaagtccagagaaaaaacaacaagccctggaagttcctagtaggtttcctgggtaaagcaagaacctgcccagatcctgggaagaagcacccaggcctgcagtggggtagagagttgagaagggcctggggcaagatgctgggcctcctgggctgggatctcagctgagagcagatgtgttgagcttctcaccccagggcaat

SEQ ID NO: 62880 - DNA, 601 bp, Human
tgaaacacgagaatcgcttgaacccgggagagagaggctgcagtgaactgagactgcgccactgcactccagcctgggtgacagagcgagcctccatcccgaaacaaataaaaataataaaataaaatgaattcccagcataaagtagctgcctgaacaagccccttggctctgggctgtgtgacagaaaaataaaaaggccccggtccagcttaaccaggctgtgtccttagccccaggtcccccccacccccttcttcttaggaagctgtctttaagtctgaggaaagctgctatgtakaaaagggacaagacttgctttggaggccccaagagagaaagctaatgaggaaaggctgctggggaacagaatgttgctttcagagaaggaagaatttttaaagagtcaaacagttcaaagaatgtgctgccctgagaggtggtgaactcccattcccagaaaccgagagagaagactgcgggaagagccgagcaggggtggaaggctggaccggaggagggggatgtggccaaaccctgggggccgaggcctgggtgcccagatgtggttctgcacagagaagaaggagggtaaagtctt

SEQ ID NO: 62881 - DNA, 601 bp, Human
aatacaaaaattagcagggcttcgtggcgggcacctgtaataccagctgctcaggaggctgaaacacgagaatcgcttgaacccgggagagagaggctgcagtgaactgagactgcgccactgcactccagcctgggtgacagagcgagcctccatcccgaaacaaataaaaataataaaataaaatgaattcccagcataaagtagctgcctgaacaagccccttggctctgggctgtgtgacagaaaaataaaaaggccccggtccagcttaaccaggctgtgtccttagccccaggtcccccccacccccttcttcttaggaagctgtctttaagtctgaggaaagctgctatgtagaaaagggacaagacttgctttggaggccccaagagagaaagctaatgaggaaaggctgctggggaacagaatgttgctttcagagaaggaagaatttttaaagagtcaaacagttcaaagaatgtgctgccctgagaggtggtgaactcccattcccagaaaccgagagagaagactgcgggaagagccgagcaggggtggaaggctggaccggaggagggggatgtggccaaaccctggg

SEQ ID NO: 62882 - DNA, 601 bp, Human
gtcaagagttcaagaccagcctgggccacatggtgaaaccccatccctactaaaaatacaaaaattagcagggcttcgtggcgggcacctgtaataccagctgctcaggaggctgaaacacgagaatcgcttgaacccgggagagagaggctgcagtgaactgagactgcgccactgcactccagcctgggtgacagagcgagcctccatcccgaaacaaataaaaataataaaataaaatgaattcccagcataaagtagctgcctgaacaagccccttggctctgggctgtgtgacagaaaaataaaaaggccccggtccagcttaaccaggctgtgtccttagccccaggtcccccccacccccttcttcttaggaagctgtctttaagtctgaggaaagctgctatgtagaaaagggacaagacttgctttggaggccccaagagagaaagctaatgaggaaaggctgctggggaacagaatgttgctttcagagaaggaagaatttttaaagagtcaaacagttcaaagaatgtgctgccctgagaggtggtgaactcccattcccagaaaccgagagagaagactgcgggaagag

SEQ ID NO: 62883 - DNA, 601 bp, Human
ggcggatcacttaaggtcaagagttcaagaccagcctgggccacatggtgaaaccccatccctactaaaaatacaaaaattagcagggcttcgtggcgggcacctgtaataccagctgctcaggaggctgaaacacgagaatcgcttgaacccgggagagagaggctgcagtgaactgagactgcgccactgcactccagcctgggtgacagagcgagcctccatcccgaaacaaataaaaataataaaataaaatgaattcccagcataaagtagctgcctgaacaagccccttggctcygggctgtgtgacagaaaaataaaaaggccccggtccagcttaaccaggctgtgtccttagccccaggtcccccccacccccttcttcttaggaagctgtctttaagtctgaggaaagctgctatgtagaaaagggacaagacttgctttggaggccccaagagagaaagctaatgaggaaaggctgctggggaacagaatgttgctttcagagaaggaagaatttttaaagagtcaaacagttcaaagaatgtgctgccctgagaggtggtgaactcccattcccagaaaccgagagaga

SEQ ID NO: 62884 - DNA, 601 bp, Human
gacacaatgtaccaatgttgcggggggtagaagggggacacctaccatttgagatgctgttagatttaaaatgaattcccagcctgggcatggtggatcacgcctgtaatcccagcactttgggaggctgaggtgggcggatcacttaaggtcaagagttcaagaccagcctgggccacatggtgaaaccccatccctactaaaaatacaaaaattagcagggcttcgtggcgggcacctgtaataccagctgctcaggaggctgaaacacgagaatcgcttgaacccgggagagagaggytgcagtgaactgagactgcgccactgcactccagcctgggtgacagagcgagcctccatcccgaaacaaataaaaataataaaataaaatgaattcccagcataaagtagctgcctgaacaagccccttggctctgggctgtgtgacagaaaaataaaaaggccccggtccagcttaaccaggctgtgtccttagccccaggtcccccccacccccttcttcttaggaagctgtctttaagtctgaggaaagctgctatgtagaaaagggacaagacttgctttggaggccccaagagag

SEQ ID NO: 62885 - DNA, 601 bp, Human
ctgtgctactcctcacaggctgaggagaggaggggcccacgtggcaaagcccggcctcagagcaggcatgagtggccaccgtgtactcagaaagtactcaactgggctgagcgtgagaggcctgatgccaggacagccccggacctcgacagaggcctgctgctccccaacacccccagcagacgcctgcctgcctctccacggccaggagccgctgcccgaggacccgagctgccaacgcccgcggaaacttgggttgccctcgtcactgccacacagagtggccgagccggtgctgggrgtgcagccctggttcagccgagcccatccccaggacttcaggctgccctacccagagtgtggctggtggggctgtggactcagcatcacccgtgctcatcagggtggggaagccacggaccgtgaggcacacctgtgcacctgaggtttgagaagtctctcttgaggaacaagatttgaaggaaaggaacagctggagggtgtgtgtgtgtgtgtgtgtgtgtgtgtgtgtgtgtgtgtgtgtgtgtgtgtgtgtgtgtgtaggggtgttatttgtacaacattctggaagagtctacct

SEQ ID NO: 62886 - DNA, 601 bp, Human
aacatagaaatggatccttctgctcttaaggcttaaaacttctacttatctgagttccttcctcagcaaaggaccttcaggcctctcaaatgaagtactgaataactgaaactcaccaaccaggtcaccacatccagacaatgagactcaggacccctcattcctattgtctcgcgcgttgttccatttcttccctgccgtgtaaaccccggatttagcaggtcagagagatggattggagactgagtccccatatcctctaccgcagcacccgattaaagccgtattccttggcaataaytgctgtcacagtgattggctttctgtgcaagcagcaggacccagaccgaagccctggtgttttgtaacatagtaaggccctgacagtgcggctctggctctggacaccctccccagggctccatgccacctgggcgtgggaatcaggcagccccttccggtgggtccttcctcacagaaacggcccagcggctgcctcggggggaacttgcaacagcctctgatgtgtctcccagcaccccggtccgctcctcctctgcaatccactgtccccacggcatctgatgtcctcaaagacgtc

SEQ ID NO: 62887 - DNA, 601 bp, Human
gcatagaaataaaggcagaaggctatatgcaaagagaaaaggctcatttaacttggacgaccgaattagggaaaacctgaaacgtttttcaaagttgctatagggtgctggtggttgttctttttaaaaatactttttaaactggaaataaacatggaacttcctgttgcctccagctgtgatcctatccctgacctcggcttctctggaaggaccacagttttcttagaaagggaacatccctcaaggcctttgggcttggctccagacttcctagtcagcttggacataacctgaggakggggaacctatggccaggcacgaaccaaggagacacacagccaaaatgggggtgggggaaggcagtggtcctcctaggaagccaaagacagaacggtcaccctgggctggcttcgctctgtagctctcatgaacccagcacccaccaggtgacagacaccatccacccagtcaaaatcatccctctcctttgctaaaacttctgcatcaacccggtattatttatgtgcaatattgtctcaagtttgcaggtgacaaagcctaggcacagagagatgaagttgtctgttacacatcccaa

SEQ ID NO: 62888 - DNA, 601 bp, Human
cagtggccggtcttttctgtgctattcttgtgatagtgaataaatgtcacgagatctgatgggtttatcaggagtttctgcttttgctttttgctcattttctcttgctgccaccaggtaagaagtgcctttcacctcccgccatgattctgaggcctcctcagccatgtggaactctaagtccaattaaacctctttttcttcccagtctcaggtatgtctttatcagcagcgtgaaaacggactaatacagtaaattggtaccagtagagtggcacattgctgaaaagatacccaaaamcgtggaagtgactttggaactgggtaacaggcagaggtcagaacagtttggagggctcagaagaagacaggaaactgtggggaagtctggaacctcccagagacttgttaaatggctttgacaaaaatgctgttagtgatacgaacaataaggtccaggctgaggtggtctcagatggagataaggaacttgttgggaactggagcaaaggtgactgttatgttttagcaaagagattggtggcattttgcccctgccctagagatttgtggaactttgaacttgagagatgatttaggg

SEQ ID NO: 62889 - DNA, 601 bp, Human; identical to SEQ ID NO: 29250

SEQ ID NO: 62890 - DNA, 601 bp, Human; identical to SEQ ID NO: 29249

SEQ ID NO: 62891 - DNA, 601 bp, Human; identical to SEQ ID NO: 29248

SEQ ID NO: 62892 - DNA, 601 bp, Human; identical to SEQ ID NO: 29247

SEQ ID NO: 62893 - DNA, 601 bp, Human; identical to SEQ ID NO: 29246

SEQ ID NO: 62894 - DNA, 601 bp, Human; identical to SEQ ID NO: 29245

SEQ ID NO: 62895 - DNA, 601 bp, Human; identical to SEQ ID NO: 29244

SEQ ID NO: 62896 - DNA, 601 bp, Human; identical to SEQ ID NO: 29243

SEQ ID NO: 62897 - DNA, 601 bp, Human; identical to SEQ ID NO: 29242

SEQ ID NO: 62898 - DNA, 601 bp, Human; identical to SEQ ID NO: 29241

SEQ ID NO: 62899 - DNA, 601 bp, Human; identical to SEQ ID NO: 29240

SEQ ID NO: 62900 - DNA, 601 bp, Human; identical to SEQ ID NO: 29239

SEQ ID NO: 62901 - DNA, 601 bp, Human; identical to SEQ ID NO: 29238

SEQ ID NO: 62902 - DNA, 601 bp, Human; identical to SEQ ID NO: 29237

SEQ ID NO: 62903 - DNA, 601 bp, Human; identical to SEQ ID NO: 29236

SEQ ID NO: 62904 - DNA, 601 bp, Human; identical to SEQ ID NO: 29235

SEQ ID NO: 62905 - DNA, 601 bp, Human; identical to SEQ ID NO: 29234

SEQ ID NO: 62906 - DNA, 601 bp, Human; identical to SEQ ID NO: 29233

SEQ ID NO: 62907 - DNA, 601 bp, Human; identical to SEQ ID NO: 29232

SEQ ID NO: 62908 - DNA, 601 bp, Human; identical to SEQ ID NO: 29231

SEQ ID NO: 62909 - DNA, 601 bp, Human; identical to SEQ ID NO: 29230

SEQ ID NO: 62910 - DNA, 601 bp, Human; identical to SEQ ID NO: 29229

SEQ ID NO: 62911 - DNA, 601 bp, Human; identical to SEQ ID NO: 29228

SEQ ID NO: 62912 - DNA, 601 bp, Human; identical to SEQ ID NO: 29227

SEQ ID NO: 62913 - DNA, 601 bp, Human; identical to SEQ ID NO: 29226

SEQ ID NO: 62914 - DNA, 601 bp, Human; identical to SEQ ID NO: 20536

SEQ ID NO: 62915 - DNA, 601 bp, Human; identical to SEQ ID NO: 20537

SEQ ID NO: 62916 - DNA, 601 bp, Human; identical to SEQ ID NO: 19312

SEQ ID NO: 62917 - DNA, 601 bp, Human; identical to SEQ ID NO: 19313

SEQ ID NO: 62918 - DNA, 601 bp, Human; identical to SEQ ID NO: 19314

SEQ ID NO: 62919 - DNA, 601 bp, Human; identical to SEQ ID NO: 19315

SEQ ID NO: 62920 - DNA, 601 bp, Human; identical to SEQ ID NO: 19316

SEQ ID NO: 62921 - DNA, 601 bp, Human; identical to SEQ ID NO: 19317

SEQ ID NO: 62922 - DNA, 601 bp, Human; identical to SEQ ID NO: 19318

SEQ ID NO: 62923 - DNA, 601 bp, Human; identical to SEQ ID NO: 19319

SEQ ID NO: 62924 - DNA, 601 bp, Human; identical to SEQ ID NO: 19320

SEQ ID NO: 62925 - DNA, 601 bp, Human; identical to SEQ ID NO: 19321

SEQ ID NO: 62926 - DNA, 601 bp, Human; identical to SEQ ID NO: 19322

SEQ ID NO: 62927 - DNA, 601 bp, Human; identical to SEQ ID NO: 19323

SEQ ID NO: 62928 - DNA, 601 bp, Human; identical to SEQ ID NO: 19324

SEQ ID NO: 62929 - DNA, 601 bp, Human; identical to SEQ ID NO: 19325

SEQ ID NO: 62930 - DNA, 601 bp, Human; identical to SEQ ID NO: 19326

SEQ ID NO: 62931 - DNA, 601 bp, Human; identical to SEQ ID NO: 19327

SEQ ID NO: 62932 - DNA, 601 bp, Human; identical to SEQ ID NO: 19328

SEQ ID NO: 62933 - DNA, 601 bp, Human; identical to SEQ ID NO: 19329

SEQ ID NO: 62934 - DNA, 601 bp, Human; identical to SEQ ID NO: 19330

SEQ ID NO: 62935 - DNA, 601 bp, Human
aagaagaataacaaggtaaaagaataacggtgaaaaaaacatcacaactgccgctcgagagtttggaattttgtaaaattgtatttgaaaagcaagttggaaatatgtgttaaacatatttactagcatgttaaacgttaaattagtaaatatttaaaactttcaattgcatagtttcacttctaagaatatgttcaaagcaaataagtggtttagtcatgagtatttgggggtacagttcaatggttgtagggagaagggtcgggcccttctgttttgccctcaggtttgcttaccaagygcagtgattctctactcagactacacatcatcattgcacgggagctttaaatatttctgatgtccaggagggatgatcgactccttaaatcccagtctctgagggcgggactcatattcttaaatgttctcctgctcattctaatgtgcggtctcggtgaagaaccactgggtattaccaacagacctagatcaaatattcttttaattgatttcaagttactcacctcctgggctccaaatttgagaaaggaggagaaaggaaaaatccacacgactttagcactgatggttttcttgc

SEQ ID NO: 62936 - DNA, 601 bp, Human
aattgtatttgaaaagcaagttggaaatatgtgttaaacatatttactagcatgttaaacgttaaattagtaaatatttaaaactttcaattgcatagtttcacttctaagaatatgttcaaagcaaataagtggtttagtcatgagtatttgggggtacagttcaatggttgtagggagaagggtcgggcccttctgttttgccctcaggtttgcttaccaagtgcagtgattctctactcagactacacatcatcattgcacgggagctttaaatatttctgatgtccaggagggatgrtcgactccttaaatcccagtctctgagggcgggactcatattcttaaatgttctcctgctcattctaatgtgcggtctcggtgaagaaccactgggtattaccaacagacctagatcaaatattcttttaattgatttcaagttactcacctcctgggctccaaatttgagaaaggaggagaaaggaaaaatccacacgactttagcactgatggttttcttgctccaaccttgacattaggctcacttggactattccctcagtggacacaagcagagaaaggaaaggtgggcattggc

SEQ ID NO: 62937 - DNA, 601 bp, Human
aagtggtttagtcatgagtatttgggggtacagttcaatggttgtagggagaagggtcgggcccttctgttttgccctcaggtttgcttaccaagtgcagtgattctctactcagactacacatcatcattgcacgggagctttaaatatttctgatgtccaggagggatgatcgactccttaaatcccagtctctgagggcgggactcatattcttaaatgttctcctgctcattctaatgtgcggtctcggtgaagaaccactgggtattaccaacagacctagatcaaatattctttwaattgatttcaagttactcacctcctgggctccaaatttgagaaaggaggagaaaggaaaaatccacacgactttagcactgatggttttcttgctccaaccttgacattaggctcacttggactattccctcagtggacacaagcagagaaaggaaaggtgggcattggccctatgctgggccctatgctggggagggggaagcaaagaggacaagtagggctgtggtttcatagggagcagtttctaccagggaaagagagggaaaggagatggggagggaggggaaggggaagaaag

SEQ ID NO: 62938 - DNA, 601 bp, Human
tgttttgccctcaggtttgcttaccaagtgcagtgattctctactcagactacacatcatcattgcacgggagctttaaatatttctgatgtccaggagggatgatcgactccttaaatcccagtctctgagggcgggactcatattcttaaatgttctcctgctcattctaatgtgcggtctcggtgaagaaccactgggtattaccaacagacctagatcaaatattcttttaattgatttcaagttactcacctcctgggctccaaatttgagaaaggaggagaaaggaaaaatccamacgactttagcactgatggttttcttgctccaaccttgacattaggctcacttggactattccctcagtggacacaagcagagaaaggaaaggtgggcattggccctatgctgggccctatgctggggagggggaagcaaagaggacaagtagggctgtggtttcatagggagcagtttctaccagggaaagagagggaaaggagatggggagggaggggaaggggaagaaaggggaagaggaagaggacacagttaaataaaccaaattcatttccaatagtggagagtaccgtagagg

SEQ ID NO: 62939 - DNA, 601 bp, Human
cagtttctaccagggaaagagagggaaaggagatggggagggaggggaaggggaagaaaggggaagaggaagaggacacagttaaataaaccaaattcatttccaatagtggagagtaccgtagaggagggtaagcaggttgacatgataggccttgcctggggcagcagtcagatggggcaacagtgtcctctgatgctgcatctttgagctaagactcactccagtgacaagaagttcccactgtggaaagacgttctgaggaatattgggtgagctggcagagtcagtgggagggtcmtgaaggacgaaagaccttgagagggaggctggctagagccaagtgagcctgggagagaaaggtgggagtggagagcggtcagagaggtgggcatgagtgggacatgcctaggtcatgattttgaggagtttgaggtctgttttaagggcaatgggtagcccctagggacatgtgcatttgcaaaacatctctgcttagcttgggccaccgtaacaaagtaccacgaacacataacaaaccatggtctaggtggtgcataaaaaacaccaatttatttctcagaattcaggaggctgagat

SEQ ID NO: 62940 - DNA, 601 bp, Human
taggccttgcctggggcagcagtcagatggggcaacagtgtcctctgatgctgcatctttgagctaagactcactccagtgacaagaagttcccactgtggaaagacgttctgaggaatattgggtgagctggcagagtcagtgggagggtcctgaaggacgaaagaccttgagagggaggctggctagagccaagtgagcctgggagagaaaggtgggagtggagagcggtcagagaggtgggcatgagtgggacatgcctaggtcatgattttgaggagtttgaggtctgttttaaggkcaatgggtagcccctagggacatgtgcatttgcaaaacatctctgcttagcttgggccaccgtaacaaagtaccacgaacacataacaaaccatggtctaggtggtgcataaaaaacaccaatttatttctcagaattcaggaggctgagatctgggatgagggtgccagcatggtctggttctggtgagggccctcttctgggctgcagactgctgatttcctgctgtatcctcacatggcagaaagagagctagctgactctccagcctcttcttataaggatgctaatcccacttat

SEQ ID NO: 62941 - DNA, 601 bp, Human
tcactccagtgacaagaagttcccactgtggaaagacgttctgaggaatattgggtgagctggcagagtcagtgggagggtcctgaaggacgaaagaccttgagagggaggctggctagagccaagtgagcctgggagagaaaggtgggagtggagagcggtcagagaggtgggcatgagtgggacatgcctaggtcatgattttgaggagtttgaggtctgttttaagggcaatgggtagcccctagggacatgtgcatttgcaaaacatctctgcttagcttgggccaccgtaacaaartaccacgaacacataacaaaccatggtctaggtggtgcataaaaaacaccaatttatttctcagaattcaggaggctgagatctgggatgagggtgccagcatggtctggttctggtgagggccctcttctgggctgcagactgctgatttcctgctgtatcctcacatggcagaaagagagctagctgactctccagcctcttcttataaggatgctaatcccacttataagtgctctaccttgaagacctaataacctcccaaaggcccaacctccaaatatcacatcagggattaga

SEQ ID NO: 62942 - DNA, 601 bp, Human
tgtggaaagacgttctgaggaatattgggtgagctggcagagtcagtgggagggtcctgaaggacgaaagaccttgagagggaggctggctagagccaagtgagcctgggagagaaaggtgggagtggagagcggtcagagaggtgggcatgagtgggacatgcctaggtcatgattttgaggagtttgaggtctgttttaagggcaatgggtagcccctagggacatgtgcatttgcaaaacatctctgcttagcttgggccaccgtaacaaagtaccacgaacacataacaaaccatgrtctaggtggtgcataaaaaacaccaatttatttctcagaattcaggaggctgagatctgggatgagggtgccagcatggtctggttctggtgagggccctcttctgggctgcagactgctgatttcctgctgtatcctcacatggcagaaagagagctagctgactctccagcctcttcttataaggatgctaatcccacttataagtgctctaccttgaagacctaataacctcccaaaggcccaacctccaaatatcacatcagggattagagtttcactatacggattggggcaggg

SEQ ID NO: 62943 - DNA, 601 bp, Human
gacgttctgaggaatattgggtgagctggcagagtcagtgggagggtcctgaaggacgaaagaccttgagagggaggctggctagagccaagtgagcctgggagagaaaggtgggagtggagagcggtcagagaggtgggcatgagtgggacatgcctaggtcatgattttgaggagtttgaggtctgttttaagggcaatgggtagcccctagggacatgtgcatttgcaaaacatctctgcttagcttgggccaccgtaacaaagtaccacgaacacataacaaaccatggtctaggtrgtgcataaaaaacaccaatttatttctcagaattcaggaggctgagatctgggatgagggtgccagcatggtctggttctggtgagggccctcttctgggctgcagactgctgatttcctgctgtatcctcacatggcagaaagagagctagctgactctccagcctcttcttataaggatgctaatcccacttataagtgctctaccttgaagacctaataacctcccaaaggcccaacctccaaatatcacatcagggattagagtttcactatacggattggggcagggggacaaac

SEQ ID NO: 62944 - DNA, 601 bp, Human
agtgggagggtcctgaaggacgaaagaccttgagagggaggctggctagagccaagtgagcctgggagagaaaggtgggagtggagagcggtcagagaggtgggcatgagtgggacatgcctaggtcatgattttgaggagtttgaggtctgttttaagggcaatgggtagcccctagggacatgtgcatttgcaaaacatctctgcttagcttgggccaccgtaacaaagtaccacgaacacataacaaaccatggtctaggtggtgcataaaaaacaccaatttatttctcagaattcrggaggctgagatctgggatgagggtgccagcatggtctggttctggtgagggccctcttctgggctgcagactgctgatttcctgctgtatcctcacatggcagaaagagagctagctgactctccagcctcttcttataaggatgctaatcccacttataagtgctctaccttgaagacctaataacctcccaaaggcccaacctccaaatatcacatcagggattagagtttcactatacggattggggcagggggacaaacagtccattgcaatctttccagctgctgtgtggagtg

SEQ ID NO: 62945 - DNA, 601 bp, Human
ctgtgtggagtggggtgtgaggggagaaactgatcatggtgagatgctggtgtggggtctcaagtcagggcagggaggatgcggggagcagatagatttgaggtacatttggaggcaaagccatggagttttgggatccttgaggtctccatgccttttttgtgtgtccattttacctttcaacctctttgcattttttggtttttggctttctaaattattctcagctagccatttctgatctttactttttgtccattaataagggattcatttgaaaaacctaagtgaccattgatgycctattagtgagggttctccagagaaacagaaccaatatgacatgcatacatatataaatggatgcatatgaatatatgagagagagacattgagagagacagagatttattataaggaattgcctcatgcaatttcaaaggctggcaagtccaaaaggaaaaaagaaaatctgatgaggtaggccagcaggctggagattcagggataacttacagtttaaatccaaaggcagtctgctggcagaattcctttctgatgggaagatttctgtctttattctattaaggcctttaactga

SEQ ID NO: 62946 - DNA, 601 bp, Human
tgcggggagcagatagatttgaggtacatttggaggcaaagccatggagttttgggatccttgaggtctccatgccttttttgtgtgtccattttacctttcaacctctttgcattttttggtttttggctttctaaattattctcagctagccatttctgatctttactttttgtccattaataagggattcatttgaaaaacctaagtgaccattgatgccctattagtgagggttctccagagaaacagaaccaatatgacatgcatacatatataaatggatgcatatgaatatataagagagagacattgagagagacagagatttattataaggaattgcctcatgcaatttcaaaggctggcaagtccaaaaggaaaaaagaaaatctgatgaggtaggccagcaggctggagattcagggataacttacagtttaaatccaaaggcagtctgctggcagaattcctttctgatgggaagatttctgtctttattctattaaggcctttaactgattcgatgaagcccacccacataatggagggtcatctgctttacttaaagtccactgatttaaatattaatcccattcaa

SEQ ID NO: 62947 - DNA, 601 bp, Human
ttggtttttggctttctaaattattctcagctagccatttctgatctttactttttgtccattaataagggattcatttgaaaaacctaagtgaccattgatgccctattagtgagggttctccagagaaacagaaccaatatgacatgcatacatatataaatggatgcatatgaatatatgagagagagacattgagagagacagagatttattataaggaattgcctcatgcaatttcaaaggctggcaagtccaaaaggaaaaaagaaaatctgatgaggtaggccagcaggctggmgattcagggataacttacagtttaaatccaaaggcagtctgctggcagaattcctttctgatgggaagatttctgtctttattctattaaggcctttaactgattcgatgaagcccacccacataatggagggtcatctgctttacttaaagtccactgatttaaatattaatcccattcaaagaatagcttcacagaaacattcagaaaaatgttgaccaaatatctgggcaccatggttcagtcaagttgacactataaaattaaccattacaattgtcaaatggaattgctatgggt

SEQ ID NO: 62948 - DNA, 601 bp, Human
aattattctcagctagccatttctgatctttactttttgtccattaataagggattcatttgaaaaacctaagtgaccattgatgccctattagtgagggttctccagagaaacagaaccaatatgacatgcatacatatataaatggatgcatatgaatatatgagagagagacattgagagagacagagatttattataaggaattgcctcatgcaatttcaaaggctggcaagtccaaaaggaaaaaagaaaatctgatgaggtaggccagcaggctggagattcagggataacttayagtttaaatccaaaggcagtctgctggcagaattcctttctgatgggaagatttctgtctttattctattaaggcctttaactgattcgatgaagcccacccacataatggagggtcatctgctttacttaaagtccactgatttaaatattaatcccattcaaagaatagcttcacagaaacattcagaaaaatgttgaccaaatatctgggcaccatggttcagtcaagttgacactataaaattaaccattacaattgtcaaatggaattgctatgggtcttttatttttatatatt

SEQ ID NO: 62949 - DNA, 601 bp, Human
catatgaatatatgagagagagacattgagagagacagagatttattataaggaattgcctcatgcaatttcaaaggctggcaagtccaaaaggaaaaaagaaaatctgatgaggtaggccagcaggctggagattcagggataacttacagtttaaatccaaaggcagtctgctggcagaattcctttctgatgggaagatttctgtctttattctattaaggcctttaactgattcgatgaagcccacccacataatggagggtcatctgctttacttaaagtccactgatttaaataktaatcccattcaaagaatagcttcacagaaacattcagaaaaatgttgaccaaatatctgggcaccatggttcagtcaagttgacactataaaattaaccattacaattgtcaaatggaattgctatgggtcttttatttttatatatttgtatttcttttaaaaataaaaaccaaaatgtaatcattacaaaaagtcaaaaaatacaagaaagggaaaatgaaaaataacattcattatccatttatctgagaaacactcactataaacccatgagaggatatccttttggagtgtttt

SEQ ID NO: 62950 - DNA, 601 bp, Human
aaaatgaaaaataacattcattatccatttatctgagaaacactcactataaacccatgagaggatatccttttggagtgtttttattcatatgaaggtatacaatgtatttttaaagaaaaataggacaatactgtaatactgattgtaaattctcataatttgtttcagcaataatgctgggtttttaattttctccagttgacttcttttttttttttggaaatgaattattttattttatgagtatcttggtaagtttttttattatactttaagttttagggtacatgtgcacaaygtgcaggtttgttacatatatatacatgtgctatgttggtgtgctgcacccattaactcatcatttaacattaagtatatctcctaatgctatccctccccgcttcccagttgacaaatgggatctaattaaactaaagagcttctgcacggcaaaataaactaccatcagagtgaacaggcaacctacagaatgggagaaaatttttgcaatctactcatctgacaaagggctaatatccagaatctacaatgaactcaaacaaatttacaagaaaaaaaacaaacaaccccatcaaca

SEQ ID NO: 62951 - DNA, 601 bp, Human
acttctcaaaagaagacatttatgaagccaaaagacacatgaaaaaatgctcatcatcactggccatcagagaaatgcaaatcaaaaccacaatgagttgacttcttattgttcagcatttaggctgtcccacatttcttgaattacacagaatagaaatttactggcagaaagtgagttcaaatgaaacagcaaaaatgttagatgtttctccctattcttgaaagtccccttcaagatgcaaaagaggttgcaaagttatctcatagctcaataaaatgatctgtacccccaaaaaacycacattttcatcttttcagctaagcttttgtgttgccagttgcttccatcaaattgcttttaggtgaattgctgaagctcaccctgcagtggagggccccaaacaatggacttcagttgatgggagagatttttattttttaattttttaatgagacacagatttaacgttcaatatattaaaattataagtatatgaggtagtaattaatggtgaggttgagtttttatttctacttgttttcagaaaattctacttttatcagcactcattatgtgtcctatgttaggagacataaag

SEQ ID NO: 62952 - DNA, 601 bp, Human
cctccatctctctcctccctgggcagtacgttcaatgtgttgctgacttcaatttgctgcaaggtgggttcagaaactaagaggcaagaagtgacttggatcctgggggtgttgtcaggtactggaccgtggcaggctccccactggcttcctgctgcccccttgttcctgccccaatctgtttaccttgcagcagccacggtgattcacgtgctgctcttaaaactctgtgatagcatctcgctgcagtgagaattaaatgtaaacacctttccgtgggctccaagaccatacctgacaygctccatctctccaaagtcacagtgtatggttcctgccctggtcaggtttgctccagccacaagagtcggagttgtccctgccccagggcattggctctgctttctattcacaggatgagcttcttcccatccttcaaggctcagtttaaatttgccttccttgggaggatttttctggcattttctctaaaacagctgcttccttccctcacccccattgccatgttgttgtttttcttgatagccccataactatctgggatgatcttggatagttttctttgatgtgtccactgtgt

SEQ ID NO: 62953 - DNA, 601 bp, Human
cttaccttactcacatattttccatgtcagctgcatcacagccttgtgctttggaacactagtgggttcttccacaccaggcttgggggccatcataaacataaagctactaacaaaaagcacaaaaatgcaaaaaaagccacgaaatagaccataaaaagcacacttgttttcaatatgagagttgaaacaagaaggaagaatgtctccttgttcggctcctgttggtaacatgcatgttgggtgactcaagatttttgtcgttctgcatttgtccctagatgattgccaaagtaagtgytactagtattgattttggggttacaaataaattttagtgagtaggtgagtttgccaatatggaatccacaaacagtgaggatcaattgtcactgtaaagtgttagaagcaatactggccttggagttagaacacctacattctggttccattttcgtcactaaactattgtacgactttgttaagtcacttttcctctctggtctgcagaagaaaggcacggaactaggtgattgctaagataatttattgctttcatggtggacaattctgtaatttttttcttatggggtagagacaa

SEQ ID NO: 62954 - DNA, 601 bp, Human
aagtgttactccgtggctgaacattgagctgtggagtctgagatcctgagtgatcctgacaaattactttatccctggtgcctcagtttcctgctttttaacatgaggatgaatttgtatcaggtaaagtgaatacaacaccagagacaaatcccagacacacttaaaattctcttacaaaggattatgaaacactgactcttcctggcacatgtcacgttcttttgccattgactgttgaatgacatctgtcttccccactagttcaggctcagtgagatcaggaacatggcatgttcgytttcgtgtctctcatgaccagaacatgtacagcactgttccgtggtaagcaggaccatgaaaacctaaccccaaaggccaagggagctgagaggctgaagaaagaggctcccaaatccagtttctcggaaaaacaaacaaacaaacaaacaaacaaaaaacacttcatagggacttacaaacagaatgcatgtcttgggtggaggtgagacagtggatccctgtgccattacctcccagatccagggcttacatactgtagggaatttgacccaaggccaggatttatggtatgcacatg

SEQ ID NO: 62955 - DNA, 601 bp, Human
tattgacagatatttttaaatatttccaacattatatggatgattctaacataatctttctttcctttttatatttttgttcagtttttcaagatttaactctgtagtgaaaattacattaaaatattataaaatttctacttcaagaattacacataaaagttaattttcccatataattaatatactcctgccttaactatttcttctggaggtacattttagaattagaaagtaatgaaactaatgactgagacactcctattgcagaggatggccttattggtacaaagagaacttmacacagtttattaggactttctccacaaaaagttcagttgagcacggccttattgattgatcccgtcacactggcaactttcgaaggtcaacccccaggtgacctctgaacttgtcctggagccatagttgaagaatcttcttttctcagggctggggcgagtaccatgggcctcctttcttagaccctattgaaatatttaggaagtcaaatacattctgctgtaacacactcatacactgtggccccgctaaccagaaatgacaaggaccaagcttatcacttcacaagtcttttgtt

SEQ ID NO: 62956 - DNA, 601 bp, Human
actgagacactcctattgcagaggatggccttattggtacaaagagaacttaacacagtttattaggactttctccacaaaaagttcagttgagcacggccttattgattgatcccgtcacactggcaactttcgaaggtcaacccccaggtgacctctgaacttgtcctggagccatagttgaagaatcttcttttctcagggctggggcgagtaccatgggcctcctttcttagaccctattgaaatatttaggaagtcaaatacattctgctgtaacacactcatacactgtggcccmgctaaccagaaatgacaaggaccaagcttatcacttcacaagtcttttgttaatcttgatttgtggttcatatgagaaaaaagacagtggggaggaagacaagcacagtgctagcctttgtggagtttatagacacgtcttggggaaaggtgcccactaagcaggaattaccctatcaggcaggcactgggggccacatagtgagaggaatgcatgtcacctggggagcagacagcttcccccaggaactgaccttccagccaagaactggaaggcgggtagaagtcagaacaaacaggg

SEQ ID NO: 62957 - DNA, 601 bp, Human
ccatagttgaagaatcttcttttctcagggctggggcgagtaccatgggcctcctttcttagaccctattgaaatatttaggaagtcaaatacattctgctgtaacacactcatacactgtggccccgctaaccagaaatgacaaggaccaagcttatcacttcacaagtcttttgttaatcttgatttgtggttcatatgagaaaaaagacagtggggaggaagacaagcacagtgctagcctttgtggagtttatagacacgtcttggggaaaggtgcccactaagcaggaattacccaatcaggcaggcactgggggccacatagtgagaggaatgcatgtcacctggggagcagacagcttcccccaggaactgaccttccagccaagaactggaaggcgggtagaagtcagaacaaacagggcagagtgtggagggggaagggtatttcaagcataggggaaatcaggtggggtaccctgaattgccaggaaagctggtgggttgaaatggacagaactccattacaacaggaatgagaaaaacatggggagagaggcacaaggtggagctggaggaacattagcagtcaagatgg

SEQ ID NO: 62958 - DNA, 601 bp, Human
aaaaaattctacaatttgaaagacaagaagaaagcagatagagacttaagtaattcctggaaactctgaaatgaatttcttgcatgaaacagagaagaaatgagagaacagctggtaatcattctcagtgaaaaaaaatggcaatattataaatatgaaagacattagattaggatacatttagtcatagaacaaataaattattgttggaaggaagaaatagaagaaataaaactgaaaaaaactcccagagtaataaaaataaagatcacttgaaaaacatatagagaatgtagaagamtttccagagtaaggaatataaggtaaagaaaaatggaagccatggcaaataagccccaaaatccaaattatgactaataaggacttagagtaagtctggtaaggacataatgaaagccctgaatataaaatatttggactttccatgacataattttttaaagtatagtaacaataaaaaattgagaaaataaatttctaaatttgcaaatattctcctatagttaactaaatagataggtgaattatcggtagtttttattatttctttttcaatcccgaaattgaaatgtgtagagga

SEQ ID NO: 62959 - DNA, 601 bp, Human
tgccagttagagaaacctcttggtattccctctattggcctggcttaggtgtcccctctttttgttcttttatacatataactttattattaatttattttaaattttatatatttacttgtgtacaatgtgatgttttgatacccccctttaaaaatacattttggtggagatataatttacataccatagaattcacccttttaatatgtacagttcagtggtttctagcatattcacaactgccaccaccatttaaatccagaacacttttatcacgcgggagagagaccccagtaasagttgttctctattcctcattcctcctaacacttggcaaccactaatctactttgtgtgtctatggatttgtccattctgatcatttcatacaaatggaatcgtacagcctgtattcttttgtgactgacttgtttcacttagcataatgttctggaggtttatccatgttgtagcatgcatcaatgcttcattcctttgtattgttccgttttacagagccacatttgattgatccattcattcattgatcgacattttgcttatttctccctttttggctatcatagataatgaggct

SEQ ID NO: 62960 - DNA, 601 bp, Human
ctcattcctcctaacacttggcaaccactaatctactttgtgtgtctatggatttgtccattctgatcatttcatacaaatggaatcgtacagcctgtattcttttgtgactgacttgtttcacttagcataatgttctggaggtttatccatgttgtagcatgcatcaatgcttcattcctttgtattgttccgttttacagagccacatttgattgatccattcattcattgatcgacattttgcttatttctccctttttggctatcatagataatgaggctagaagcattcatgtgmaagtttttgtgtacacatgtatttaattctcttggaaacagaattcctggatcatatagtaactctatgtttaatgaccgtatagtgactttatgtttaactttttgaggaactgccacattatttccatagcagctgtaccattttacattcccaccagtaatgtatgaggatttcagtttctatacatttttgtcagttcttgttggtgcctgtcttttttattttagccattctagtgagtgtgacgtggtatctcattgtagttttttttgttgttgttgacagagtctcactctg

SEQ ID NO: 62961 - DNA, 601 bp, Human
ggcgcggtggctcacgcctgtaatcccagcactttgggaggccgaggcgggcggatcacgaagtcaggagatcgagaccatcctggctaacatggtgaaaccccgtctctactaaaaatacaacaaattagccgggcgtagtggtgggcgcctgtagtcccagctactcgggaggctaaggcaggagaatggcgtgaacccgggaggcggagcttgcagtgagccgagattgcgccactgcactccaacctgggcgacagagccagactccgtctcaaaaaaaaaaaaaaaaaaaaaaaargttaccaagaatcaaaatatcaaatctggctcaggaaataagcattcaccattttttttttctgacactctctggagcatttaaaaagtagcatgaactctaatataatcttgtttttttaaactaaaaaatttaatttttatgggtacataggaggtatatacatttatggggtacatgagatattttgatacaggcatacaatgtgtctaatgatcttctttttgccatactcaaccaaatttctcaccaaatggatgaaacaaagttattttgtccctctcctgtacagatcagttt

SEQ ID NO: 62962 - DNA, 601 bp, Human
tgtttcatgctgcctcccagaagaactgcgaaatccacctgatgttcagcattccccattaaaatgaataacagagatattaacatttcaatgagctcaaagtctgaccttcattaggcaaactccagtttatttgaagtgctagagcttataacctgatgcttgatttttttttaatgcctgttttatatctcatccaagttgtcactttgggagaatatacagttattatgacagcatgaccactgctgaaacgtttttatgagcttttcttttagaattgccttcagaatccatggctttttttttttttttttaaatctccgtactggtggcaaacatttgcccttggatttgatgttgggaatattcaaaagatatttggagacaaatctgattaatcagattaataatcaacttgggtgtgttggttatctattgctatatatcaaattaccccaaaatgtggcagcttaaaaccacacacatttattatctcacagtttctgagggtcaaagaccaaggagaaacttagctgggtggttctggctcagagtctatcaaaaggtttcagataagacgttgactgggctgtgatct

SEQ ID NO: 62963 - DNA, 601 bp, Human
ccgccttcccagggtccctagggccaaagcctcggaggagggacctggtggcagctgacctttgtgttctttgaagccagagtttactaagcaaaattagcatgtaaataagcttgggaaaggactgctgaaacctctgacagtgaacttttaatcttcattgagagtttttaaaaccatatattcacataaatttagtgagttgctaattttattacaaaaaaaaagattttactaggcaggacttagttaccgtaatatattgaataatatatatatatacatatgaacactacaagctttttttttttacctttttttttttttaagagacggggtctcactgtgttgcccaggctggtctgaactgggctcaagcgatcctcccgcctcggcctcccaaagtgctgggattataggcctgagccaccaggcgcgcctggcctaaaaccatattctttaaaatcctgtaattcggatttttcctcttgaaatttaaacattggctaattactattttgaaatagattaagaggtgttttcctatcttttgtcataaaataaagtccaagggatgtttttataaactctttgccataaa

SEQ ID NO: 62964 - DNA, 601 bp, Human
gtggctcggccataggggctcctctctagtgaatgggattagtgctctaaggggctggatggagggaggtgggtccctctgtagcctcattgaagggatgaggcaggaaggccctcagccgacaccagatgttggtgcgtggatcttggacttcccagcctccagaacagagatcagtttctgttcgtaaatcactaagtctgtgggattctgttgcagtagcgcagaggatgacagagatacacttgtctctccttcatcttcctctccctgttgtcttcagcctgccccttgtgtgatmgattacagtatgtgtttggtcttgaccctacctacttcctggtgcagagcacctaaacccctggggcttcctgagcagtgtcttttttttttgtttgagacacagagtttcgctattgttgcccaggctggggggcagtggcatgatctcggctcactgcaacctccccctctcaggttcaagggattcttctgcctcagcttcccgagtagctgggattacaggcgcccaccacgcccagctaattttgtatttttagtagagacggggtttcaccatgttggtcaggctggtctctga

SEQ ID NO: 62965 - DNA, 601 bp, Human
aagacatcagaagtgaaaagaacaagctaccgagggaaagttacttgcaacatatttaaatgcagaaaaacatatatctagaatacagaattatcccagaattgcacttttagcagtaagggaacgggagcagcgttccagcctcagtttctatttataatggtgacatggaaaaaatactgctggatgcccacaaataagagaaagacagataatagaaaagaataagagattcgaagaaccagttcaaaaaagatgctatccagatggctagcaaacttgtaaaaccgtcttcaacctygttagaaattatataaatgcaaagtaagccacacgatgcaagtcatagaggctgggcatggtggctcacgcctgtaatcccagcacactgggaagctgaggtgagaggactgcttgggcccagaagttcgagactagcctgggcaatatagcgagaccccatctcctaaaaaaaatagccaggagtagtggtgcatgcctgtagttccagttattccggaggtgtcagctagaggatggcctgaacccaggagtttgagattatagtgagccttcatcgtgccactgcaccccagcctgg

SEQ ID NO: 62966 - DNA, 601 bp, Human
aggcggcaggtgacaaagccagctgcttgccagttgcccctgcgtcttctctggaagactggctagctcactcctgtcgtgctcagccaaaagggctgaggaagagtttggctctggcaggtgctgggtggaagggaagacgcgtacgctgactggctagagcccctcatcacggaggcggttcactgcctttggggtttgagcttctaatgatagaatgttcacatgatgttctgtttttcccattctattcacatcgccaagcccacctcgctcgcagacaccacaagataccaacagrgcttctgaaacagatacccatagcattggagagaaaaacagctcacaggtaagctggaaggagaatgtgcagttgtaaaagtatttgtgatctgtttgtacaggaaacggttttaaatgtaattgagcacctcagagaaaagtcgggctttaagggtgtttcctgctttaaaaaaaacaaaaaagcgaaacaaaaaaaccaagaaactgtgggtgggaacatccacaagcacatgggctggacactcagctgagcgggggaggcgccgagtgggacaggcagcgggggcctcctgtccct

SEQ ID NO: 62967 - DNA, 601 bp, Human
cggcacagatagggttcgaggcagtgatcagtactgtcttgctcagttatatctggcagtgccttaccttgctgcagatgagatgcgcgatcagtgttttcttgggtgttcgttgctggtgagaactttgacgacggactgtgttctgtattttggaagctctgtgaggaagcatggccttccaggcagggttagtagctgacccttccgtgctagcgcttccctcaaggctttcttcaccaaggaaacaaggagtccctgttacccaggctttctcagggacatcccctggccccactcygaggggcagcatgatttcgggagccccaggagccctggctgtgggtgtgtgggtgcatccagggcgtgcggcctgctcctgggcacttggggctgtacccagcttgggtgtacccagatgtttggtgggtttggggagctatattcttgagtattttcaattttatttcttttttttttgagacagggtcttgccgttttcactgttttacacaaaacttcccctagttttaaaaggaattagatgttcaggtacagaattttgaaaatgcaaaaaagtagagaaaaacacttagactct

SEQ ID NO: 62968 - DNA, 601 bp, Human
agcatggccttccaggcagggttagtagctgacccttccgtgctagcgcttccctcaaggctttcttcaccaaggaaacaaggagtccctgttacccaggctttctcagggacatcccctggccccactccgaggggcagcatgatttcgggagccccaggagccctggctgtgggtgtgtgggtgcatccagggcgtgcggcctgctcctgggcacttggggctgtacccagcttgggtgtacccagatgtttggtgggtttggggagctatattcttgagtattttcaattttatttcttttttttttgagacagggtcttgccgttttcactgttttacacaaaacttcccctagttttaaaaggaattagatgttcaggtacagaattttgaaaatgcaaaaaagtagagaaaaacacttagactctcagatttaaaatcctctttaatgtttcgtgctgttatataattctgaggatttggccgcagctgtggttatgtggacatttctgccttttccctcctgcttatcccggaagcatcttgtaaacctgctcactatacagtgtcccttccttcgtcacgtccctgttttgag

SEQ ID NO: 62969 - DNA, 601 bp, Human
gccaggtctcctgcctctgtccctatccaggaaggactctgtggaaggctggctgtgcccaggaaaggcagggttcagtactcactagacctaaatggcaccctgctgggactctcaggcatggtctcactcactttctctctacttgatgtctcactgggcactcccagatttgggacctcctggatgagaggaggccacagggctgaatcacctgaagtctgagagccaggattgcagtttcttcctggtggaagcagcctccaagtttgattggagaactctgcctttccagggctcytagaccacccagagtttcccgcgccttttccagccccccacccctagccccagctctcacctgtagaagcggcactccaccgtgtcagtgctgaagctgtactggtcctggtgggtcttctgggctgcaaagttggctgcctgtgagtgtgagccggccacagacacatgcacattgctggtgggcttaggagtcacgtccagcccgaccttccagtcgttgcggatgctacgagccgcatcccgggccacagcttcagtggagctgactttggccctggttacatggcgctggcagcca

SEQ ID NO: 62970 - DNA, 601 bp, Human
gcgatgaggaaggatgacccggccaggtctcctgcctctgtccctatccaggaaggactctgtggaaggctggctgtgcccaggaaaggcagggttcagtactcactagacctaaatggcaccctgctgggactctcaggcatggtctcactcactttctctctacttgatgtctcactgggcactcccagatttgggacctcctggatgagaggaggccacagggctgaatcacctgaagtctgagagccaggattgcagtttcttcctggtggaagcagcctccaagtttgattggagractctgcctttccagggctcttagaccacccagagtttcccgcgccttttccagccccccacccctagccccagctctcacctgtagaagcggcactccaccgtgtcagtgctgaagctgtactggtcctggtgggtcttctgggctgcaaagttggctgcctgtgagtgtgagccggccacagacacatgcacattgctggtgggcttaggagtcacgtccagcccgaccttccagtcgttgcggatgctacgagccgcatcccgggccacagcttcagtggagctgactttggccctg

SEQ ID NO: 62971 - DNA, 601 bp, Human
tgagccatggcacacacactggcatgggtctcgggggctcttctgccgccctggtgggcacggccggctgcagtccctccagcgagccctgtccgtcaggtactgactcagggccctcctcagtgcctcccgccgcgggtcctggctgtccagcagcacgtgcaggggttccagggtgtagtccaccaggccagggctgccgggcagcgagtttacccaggctgagtactgctcgggcccggcctggatcccgaacagcaggtcgttaatggaggtgtgatggccgccaaccacttccgartggcgctcccggtaggtttggtggaaggaggccgtcatcttgtgcttcttcttcttctcctcacaggccttggcttcggcagagatgctgccgtggatgcctatgttgacctgggcctcgacagtcaggcagtcctccacctcgttgtccgtgagcccttccagggccagctcgcaggtgcgcagggcagtgagggccgatatgcggccacccagctccacagcccggatgaagtgggtgccgtagttggagataagcctgaggtaggcgggctgggtggaggcgttgaagtggtggggc

SEQ ID NO: 62972 - DNA, 601 bp, Human
gccaaagtggaaggaacttggccaaaggcagctggcaaacctagtgccccatcctatttacctaatgtgcgaagtgccctcaaggcagcccaaattggcacaattcaggccatgagtggaacctcagagaaagcaaggaagcaagggtcagtttcatcctaggaggatccaggtctaggagcttaacagatcccagaacctaggcttctagagtagcaccaccccagggcagaaatagagtgctgaattgaaaagatacccttaggggtggggagggaatgtgagggaggttgatttagcwtttatgaggcagcctgcagactggacaccatgtgttgattggcaggagttttgagacccgctttcaccatttaccagccaggtggctgtacctctcttggcagaacctccacctccacagatcatcatgaggtgccaatgggacactttaggaaactccactgctataaagcaaatgtcatctgcattacaaaaaaaaaacttcctaaggcaagcaggcttgtgatgggcctggtagcatttggggtagctgaagcatcgcagtgctttcctaagtccgtcttttttccctgctgttttc

SEQ ID NO: 62973 - DNA, 601 bp, Human; identical to SEQ ID NO: 35532

SEQ ID NO: 62974 - DNA, 601 bp, Human
ggaaagtgaaaagctactttaaacaagtgaattacgtgctatacaaattatatctcaataaagctgctattttttaaatcctgctttaattctcaaaggacttctataaatacagatcagttatcatttccaaagtgctttgggatttgtatccaaaagcgaaagtataactcagattccttggatgttttctttaaagcctctctgtggtctatcagagttacctgaataaagggatcagcctgtaagtggagcaagtcagtgtagacgttagtgtactctatggcctcttcctaccacwcctgtatctcctgatcccatggatggtgctccttctcccacccagcgtcccctcagaggtcccaacactcattcaccttgaggtgcgagtgtatgataacaacttcgatgttactgttgccattcttaaaagagatccaaaccttctcctaaggagaggaagtcttaagggtgagattccaggcttgagtagcaacagtgggagcctgtgagtcctgtcctccaatagctgcctctttctgccgccctcttccttcccctcccgctaaaccccaggaagaaagaccatctatggaggagc

SEQ ID NO: 62975 - DNA, 601 bp, Human
ggggagatggagactctgtgaatgggtatgaggttccttttcggaacagtgaaatgttctaaatcgatggtggtggtgatggttgcgtaactctgtgatgatactaacaacaatggaaagtgaaaagctactttaaacaagtgaattacgtgctatacaaattatatctcaataaagctgctattttttaaatcctgctttaattctcaaaggacttctataaatacagatcagttatcatttccaaagtgctttgggatttgtatccaaaagcgaaagtataactcagattccttggatkttttctttaaagcctctctgtggtctatcagagttacctgaataaagggatcagcctgtaagtggagcaagtcagtgtagacgttagtgtactctatggcctcttcctaccacacctgtatctcctgatcccatggatggtgctccttctcccacccagcgtcccctcagaggtcccaacactcattcaccttgaggtgcgagtgtatgataacaacttcgatgttactgttgccattcttaaaagagatccaaaccttctcctaaggagaggaagtcttaagggtgagattccaggctt

SEQ ID NO: 62976 - DNA, 601 bp, Human
gttcagtaaaccagtcacaaaagaccacatatagtatgatttcatttttatcaaatatgcagaataggcaaattcggagacagaaagtagattagtggttgcctggggctggaagggttggaggggagatggagactctgtgaatgggtatgaggttccttttcggaacagtgaaatgttctaaatcgatggtggtggtgatggttgcgtaactctgtgatgatactaacaacaatggaaagtgaaaagctactttaaacaagtgaattacgtgctatacaaattatatctcaataaagcygctattttttaaatcctgctttaattctcaaaggacttctataaatacagatcagttatcatttccaaagtgctttgggatttgtatccaaaagcgaaagtataactcagattccttggatgttttctttaaagcctctctgtggtctatcagagttacctgaataaagggatcagcctgtaagtggagcaagtcagtgtagacgttagtgtactctatggcctcttcctaccacacctgtatctcctgatcccatggatggtgctccttctcccacccagcgtcccctcagaggtccca

SEQ ID NO: 62977 - DNA, 601 bp, Human
cctaaaattcatataaaaatgtaagggacacggaataaccagaagaacaaagttggaggacacatgtgttcttatttcaaagcttacctcaaggctttgattactacaaagctatagtaatcaacactgtgtggtactggcataagtatagacatatagatcaatagaactgagagtgcaaaaataaactctcacatatacagtcaattgatttcctataacgatttcctacaagaatattatttggcaataaaaggggatatagtattgatacatgctacaacgtggatgaaccttgaaracgttcagtaaaccagtcacaaaagaccacatatagtatgatttcatttttatcaaatatgcagaataggcaaattcggagacagaaagtagattagtggttgcctggggctggaagggttggaggggagatggagactctgtgaatgggtatgaggttccttttcggaacagtgaaatgttctaaatcgatggtggtggtgatggttgcgtaactctgtgatgatactaacaacaatggaaagtgaaaagctactttaaacaagtgaattacgtgctatacaaattatatctcaataaa

SEQ ID NO: 62978 - DNA, 601 bp, Human
caaagtattgttgaaagaaattaaagatgacctaattcaatggaaagatacactatgttgacaagttagaagacttaatattgttaagatggcagtactccccaaattgatcttcagatttaatgcaatctgtatcaaattccaattggattatttgcagaaattgacacgctgatcctaaaattcatataaaaatgtaagggacacggaataaccagaagaacaaagttggaggacacatgtgttcttatttcaaagcttacctcaaggctttgattactacaaagctatagtaatcaasactgtgtggtactggcataagtatagacatatagatcaatagaactgagagtgcaaaaataaactctcacatatacagtcaattgatttcctataacgatttcctacaagaatattatttggcaataaaaggggatatagtattgatacatgctacaacgtggatgaaccttgaaaacgttcagtaaaccagtcacaaaagaccacatatagtatgatttcatttttatcaaatatgcagaataggcaaattcggagacagaaagtagattagtggttgcctggggctggaagggttgga

SEQ ID NO: 62979 - DNA, 601 bp, Human
tctgttaaagtgagtttagtgccccatagtaaaaaccaaggaagcatgatttttcagaaaagaggaaactcagagcttccttatgatctcatattatttttgcaaaggcttcttaatcttttcagatctctggtcagtattgaaaaataatcctagaaaagaagaggtaaaactctatctgtttgcagatgacatataaaatatcctaagaaatctaaaacagagacaaaaccaaaaactattggatctaatgagttaagcaaggttacaagatacaagattaatattcaaaaatcaaatmtatttctcagccagacgcagtggctcatgcctgtaatcccaggactttgggaggccgaggcgggtggatcacttgaggtcaggagttcaagaccagcatagccaacatggcgaggccccatctctataaaaaatttaaaaattagccgggcatggtggcacgcaactgtaataccagctactcgggaggctgaggcaggataatctcttgaacctgggaggcagaggttgcagtgagctgagatggtgccactacactccagcctgggtgacagagcaagactctgtcacacacacacaa

SEQ ID NO: 62980 - DNA, 601 bp, Human; identical to SEQ ID NO: 22802

SEQ ID NO: 62981 - DNA, 601 bp, Human
ccactaattattccctaactttcaaaagccaaagatacattttggaagatgataatggatattaccttctttatcatctttctcaataggcaaacctgtggcaactagaaaattctgataatttttgttttcatttccttgctttttccaaataggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtrgatcctgctggagccaaaattggtacgcgctttatggtcagttttataatataggtcctaagcagaataatcattgaagaaaaggtttctgtgacttacagtgtataagctgcatatctctacccacagctttacaaactttaaaatttgaacataaattgactttttttagaaagataaaaggaatagcaactgttcttacccattatgacttaccttgaaaaacttccagaatgttacttaaaagaaaattttattagttttaatgaaattcacactattcagataggaatactcctt

SEQ ID NO: 62982 - DNA, 601 bp, Human
aaagctgaaaagaaaggagttaccccttggagttcaatatcacgtttttgtagatcctgctggagccaaaattggtacgcgctttatggtcagttttataatataggtcctaagcagaataatcattgaagaaaaggtttctgtgacttacagtgtataagctgcatatctctacccacagctttacaaactttaaaatttgaacataaattgactttttttagaaagataaaaggaatagcaactgttcttacccattatgacttaccttgaaaaacttccagaatgttacttaaaagawaattttattagttttaatgaaattcacactattcagataggaatactcctttggaccttatcagtagaacccttgaggtcctctccactccagagttcctccagcaatttacatgaagaaagcaattagtgggaaaaaatactcttgacctcttagggacataatgcagaatgcaaaagaacactgtcacatggcttaaatataatacatatatttgaaaaccctagtttaggtcaactttgccctttgaccgtccattgcaaatagaaataaatgctgtttttctgaatgctcttttct

SEQ ID NO: 62983 - DNA, 601 bp, Human
tactcttgacctcttagggacataatgcagaatgcaaaagaacactgtcacatggcttaaatataatacatatatttgaaaaccctagtttaggtcaactttgccctttgaccgtccattgcaaatagaaataaatgctgtttttctgaatgctcttttctatgtgatacttaaagttgaagccccctgataccagagataagatatctgtatatgacattaatatgacattagcattattctaattagccaacattattttaatccttacaactatgaggtcagtactgttattatttcyttttttttttttttttttttttttgagaaggagtcttgctctgttgcccaggctggagtgcagtggtgcgatcttagctcactccaagctccgcctcccaggttcaggccattctcctgcctcagcctcccgagtagctgggactacaggtgactgccaccagcctggctaattttgtttttgtattttttagtagagacggggtttcaccatgttagccaggacggtctgtatctcctgacctcgtgatccacctgcctcggcctcccaaagtgctgggattacaggcgtgatattatt

SEQ ID NO: 62984 - DNA, 601 bp, Human
gatatgaaagaagtatttgaaaataaacacaggtagactttttttctgtcctggtatgtgtgtccatgtgttcttttgtctgtcagtcagtcccctagtgctaactcatccttatcctctccccttcatttaggtgaagaataggagcgtgggatttacaatctgatttttaaatagatattaatatttataaaattgtgtaaatttatagaattagaaatacagtagaaatattatctaatttatagaactagaaatcaaaatacatctgcagataagttttttttttttttttttttttgagacagagtcttgccctgtcgcctaggctggaatgcaatggcacaatctcagcttactgcagcctccgcctcctgggttcaagtgattctcctgcctcagcctccgaatagctgagactacagttgcacgccaccacgcccagctagtttttgtatttttagtagaggcggggtttcgtcattttggccacgctagtcttgaactcctggcgtgaagtgatccactcaccttggcctcccaaagtgctgggattataagcatgagccaccactcctggccgtaagttttttaaaactta

SEQ ID NO: 62985 - DNA, 601 bp, Human
ttccagtatgatattgttaggtatcagaaacccaaagactgataaattgccttttctagcctcaaaaaaatgtatttgcttgggggtggagggaagagctatttaacaactaatttcataaaaggcctgttgcttgtgccgatttgcaaaattgtgttaattgggaggactccactgtcttttccgttagtgtgaacaaaagtggctaaaagggacttgatttatccaactgcaaacagggttcccagtgggtagcgggattatgcatacctgtgtctgctcttttttttccttttgagayggaatttcgctcttgttaccccaggctggagtgcagtggcacaatcttgagtcaccacaacctccacctcccaggttcaagcaattcttcctcctcgaggagcctcccaagtagctgggattacaggcatgcgccaccacgcgcggctgattttgtatttttagtagagacggggtttctccgtattggtcaggctcatctcgaacccccgacctcaggtgatccacccacctcggcctcccaaagtgatgggattacaggcgtgagccaccgtgcgtggcctgtctgctctcctttatc

SEQ ID NO: 62986 - DNA, 601 bp, Human
gaccacaggtgcacaccactacacccagctaacttttttgtattttttgtagagatggggtttctttgcgttgccaggctggtctcaaacaactgggctcaagcaatccacccacctctgcctcccaaactgctgggattacagggatgagccaccatacccagttgcattaactcataataaaattgataataatgatcatttatatataactagaagctttcccttacttacatccaaagatgagccaattgaaccttctctgtgcatacttccttcactttgctttccacatgacaaratttctaagtctctctctgaagtataaactggaatgcattcacttcacaaagagtggacttcttttcttgaaagcttcaaacttgttcttatccttagggtctttctaatttgttatttcctctgtctggaatactcttcctccagaaattcaaatgtcttgcttcttccttttagtaaggtctcagcagataacactttttccgccatcccctgtcctatttcatttcatcacaacacattagtcctttcatctttgtggggttttttgtgttttttttgttgttgttttttgtttttt

SEQ ID NO: 62987 - DNA, 601 bp, Human
ggtggcttaacttgcttgtggatatcctgttaattttgctttgaacttgggttagggtctgtgtttagcctgagaggtccttgtagggaagcttgtatcagaagttctaatgggtttgagttctcaggccatatatagcatcatgttagtgtttgagttgtgataaaaattatggggttttttgttaggcctaaattaaaagaaattatttttcttttcaacaatgaatctgaaattcttagtataaccaaatctgatgcatttacaattttatgtacacattggtgtgtttcattttttagaaactgtgaagcctcattcagatagtattaaaatacaggattttccttttcattaatgagtcctatgatgtaagtgttatattgatgttaaaatgaagtagttttgtaccctgggtgcataaaattgtcagagagaattaaaggagaaagaactcaaacttcatcagagatcttgatttaattcatgtgaagagtgtggattacccccaacccccaaccccatgactctaatacacattagagtgtattaactagggatggtgtgtttatttctgccttagggcactagctttccaaat

SEQ ID NO: 62988 - DNA, 601 bp, Human
tatatgcctatatttcattcaaagtatattattggtgccttttatttaaatcaggcagtgtagtaattgctcaagaatacagtcatgaaaagacttacttcccatgtctttgtggagcctatggtagggtagttaagtagataaaaacatcttaggatgtggagatgttattgcaaggaattgtttagtaaatagtttcaaatatggctgaaaataagagattaaaattaaagttaattgagttcaataactcaaatagtttattgaggcattactatgggttttgaggcagttgttttakggagttatggcaacagaagctatattagtacatcagtaagaggaaagaaggacatcaatatttaatgtacagtcccctccgtatatgcaggggattggttacaaatccatctataccagaatccatgcatactcaagtcctctggaatccacatataggaaaactcagtcctgactatacatgggttcctcatccttcaaatactgtttttaatccacatttggttggtggcaaaaaaaaaaaaaaaaaaaaacacagtgtgtaggtggaaccatgccgttaaagctcatgttattcaag

SEQ ID NO: 62989 - DNA, 601 bp, Human
tcaaatgaagagggaaccaatgataaagattgaatgaagagggaaccgaggatgaccagagaagggaaaaaaatgaaattgagaatgcagaatggaaagattagcttagaacagtaagagagggatactttgattcttaaaattagagaatagttaaagaggggggttgttatgagacttctcattcaacaaatatatatcgtttatctactctttgcttagagtcttggggagaatgatgatcttggggaaaaaatattgtgaggagtaaaaatttataggaatctgtaaaaaaaaaaaattgagttacggctgtagtcaaaatctgttgatattttctaataagccctgaatagttcataatagccgcagaaaaagaagcttgcttgatccatgatagaggttgacatgggatgtgtgtcttggaagaatattcatgatattgatggattttggtagtgctctatgggttttggcctgataggagaggtgggttgggaaagtggtaatcagctgagagaaaaaggagtcttgaggagcctagagatagttaacttattggtgtttaccaagtatatttcaagccaacatcctagttatt

SEQ ID NO: 62990 - DNA, 601 bp, Human
gttatataatttactaatagataataggttttgtacagagtccacattaaaatagatgtctgataaatatggtataggtactcggaaagaaatactctccctgaacttcactgatgaaaaaggtagatgtttttctgtctctggctcatgggagaaactaaagcactgtttgtattgtcagccatagattaactaatcctgtgcttctcagataattgtttttttctgataatagttgtgtctgaagatggcttctaacattgagcagcacagattttaaactcactactgatcagtgctkttaaggtcaggagaggtaaaaatagcagcatggctaatgagttacctttgtgtttaatctctttataacttgttaccagttcaaatgacagatttaagaaattgtgtattattttaggaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacact

SEQ ID NO: 62991 - DNA, 601 bp, Human
aacatctacctggtggtttaaagtctttctggtactactgggtgctgagatgggaagatcaggactttgtgtggatgtgagttagtatacttgagtatcttggaatgccaagttaaaatttatatgtagaaaattatactttaaagatttgagttttcttgatactatctaattttattcaataacaggagagtctgcatatttgagaaaaggttatatacacagagacaaaaggatgtgcttgacaacttaaaaagagttgagcataagatcattagaataaacctgaaagggacatttrcctaatacttgtctttattgcagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggttttgctagtaaccagtttataagtttttcatcttttcaggtcccactaagcagctggtctaactggagttaatggtctgctggaacttccagcatgcactgtggtagttatatcag

SEQ ID NO: 62992 - DNA, 601 bp, Human
aatttgctgttatttttgacaaaggaattttcttgggaagtaaaggcacttcagatttagctttcctcctgactaccctaaagtgaaagttaagcttgaactcaatttaaagtggtagttgtgcagtgtttgtttttagatgactcatgtatgatttggtaacacctgccttgatttgatctatttttattgtaggagaaattgacacaagattctctttttgtgcggtggcaactttggctttgttggtaagctttgaatatttgattgaaatgattaaagttcatgaatactctggaattttttttttttttgagtctgatctgctgaatactctggaatttaacaggcatctttttttttgtttgtaggggaagcttgatgctattaatgtggaaaaggcaatcgaatttgttttatcctgtatgaactttgacggtggatttggttgcagaccaggttctgaatcccatgctgggcaggtaatttatgaatacagatgaaaatgtattgtcattttggaagccagtgtagtaaaataagaaaattggttatttcagtgtttgtcaaatacacataaagttaattcgactgtaatagg

SEQ ID NO: 62993 - DNA, 601 bp, Human
tcttgtgccagagaacactgaatatgtgaatggatggctgtgaaatactagccatgaagaaattttgacaataatatttcagtgcagaattgcatactagtaatagtatgcttggattttttcagatatgtggtattaatacatgtttggaattttaagtgtcagatcaagaagaaaaacttaagatataaagtggtgttttaataatttgagttttatcacttttaatgtcaagaaattattatacacataaactttatgtctgtaattttagatctattgttgcacaggatttctggcwattacaagtcagttgcatcaagtaaattctgatttacttggctggtggctttgtgaacgacaattaccctcaggcgggctcaatggaaggccggagaaggtattgtttgataagccatattctgctagctttagaaccttgagtgaatgctgctgctttgtcttgcctgtttctatattgtaaattggccatgagcttatttattacctttccctgttgtgaattttcagtaatatatcctactaaaagactccccttgacaaagtagacccccatgagttgaaatactcattgatccta

SEQ ID NO: 62994 - DNA, 601 bp, Human
aagtcagttgcatcaagtaaattctgatttacttggctggtggctttgtgaacgacaattaccctcaggcgggctcaatggaaggccggagaaggtattgtttgataagccatattctgctagctttagaaccttgagtgaatgctgctgctttgtcttgcctgtttctatattgtaaattggccatgagcttatttattacctttccctgttgtgaattttcagtaatatatcctactaaaagactccccttgacaaagtagacccccatgagttgaaatactcattgatcctaatgtcyatttccagacagtcttgtacaggaatctccatgtttaaggacagttgattttggcaaattggattttttaaaaattagactacagaatttttgtttgcaatcttcttatttaaggaatacccagataatttggtttggagagaagattattaaattttcctccacataataggtctctcttatcaggtctgtaagggacaaatagtgaatactcatttgcaactatgtaattgtcctgtagagcaagtgcagccataagtggtaagaaatgaatgagtatggctgtgttccaattacaat

SEQ ID NO: 62995 - DNA, 601 bp, Human
caggaatctccatgtttaaggacagttgattttggcaaattggattttttaaaaattagactacagaatttttgtttgcaatcttcttatttaaggaatacccagataatttggtttggagagaagattattaaattttcctccacataataggtctctcttatcaggtctgtaagggacaaatagtgaatactcatttgcaactatgtaattgtcctgtagagcaagtgcagccataagtggtaagaaatgaatgagtatggctgtgttccaattacaattattatggatggatatactygtatttcctatgtcagatggaatcttgctctgttgcccaggctggagtgcagtgacgccatcttgattcactgcaacctccgcctcccaggttcaagcagttctgcctcagcctcccaagtagctgggactacaggcgcacggctaatttttgtatttttattagagacggggtttcaccatattggccaggctggtctcaaactcctgacctcgtgatctgcctgcatcaacctcccaaagtgctgggattgtaggcgtgagccaccgtgcctgacccaggactatatttaaatgattt

SEQ ID NO: 62996 - DNA, 601 bp, Human
tcctgacctcgtgatctgcctgcatcaacctcccaaagtgctgggattgtaggcgtgagccaccgtgcctgacccaggactatatttaaatgatttataaatgtaaaaactattcctacactatagatttgactcaaggattgtagcttgctgtgcccctgccctctgaatgggacgtggtggtacagtagctgggattacagtcatacaccaccacgcccatccaattttgtatttttagtagagatggggtatcaccatgttcatcaggctgatcttgaactcctgacctcaggtgatytacccgcctcaacctcccaaagtgctgggattacaggcgtgagccactgtgctcggcctgtatttttatttttaaaccttagtatttctgaataacaacgggtagagaaacacccgcagtagctgtctacaatagagtgaaataaaaagcctgaggaactgtcaacagaaaaatgggtggccgtggggagcaccgggacctgcacttgcacacaatctagggcagcttctaatgagtctatgagttactcagggatctcattaaaatgagatcagccttgagtggggttttctttataga

SEQ ID NO: 62997 - DNA, 601 bp, Human
cacctgtgtgcgagttggccagtctgctcacccttccacctaactgtccgcagtccttctgcttgcctgtttccatccatctgtggcctgtgcagttatccgggtgcctgtctgtgcatctgcctatccacctgtccacctgactgtccactcttcctctacctgtcttttccacctgtctctgggtctgtccttcggcctgtttctcgggtgcttgctggcctgcctctgccccatctgaactgggcccacataatttcagaggtgaaggggagaaagatgcggcacagggaggggcagkgggggaagacagcagggctctctcggccattaagtgcgttgggggtggcaaccttgactctgtgcagagacctcagctgggctaggctggggcagagagttgaaattgctcaggacatgaggtcaagcttcggttcagggtcaacggtttgtagtagcccagtccttagtgtccattgggaggcctaggatgaatatttgtggctataaagaggcccgttggagtgaggaaggcccagggctggtggagttgggggtgaggggatggggactacttcttaggagtggctacagagcagcc

SEQ ID NO: 62998 - DNA, 601 bp, Human
attattggggctggaggagggggcccacacagaaggtctctcctgtttgtgaggagctccagatgtggggtttctcagtcacactgcagggtcttgccaggaagtacttcctgctgttggactcctagccagaccattacactttgggtcaaatcctttctcctcttcccaatctgcctcagtggcagcccaagtgaggggagtccagggagtactgttagctaggacccccttcccagagacgcaggctgtggcaggaggggccccagcagaagagcctgcaagagaagggctctgggcsgggcgcagtggctctcacctgtaatcccagcactgtgagaggctgaggtgggaggatcgcttgagcctaggcaacatggtgagacccctgactctacaaaatttaaaaattagccgggcatggtggtgcacacctgtagacacaattacttgggaggctgaggtgggaggatcacttgaacccaggaattctaggctattgtgaactgtgattgcaccactgcattccagcctgagtgacaggatgagaccctatcaattaaaaaagagagagaaagagaagggctcaggaaggagggag

SEQ ID NO: 62999 - DNA, 601 bp, Human
ggtggcagcagcttctggggcccgcagactcctaacccccgagcccccgacctcccaccccggccatctgagaaagaacatcgcctgggttggaaatcatcccagcaaagtgtcctcagaaccctcaggcatccccgctaggtcagtcggtcctcacattttgacagccccattttacttgtaagaaaactgaggctctggagaccaaagtcacctgggaaatgagtagcagatacagcggactctgtgcagagacctcagctgggctaggccagggcagagagttgaaattgctcctgcytccttgtccaggactgttcgctccgttcctagtggccaccgggcttggctcttggagtctgaaatgaaatctctggttgtgtgtgcagcaccaactatgcacagggcaccctgctgagctctctctaaaccggtctcattgtgtccttctgcagccttgtgaggtgggcactgttatcctcctcatttgacagatggggaaactgggactcagcagaggccacccagttaatgtggaagagcctcagcccggagcgggggctgactgggagctgttgcgctcagcaccacagcctcagct

SEQ ID NO: 63000 - DNA, 601 bp, Human
ggaggagcggggtggctggcctcgtagaacttcgctggcgtttgctcctcctggggggtcctcgggggtcctttgatctgaccttggggtatactgctgggtacaccaagacacagaaaggggcagctactcatccaaggtcacacctagtgagttagtggagaactgtgccaggaacccaagccttttgtctcccagatcaggactttagataacaattttcctaacctagccaacaggggagatggatgctctaagaactttgcccttgtgattgggaaagtctttgagtgtgacccamatttttcgtgctgctgtttttcagccctagtccttttgcttggtctttgtaaggagctggggagaccatcctgttcttatactgccttcctcctcctccttgcactccccttcacgctcctttgcctccttcttctgaagttctttggtgtcactggagccggttcgatctctcactgacggcccaccccaccccaactccatagtacgttcattcttccattgaagacgcgctgctagatgtctaacttcaatccctattgctgccgaagcccttatccttgggatatttaagccagga

SEQ ID NO: 63001 - DNA, 601 bp, Human
cttgtgattgggaaagtctttgagtgtgacccacatttttcgtgctgctgtttttcagccctagtccttttgcttggtctttgtaaggagctggggagaccatcctgttcttatactgccttcctcctcctccttgcactccccttcacgctcctttgcctccttcttctgaagttctttggtgtcactggagccggttcgatctctcactgacggcccaccccaccccaactccatagtacgttcattcttccattgaagacgcgctgctagatgtctaacttcaatccctattgctgcygaagcccttatccttgggatatttaagccaggagtgtttcaagaggtggttattattcttgggctgatggcagcactttgagtggatgattaatttcaggctctctgagccagtcaaaggagctggaactgcctgggagcagggaaaaaggaaggccgaggccctgcccacaaaggaggctgcccagggaacttccccagactccctcctacctccctagcaccaatgtgggtctttggggaaggtccgatcttcttgtgggctatggagccccccagcagggaattctgcatgtttgcc

SEQ ID NO: 63002 - DNA, 601 bp, Human
ggggcccctcaggtgacagggtgccacttcacagggcactcagggggctgcctgcccccagtggaggctctgaggggctggagaaagggtgctgagccgacctcagtggctacacagagcccccaggacttcaggttccctgggcaaccctgtccctggggcaggagctgcgtgccctggggatgaggcacaggaggggcagccccaggcagcagactaattgggctgggaatccgtgggcagcgcctgaggaagggaggcaacaggagctcagcgattccctccctcctcaccccacggagatttgggggacagtggatagagcagggtctctagcctaaaggatggagggaaaatcttgaggcacattctcctgagactccttggacacccaggccgggaaggtgggactggaggaaagctcactggaaataaatggagcatggttcccatcaaagcagaggagatggaggtcagacagcaggaaggactgcccaagaaccaggaggtgaatgagattttctgggatattgtttcaaaaacttggagccccctgtctagccgggctggacaacatttactcgaattgtccctatcaagc

SEQ ID NO: 63003 - DNA, 601 bp, Human
ttcctgtcctcaggctcccctggaggacagctcagagatgcccaggctggagacctggggaactctaggaaaagaatgcacgaagctggagccaggctagagttctaagcacagactttgtcactgagtaataagattcatagtctaatctctaccaggtattgtgctaaatatttttcacactgcttcatttaatccttccaagagccctatgaggtaggtcctatcattatccccattggatggaagatgacactgaagcttaaaggtgaaacactgcccttgtcacacagccaggaastggtgaatgcccaagaggacgggagttttctgggctcagctcagacaactgagtgcctggagaggccgagtgtgcaacgattctgtgacatgagagggtgggaacggtttgcaggactgtggtggggggccgagggggtaatcagtgcacatcaggggcaccgggttggggtcagaaggcaagagacacgatcctgctggctagcttctagcagtcacctccctctctgagtctcagcctccctctctgctctggctctcaataataacaaagataatactagcaggaccttactgagtg

SEQ ID NO: 63004 - DNA, 601 bp, Human
ttttcacactgcttcatttaatccttccaagagccctatgaggtaggtcctatcattatccccattggatggaagatgacactgaagcttaaaggtgaaacactgcccttgtcacacagccaggaagtggtgaatgcccaagaggacgggagttttctgggctcagctcagacaactgagtgcctggagaggccgagtgtgcaacgattctgtgacatgagagggtgggaacggtttgcaggactgtggtggggggccgagggggtaatcagtgcacatcaggggcaccgggttggggtcrgaaggcaagagacacgatcctgctggctagcttctagcagtcacctccctctctgagtctcagcctccctctctgctctggctctcaataataacaaagataatactagcaggaccttactgagtgcttaccgtggaccagatgctgctctgagagcttgccacgccttctatcactttttcctctcaatgacactatgaggtaggtactgttattatgcctacttttcagatgaggaagttgaggcacaaagaggttacgtgacttgcctgggtacatgtagcagggccaggattctaa

SEQ ID NO: 63005 - DNA, 601 bp, Human
gaggtagaggttgcagtgagccgagatcgtgccactgcactccagcctggatgacagagtgagactccatcaaataaataaataaataaataaataaataaataaataaatacagttcaaggtcctgctcccaccccgattctaccctggggactcattccttccctctctcgccctttcatttgagaaaccttcacttctaaatgaagttcagctgcttatgccagtctccccgggccaggccctgtgccagactctggggacagagcaatgaatcagaccttcctctgctccctggggragatgggctgggaagctggcagttaccaggcagggtgataagtgccactgtccaggcagcacggagtccagtgggagcccagcacagagggccaagccctgccccaatctgggcatggctgggaaggcttcccagaggaagaggcttaagttgagactgaaagatgagtagaagtaggagttagctaggtgaaaaggagcaaggaacagtgtttcaggcagagagaatagcacaggcagagacccagaagtgaggctgaacagggcatttgcaaagaacagcaagaagtcagaagagcgg

SEQ ID NO: 63006 - DNA, 601 bp, Human
cctggcgaaggggcagagtcctggcagttcagccagccccagctctgtctttttcttgaagctcaacagagtatggaaatcattggtctcacccagccccctcattcttctgagggggaaacaggctcagaacagggcagggactaaactcaggtcagcagtagagcccagaccagaacccaggctcagtccaagcatcttagttgtctccaatgatgataaataacagtgaaaacctttctgcagagcttcccaggggctggcctgggcttaggcaccctctggatggtcttgggcagaygtttttcacatctcgagccttagctcgaggtccaaaatactacctgtactgggaaggaggtcctctctcccactgacagtccacaaagccgttttaggcatgctggacccattgtgggctttacttattgtttgttcaatgaatcccactgaattcatgtaacaaccctggaggaagatactattatgctattttgtgctgaggctcagaaaggagaagtgacttgcccaaggtcattcagctgagaagttgctgacttagggctggactccaggggtccagatgcctgtctaggatccc

SEQ ID NO: 63007 - DNA, 601 bp, Human
caggctcagtccaagcatcttagttgtctccaatgatgataaataacagtgaaaacctttctgcagagcttcccaggggctggcctgggcttaggcaccctctggatggtcttgggcagacgtttttcacatctcgagccttagctcgaggtccaaaatactacctgtactgggaaggaggtcctctctcccactgacagtccacaaagccgttttaggcatgctggacccattgtgggctttacttattgtttgttcaatgaatcccactgaattcatgtaacaaccctggaggaagatrctattatgctattttgtgctgaggctcagaaaggagaagtgacttgcccaaggtcattcagctgagaagttgctgacttagggctggactccaggggtccagatgcctgtctaggatccctgatggacacagccccatttttgagcctgcgctctcagcgaaaatcagttggtgtctcaacgagacccatcgtcagctgggcagggtgtgtgtatatatgtggaagctgggctgggctgctggctggaactcaagccacaccaacccctgtgcccctgtgtttggacctggctgcagctg

SEQ ID NO: 63008 - DNA, 601 bp, Human
cctctgcttggggccttcccctgtcctgcttctgctccccaccctcctactctgtgagcagaatcaggagctagggggcaatgctggggcattcaggactgatggaggtgcagtgctacatagcatgtgggactgaaggatgggggcgatgtcagggaggtttagggcacatgttggggcaaagttgagggaagatgattggggtgcagagcaggagtgtttggggctcatcctgggccaccccttcctggaaaaatttggctacaagtcagggaggcaaatgtgtgggccatgccccccscctcgctaggcagtaaacactgccgtcgcctgggagacaagaaaacatcttggtccccccacggttgtttataccaggactccctctccttctctggcctggtctggcctctccactcctgagctgggctacctgagtcgagggtccagcccccggtcatggcaggaggccctggcagcacgcccactggcccccaccagggactgagcactcaccacctcctggtggcctgtcccattggaggccctaggtcttattgatcagaaacgtgctcccaagccttggcctccacgagggagg

SEQ ID NO: 63009 - DNA, 601 bp, Human
tctgcttggggccttcccctgtcctgcttctgctccccaccctcctactctgtgagcagaatcaggagctagggggcaatgctggggcattcaggactgatggaggtgcagtgctacatagcatgtgggactgaaggatgggggcgatgtcagggaggtttagggcacatgttggggcaaagttgagggaagatgattggggtgcagagcaggagtgtttggggctcatcctgggccaccccttcctggaaaaatttggctacaagtcagggaggcaaatgtgtgggccatgccccccccctcgctaggcagtaaacactgccgtcgcctgggagacaagaaaacatcttggtccccccacggttgtttataccaggactccctctccttctctggcctggtctggcctctccactcctgagctgggctacctgagtcgagggtccagcccccggtcatggcaggaggccctggcagcacgcccactggcccccaccagggactgagcactcaccacctcctggtggcctgtcccattggaggccctaggtcttattgatcagaaacgtgctcccaagccttggcctccacgagggaggcc

SEQ ID NO: 63010 - DNA, 601 bp, Human
gcattcaggactgatggaggtgcagtgctacatagcatgtgggactgaaggatgggggcgatgtcagggaggtttagggcacatgttggggcaaagttgagggaagatgattggggtgcagagcaggagtgtttggggctcatcctgggccaccccttcctggaaaaatttggctacaagtcagggaggcaaatgtgtgggccatgccccccccctcgctaggcagtaaacactgccgtcgcctgggagacaagaaaacatcttggtccccccacggttgtttataccaggactccctctycttctctggcctggtctggcctctccactcctgagctgggctacctgagtcgagggtccagcccccggtcatggcaggaggccctggcagcacgcccactggcccccaccagggactgagcactcaccacctcctggtggcctgtcccattggaggccctaggtcttattgatcagaaacgtgctcccaagccttggcctccacgagggaggcctgggactgtgccctggatttgctccaacccactgcctgaatgcagtcactggcctcccggtaacctcagcttcccatgttcagtag

SEQ ID NO: 63011 - DNA, 601 bp, Human
gactgaaggatgggggcgatgtcagggaggtttagggcacatgttggggcaaagttgagggaagatgattggggtgcagagcaggagtgtttggggctcatcctgggccaccccttcctggaaaaatttggctacaagtcagggaggcaaatgtgtgggccatgccccccccctcgctaggcagtaaacactgccgtcgcctgggagacaagaaaacatcttggtccccccacggttgtttataccaggactccctctccttctctggcctggtctggcctctccactcctgagctgggckacctgagtcgagggtccagcccccggtcatggcaggaggccctggcagcacgcccactggcccccaccagggactgagcactcaccacctcctggtggcctgtcccattggaggccctaggtcttattgatcagaaacgtgctcccaagccttggcctccacgagggaggcctgggactgtgccctggatttgctccaacccactgcctgaatgcagtcactggcctcccggtaacctcagcttcccatgttcagtagcaggcaggatctagattagagcttttcaaactgtttcaagtc

SEQ ID NO: 63012 - DNA, 601 bp, Human
atgggggcgatgtcagggaggtttagggcacatgttggggcaaagttgagggaagatgattggggtgcagagcaggagtgtttggggctcatcctgggccaccccttcctggaaaaatttggctacaagtcagggaggcaaatgtgtgggccatgccccccccctcgctaggcagtaaacactgccgtcgcctgggagacaagaaaacatcttggtccccccacggttgtttataccaggactccctctccttctctggcctggtctggcctctccactcctgagctgggctacctgagtygagggtccagcccccggtcatggcaggaggccctggcagcacgcccactggcccccaccagggactgagcactcaccacctcctggtggcctgtcccattggaggccctaggtcttattgatcagaaacgtgctcccaagccttggcctccacgagggaggcctgggactgtgccctggatttgctccaacccactgcctgaatgcagtcactggcctcccggtaacctcagcttcccatgttcagtagcaggcaggatctagattagagcttttcaaactgtttcaagtcatagatctg

SEQ ID NO: 63013 - DNA, 601 bp, Human
ccacctcctggtggcctgtcccattggaggccctaggtcttattgatcagaaacgtgctcccaagccttggcctccacgagggaggcctgggactgtgccctggatttgctccaacccactgcctgaatgcagtcactggcctcccggtaacctcagcttcccatgttcagtagcaggcaggatctagattagagcttttcaaactgtttcaagtcatagatctggttctttgaatgacacctgatacagaagcacaatatataaaacagatcaaagtagggctactctgggtggagtcaygggttggggcccagaattctacccactctatgccagcctatatggccctggcatatcaacccagagcctgtacatggtcctccttgctctagaacacattccaggtaaccctggaattccctggccaaatacttatgcctacttccagggtctgcacaggcccttctcccaggggctgtcagagcagccctaggctcaaggacggctgtttgtagtgggtatagcaaaagcccggaagagcaggctgaggcacccccaggagtgtacccaaggcccctcccagggagggatgggcccagt

SEQ ID NO: 63014 - DNA, 601 bp, Human
ctactctgggtggagtcacgggttggggcccagaattctacccactctatgccagcctatatggccctggcatatcaacccagagcctgtacatggtcctccttgctctagaacacattccaggtaaccctggaattccctggccaaatacttatgcctacttccagggtctgcacaggcccttctcccaggggctgtcagagcagccctaggctcaaggacggctgtttgtagtgggtatagcaaaagcccggaagagcaggctgaggcacccccaggagtgtacccaaggcccctcccrgggagggatgggcccagtgtgggaagagaatctgaggatcggagggtagcaaggggctggctgtcccttccctgctggattccagcatgggattccaaggcatccaagaactaaaattcaaacctggtcttctaggtcattatgaaggtatatgtgtcaggaaggatagagcaaattttatttaaaagtttgttaacctgattgaaacttttaaatatttagacttatggtatgtgggtctccatttatactctctccccagtcctgccagagttaggggtgagcttgcatcaatcctcc

SEQ ID NO: 63015 - DNA, 601 bp, Human
cacctacctctgcagcaaccccaagacagccttacccagaactctcaggcttcacaggacagtgtggaagtcccactcgctgaaactcaaggccctggtgactgcatctttctgttcactccccagatactgtctgagcatcagctggggccagcctgggggttgtggaggagccagactggccttgccctagagggatggatctcagtgaggagtaagcgggtaggaacactctccctcttgtagaatagtgtgagaaggggtgcctgagggggcccacaggggccctggaatcctaacsaggggctaaagaagctcctctattcaaagccgatcatggatggatgaggtggaagagagacagcccaagaaggggagacagtacaaaagccaccaaggtggaaatgtacagggagtggagaagtcgagtgtcgctggtgcttaggatgtgtgtacagcctcaaacgctggtctaaggagcttgggttttctattttaacagtaagaagctgttgtaggattgtaaatggggtaggggctgaggaagaggcattcagactgcaaggtaagtggactggaggtggggatagggggctggaat

SEQ ID NO: 63016 - DNA, 601 bp, Human
caaagtcacatgcagcaggaagggcaggggcaggtcccatcttggccccaggatgagggaatttttgaggtgggagtgagaggcaggtgcctgagtccttctacagacagaggagaaatccaaagaacattgcattaggaatcaggaaatctgggtgccaggcccaactctgtctctgatctactgtatgatcacaggtaagccaggcccctctctgggactcagtttccccatctataaatgagaaggttggttaatctctaagggacctttcagtgcccagatatagccagtatctggwcatatcttgccacttccgcttcccctcatacaagtcaccatcatcagctggtagtggctcatgcctgtaagcccagcactttgggagatggaggcaggagaattgtttgagcccaggagttcgagacgagcccgggcaacatggggagaccctgtctctacaaaaaataaatataaattagtcgggcatggtggcacccacctgtggccccagctactcagggggctgaggctggcggattgtttgagcccaggaggttgaggctgcagtgagccgtgattgcaccactgcactccagcc

SEQ ID NO: 63017 - DNA, 601 bp, Human
tgggtgccaggcccaactctgtctctgatctactgtatgatcacaggtaagccaggcccctctctgggactcagtttccccatctataaatgagaaggttggttaatctctaagggacctttcagtgcccagatatagccagtatctggtcatatcttgccacttccgcttcccctcatacaagtcaccatcatcagctggtagtggctcatgcctgtaagcccagcactttgggagatggaggcaggagaattgtttgagcccaggagttcgagacgagcccgggcaacatggggagacmctgtctctacaaaaaataaatataaattagtcgggcatggtggcacccacctgtggccccagctactcagggggctgaggctggcggattgtttgagcccaggaggttgaggctgcagtgagccgtgattgcaccactgcactccagcctgggtaacagagtgagaccctgtctcaaaaaaaaaaaaaaaaaaaaagtcacacagggtgaagtggcatgtgcctgtagtctcagctactcaggcagctgaggtgggaggatcatttgagcccaggagttctgggctgtggtgagctattc

SEQ ID NO: 63018 - DNA, 601 bp, Human
ctgtatgatcacaggtaagccaggcccctctctgggactcagtttccccatctataaatgagaaggttggttaatctctaagggacctttcagtgcccagatatagccagtatctggtcatatcttgccacttccgcttcccctcatacaagtcaccatcatcagctggtagtggctcatgcctgtaagcccagcactttgggagatggaggcaggagaattgtttgagcccaggagttcgagacgagcccgggcaacatggggagaccctgtctctacaaaaaataaatataaattagtygggcatggtggcacccacctgtggccccagctactcagggggctgaggctggcggattgtttgagcccaggaggttgaggctgcagtgagccgtgattgcaccactgcactccagcctgggtaacagagtgagaccctgtctcaaaaaaaaaaaaaaaaaaaaagtcacacagggtgaagtggcatgtgcctgtagtctcagctactcaggcagctgaggtgggaggatcatttgagcccaggagttctgggctgtggtgagctattccaatcaggtgtccacactaagtttggcataaa

SEQ ID NO: 63019 - DNA, 601 bp, Human
gctggtagtggctcatgcctgtaagcccagcactttgggagatggaggcaggagaattgtttgagcccaggagttcgagacgagcccgggcaacatggggagaccctgtctctacaaaaaataaatataaattagtcgggcatggtggcacccacctgtggccccagctactcagggggctgaggctggcggattgtttgagcccaggaggttgaggctgcagtgagccgtgattgcaccactgcactccagcctgggtaacagagtgagaccctgtctcaaaaaaaaaaaaaaaaaaaaagtcacacagggtgaagtggcatgtgcctgtagtctcagctactcaggcagctgaggtgggaggatcatttgagcccaggagttctgggctgtggtgagctattccaatcaggtgtccacactaagtttggcataaatatggtgacctcctgggaacagaggaccatcaagttgcctagggaggggtgaactggcccaggtcagaaacggagcaggtcaaaactcccgtgttgaccagtagtgggatcacacctgtgaatagccactacaatccagcctgggcaacataacaagaccccat

SEQ ID NO: 63020 - DNA, 601 bp, Human
gtcactggcatctcttgccaggattatactttccaactcacaatggggcaaacgtcattgctccctcctcccctctcccccaccatagtccgttcactcagcagcctgtgtgatctttttaaacataaggaagattgagctactccctgctcaaactccccatctcactcagagtaaaagccaagatccttaccatagccagtagatggtccgctttccacctcccctgcctctctgccctcaccccccaccactctccccttgctcattccactctgggatcactcctttcctggtagtkctggaacacagaaggcacccttctggctcagatgtgttggatttgtttttccctctggaggtgggatgggggttaagggagcatgaggtgggggctctgacctaagcctgccagtctgagctcatgctcagacacagcatgagtaaaggtggggaggggaaaagagcgcgtttgccattgtcagggacagagctatgataatgcagtgccaagtgtcaggttgggtaccggctagtgaagagcaagttggcctggtgggtggggctttccttgcaatcatgctaaggggtttgggcctgg

SEQ ID NO: 63021 - DNA, 601 bp, Human
cagcagcctgtgtgatctttttaaacataaggaagattgagctactccctgctcaaactccccatctcactcagagtaaaagccaagatccttaccatagccagtagatggtccgctttccacctcccctgcctctctgccctcaccccccaccactctccccttgctcattccactctgggatcactcctttcctggtagttctggaacacagaaggcacccttctggctcagatgtgttggatttgtttttccctctggaggtgggatgggggttaagggagcatgaggtgggggctcygacctaagcctgccagtctgagctcatgctcagacacagcatgagtaaaggtggggaggggaaaagagcgcgtttgccattgtcagggacagagctatgataatgcagtgccaagtgtcaggttgggtaccggctagtgaagagcaagttggcctggtgggtggggctttccttgcaatcatgctaaggggtttgggcctgggcccacaactcagtggatttcacactttttaaaaaaacagcaaagctttttgttcacatgaaatttttttttttttttaagatggagtcttgctctgt

SEQ ID NO: 63022 - DNA, 601 bp, Human
ctccccatctcactcagagtaaaagccaagatccttaccatagccagtagatggtccgctttccacctcccctgcctctctgccctcaccccccaccactctccccttgctcattccactctgggatcactcctttcctggtagttctggaacacagaaggcacccttctggctcagatgtgttggatttgtttttccctctggaggtgggatgggggttaagggagcatgaggtgggggctctgacctaagcctgccagtctgagctcatgctcagacacagcatgagtaaaggtggggaggggaaaagagcgcgtttgccattgtcagggacagagctatgataatgcagtgccaagtgtcaggttgggtaccggctagtgaagagcaagttggcctggtgggtggggctttccttgcaatcatgctaaggggtttgggcctgggcccacaactcagtggatttcacactttttaaaaaaacagcaaagctttttgttcacatgaaatttttttttttttttaagatggagtcttgctctgtcgcccaggctggagtgcagtggcgcaatctcggctcactgcaggctccgcctcctgg

SEQ ID NO: 63023 - DNA, 601 bp, Human
cagagtaaaagccaagatccttaccatagccagtagatggtccgctttccacctcccctgcctctctgccctcaccccccaccactctccccttgctcattccactctgggatcactcctttcctggtagttctggaacacagaaggcacccttctggctcagatgtgttggatttgtttttccctctggaggtgggatgggggttaagggagcatgaggtgggggctctgacctaagcctgccagtctgagctcatgctcagacacagcatgagtaaaggtggggaggggaaaagagcgygtttgccattgtcagggacagagctatgataatgcagtgccaagtgtcaggttgggtaccggctagtgaagagcaagttggcctggtgggtggggctttccttgcaatcatgctaaggggtttgggcctgggcccacaactcagtggatttcacactttttaaaaaaacagcaaagctttttgttcacatgaaatttttttttttttttaagatggagtcttgctctgtcgcccaggctggagtgcagtggcgcaatctcggctcactgcaggctccgcctcctgggttcacgccattct

SEQ ID NO: 63024 - DNA, 601 bp, Human
tctagctgaagtcccttcttcggtatcagctccggtttggggtttaaggagcccctttcttccagaaggtgatggtggccatagcttctgccctctagggaccttggctgaatggaggacagactggcctcagggtcctccagctgaggggagacagagccctgcctttgggccctggtctagggggcaaggaaagagtcacgcgctccccaggccagatgcacaaatcacttgagcttgggggttggagaccagcctgggaaaatagcaagaccttgtctctactaaaaatcaaaaaaaattagccaggtgtggtggtcccggctactcaggaggctgaggcaggcagatttcttgagccttggagagtgatgctgcagtgagctatgattgcaccactgcattccaacacaggcaacagagcaagaccctgtctcaaaagaaaagaaatcagggaaactgctggtggctgggcagtccccagacactggcagggctcagtctgggagggacgctggaaagacgagggaaggaaggaggctctggaggaaggagggggcaaggcctggatctgtatttaccttggccttggtggatactt

SEQ ID NO: 63025 - DNA, 601 bp, Human
gcatttccagccgggtctctctcttcatacccatggagtgtttgcccagtgcccatagccctctctctctctcaacatgcccaccacccaacacctgctcctccagtggggtctcccccgtcccatgaaggcactcatggcaccttcatccatccaatgcccaaaccagaaatagagaagttgttctccttcctagttcccgtttccagttaatcaccgagccctacttcctgcggtgttttccaacccatccactcctcttccctgctgccaccaccctgggccaggccacagtcatctstcgtctgagctattgtggagctttcttggtctttctgctgagtcttatctcctttgatctattctgtgtacttccccaagtggtcctgagatgcaaattggactgtgtcatttcctctcttagaactccacaattggccaggtgcggtggctcacgcctgtaatcccagcactttgggaggccgaggcaggtggatcacttgaggtcaggagttcaagaccagcctggccaacatggtgaaaccccgtctctactaaaaatacaaaacttagccgggcgtggtggtaggcacctgtaatc

SEQ ID NO: 63026 - DNA, 601 bp, Human
aatgcccaaaccagaaatagagaagttgttctccttcctagttcccgtttccagttaatcaccgagccctacttcctgcggtgttttccaacccatccactcctcttccctgctgccaccaccctgggccaggccacagtcatctgtcgtctgagctattgtggagctttcttggtctttctgctgagtcttatctcctttgatctattctgtgtacttccccaagtggtcctgagatgcaaattggactgtgtcatttcctctcttagaactccacaattggccaggtgcggtggctcasgcctgtaatcccagcactttgggaggccgaggcaggtggatcacttgaggtcaggagttcaagaccagcctggccaacatggtgaaaccccgtctctactaaaaatacaaaacttagccgggcgtggtggtaggcacctgtaatcccagctactcgggaggctgaggcacgagaatctcttgaacccaggaggcggaggttgcagtgagccaacaccactgcactccagcctgggcgacagagtgagactccgtctcaaaaaaaaaaaaagaactctacaatgactccccattgcctttg

SEQ ID NO: 63027 - DNA, 601 bp, Human
cacagtcatctgtcgtctgagctattgtggagctttcttggtctttctgctgagtcttatctcctttgatctattctgtgtacttccccaagtggtcctgagatgcaaattggactgtgtcatttcctctcttagaactccacaattggccaggtgcggtggctcacgcctgtaatcccagcactttgggaggccgaggcaggtggatcacttgaggtcaggagttcaagaccagcctggccaacatggtgaaaccccgtctctactaaaaatacaaaacttagccgggcgtggtggtagkcacctgtaatcccagctactcgggaggctgaggcacgagaatctcttgaacccaggaggcggaggttgcagtgagccaacaccactgcactccagcctgggcgacagagtgagactccgtctcaaaaaaaaaaaaagaactctacaatgactccccattgcctttgggatcatgttcacagtgcctgagaatgctactcaaggcccctgggtctggccctctctggtttttccactgcccccttcactttaggccacaccatccagaactgctggccgttctgggctgcctcgacggcca

SEQ ID NO: 63028 - DNA, 601 bp, Human
aattgagtcagctgcaactgctcccatcacctaagccagtgattctcaaagtgtggtccccataacagcagcaatagtatcaccagggacctttgtagaaaggcatattttccacttcaaacttactgaatcagacactgtaggaataggtcccagaaatcagtattttaacaagccctccaggtgactctgacacccaccgtagtttgaaaaccacaaatctaagcaaaccattcactttttcatctctaatcctcttgctccctcctgaacgagtgggatagtcatgggatggggagaygggggaaatggagaggaaaggttggataagccttgtgatcagaccagctggggagagccagccaggcaacacccgcctgtctcattctgcctcctgggctgggcagggagaaagaacatgggccacaacttgcaggcagacatgatgggcaaagatgtcctagaaagtggccgctagtctggcctgtctgctggggagattagagagggcccaggccagccagcacccatgtttcatctatatttgtatagatggagaaactgaggtcccagagggggccagagagaatccttagaaagt

SEQ ID NO: 63029 - DNA, 601 bp, Human
tgggatagtcatgggatggggagacgggggaaatggagaggaaaggttggataagccttgtgatcagaccagctggggagagccagccaggcaacacccgcctgtctcattctgcctcctgggctgggcagggagaaagaacatgggccacaacttgcaggcagacatgatgggcaaagatgtcctagaaagtggccgctagtctggcctgtctgctggggagattagagagggcccaggccagccagcacccatgtttcatctatatttgtatagatggagaaactgaggtcccagaggrggccagagagaatccttagaaagtcctttgatggatgaatgaagccacaccctagttgtggcaggcatgagaccccagctaaggggctccttcaccttgtctcctctacccctgacctccagatactgatctctcttctgctgtccctgtgtgaggaccacccccactccaggaaggccaaggcagcttgagggtcagcctgagctggggttctagctgcagctctgccactgattcactgtgtgatcctgaacaagtctatccctccctgagctctatttcctcagctggaagatatgg

SEQ ID NO: 63030 - DNA, 601 bp, Human
aatggagaggaaaggttggataagccttgtgatcagaccagctggggagagccagccaggcaacacccgcctgtctcattctgcctcctgggctgggcagggagaaagaacatgggccacaacttgcaggcagacatgatgggcaaagatgtcctagaaagtggccgctagtctggcctgtctgctggggagattagagagggcccaggccagccagcacccatgtttcatctatatttgtatagatggagaaactgaggtcccagagggggccagagagaatccttagaaagtcctttgwtggatgaatgaagccacaccctagttgtggcaggcatgagaccccagctaaggggctccttcaccttgtctcctctacccctgacctccagatactgatctctcttctgctgtccctgtgtgaggaccacccccactccaggaaggccaaggcagcttgagggtcagcctgagctggggttctagctgcagctctgccactgattcactgtgtgatcctgaacaagtctatccctccctgagctctatttcctcagctggaagatatggataattattcaggtgcctggaacacaggatc

SEQ ID NO: 63031 - DNA, 601 bp, Human
gagccagggcagtgccacgccctttgcatgtcttccttccatagcccccacttcatagataacgagatggctcagagaaggcaggtgacagtctcaaaaccacacacacaagcaggactgggatccaaactcaggtctctctgaccccgagctgctgtccttaaggtcaccacgaaacatgaatataaataaagccacatagaaggtgacttgggccacacatagggaggcaagcatcgggagttggcagttctgaaggggggatagtggggtgcgggaatcagaggctccgtagagctttgtagcatttgtgttcctgtaggcgtggacgatgagcagagtctcgcaggcacagacatgaggtgttctgcgtagcatgcaccgtgccagcaacggtgcagaggtggggagactggggacatctgggaaggctggcgggtcagtacacagagatgtatttccagagaagcctgttccctccggagtctcctccagggtgtgtgcatgttcagcacacccccatcctaaagaggggtgctcctggaggccacctcattcgcctctgctgtgtctgcagcctgtgacctctcacctcgctctc

SEQ ID NO: 63032 - DNA, 601 bp, Human
cggatcagggggcggggccggagaggcggggcttgagggtttcccctggatgcttctgggtttgaagggaccactcgtaccacaaagtgggcagctgaggtgggacttgagggtggggctggagcggggctagggtgggccccaggtggaagcctgaaagtgggacttgggggacggggcaaggtaggccgggtgctggagtcctgagcctggaacctggagactcaaggcaggcggggtgggggtgggggtgggaatgggggtcggggtagggggagtgctggcggtttcgcgaaggccrgggcagggtcgccgtgatgggaggagctgagaaagaaaagcgagcctgggactccgggagatgggggacctttatccctttcccgtgtggaagccccccacatctcccaggcaggcacagcgctcctcaccgcgcccctccgcctgccccgcaggagctgatcaccgcctggtacatcgggttcctggtgctcatcttcgcctccttcctggtctacctggctgagaaggacgccaactccgacttctcctcctacgccgactcgctctggtgggggacggtgcgtgagggtctttgtag

SEQ ID NO: 63033 - DNA, 601 bp, Human
ggtcgccgtgatgggaggagctgagaaagaaaagcgagcctgggactccgggagatgggggacctttatccctttcccgtgtggaagccccccacatctcccaggcaggcacagcgctcctcaccgcgcccctccgcctgccccgcaggagctgatcaccgcctggtacatcgggttcctggtgctcatcttcgcctccttcctggtctacctggctgagaaggacgccaactccgacttctcctcctacgccgactcgctctggtgggggacggtgcgtgagggtctttgtagggctgcmcttctccctgggatcctccctgggaacttcccgaggtctgcccatcgtgactcctgactcagggttgagcgggcctgcccctgccctctcactagagctgggacccccctgagaccagccccaatgctaaccccccaacctgctctggtggacctgcctctgtccccagctagccccgcacatcaagaccttgtgactatacccctttcccctgaccagcccaggagagggagaatccatctatgaccctaaccagcccccgtgggtgaccaggggccccttccctcatgatcaggctcc

SEQ ID NO: 63034 - DNA, 601 bp, Human
caccgcgcccctccgcctgccccgcaggagctgatcaccgcctggtacatcgggttcctggtgctcatcttcgcctccttcctggtctacctggctgagaaggacgccaactccgacttctcctcctacgccgactcgctctggtgggggacggtgcgtgagggtctttgtagggctgcccttctccctgggatcctccctgggaacttcccgaggtctgcccatcgtgactcctgactcagggttgagcgggcctgcccctgccctctcactagagctgggacccccctgagaccagccmcaatgctaaccccccaacctgctctggtggacctgcctctgtccccagctagccccgcacatcaagaccttgtgactatacccctttcccctgaccagcccaggagagggagaatccatctatgaccctaaccagcccccgtgggtgaccaggggccccttccctcatgatcaggctcctacctgcctgtacccccaacaagccgtaggtggcccccgtgaccagtcctgcctgtaacctgtttgtgtctccagattacattgacaaccatcggctatggtgacaagacaccgcacacat

SEQ ID NO: 63035 - DNA, 601 bp, Human
cgcgcccctccgcctgccccgcaggagctgatcaccgcctggtacatcgggttcctggtgctcatcttcgcctccttcctggtctacctggctgagaaggacgccaactccgacttctcctcctacgccgactcgctctggtgggggacggtgcgtgagggtctttgtagggctgcccttctccctgggatcctccctgggaacttcccgaggtctgcccatcgtgactcctgactcagggttgagcgggcctgcccctgccctctcactagagctgggacccccctgagaccagccccartgctaaccccccaacctgctctggtggacctgcctctgtccccagctagccccgcacatcaagaccttgtgactatacccctttcccctgaccagcccaggagagggagaatccatctatgaccctaaccagcccccgtgggtgaccaggggccccttccctcatgatcaggctcctacctgcctgtacccccaacaagccgtaggtggcccccgtgaccagtcctgcctgtaacctgtttgtgtctccagattacattgacaaccatcggctatggtgacaagacaccgcacacatggc

SEQ ID NO: 63036 - DNA, 601 bp, Human
gctatgtgactttcctggagccacatgccaagtcacacacagagccaggatgctcactgacagtgccagaaacttccccctgcaccaaatgcctggtttagggctagccagaactgccctattgcccaactccagcccaacttcacagggcctggggaggggcggagcccagacaggagctgggaggcctctggtggagacccactgctgcccccatcagctgtgcagcagtaagcctgccccacttccagcaccttcattcattcattcattccacaagcactcacacaaatgaagagargatggtgcagacagggcttttaggaatctcaacatttagcaggtgggtgggcctgcaaagttgagctgggcaaggagacagaaggaacagccagaggggtgggtaggaagccaggagtgtgtggtctcagtttccctctgtgccatggcgtgttgtgactgtgtgtgggctgaggccagggctctgattttctgtgaccctgggactaggccttggctttttctagtcaggggtgtgtgtaagggaactccttgcaggaaatgcttcagggaatactggcccagtccacctctgcctgct

SEQ ID NO: 63037 - DNA, 601 bp, Human
ggggtgtgtgtaagggaactccttgcaggaaatgcttcagggaatactggcccagtccacctctgcctgctccctagcctgtcaccctctgagccccaaacccaagcctcactcagcccttccttatctctcctccccagggtagaaccctcctccctgtcgctgttatctccagccaccagctcagccttttcttcttagcgtcccttggggcacaatggccactgtcccctgggagctggccttctgaggggcattgtaggggcaggcggctggcactgtccatgccaagagacagctrgtattgtggtgcccataattaatgagacagctctggcagctgctccccagcccatgccaggggcctaggcaagcaggaagtaaaaatattcctgtcttaggagggtgcctggctggtgaggtcagcagtggcagccccttaaggacaagaggcatccaaagaagggaggcgtccagggcccagctctgccttgtcctgcctagcagcctccatgcctccctgctctcactgatggccacactcacagtccctccctggctcttcctacgtggagggagagggacagtctctcctcctgtc

SEQ ID NO: 63038 - DNA, 601 bp, Human
ctacgtggagggagagggacagtctctcctcctgtctgactttcatccctcctgctgcagaggaagctcggcaagcccatggatgctgaggggttggtaggtaatgcttttcctcccctctcagtccttagtattcccatgggcagtgacaggcagctgggaaagatggagtggcattgctagtaataataatgacattctgcaaacatttgcaaagcacccacatgtgccagacactatatttgcactgagaatgcagcggtaacaaagacacagcttgcagtctagggggagagaaagwtatcagtcaaatacacaatgaataggtattcatcaaatgtgataaggggaataacaggagtgtttaacagaggaacctggcatgaagtgcctactatataccaggcactgagcttggcatttaatatacaactgttcatttaatcctcacaacaccctggtaggcaagtagtgttacatgcgttttacaggtgaagaaactgaggtcctgaagctttacttaatttgtcctcactaataaggggcagagctgggattggaaacccatgtctgcctgacaacaaaactccagctcttaacc

SEQ ID NO: 63039 - DNA, 601 bp, Human
caggagctctgtgcccactgggtgaggggggtggtgccatggccctgcctgccactgatggtgccctctcctgcagagagctggccctcttgtttgagcacgtgcaacgggcccgcaatgggggcctacggcccctggaggtgcggcgggcgccggtacccgacggagcaccctcccgttacccgcccgttgccacctgccaccggccgggcagcacctccttctgccctggggaaaggtaggggccccgtggggctgccacctcctcttgcttctcctcctcttcttccattctctgtcytcatcctctctcagacctgccttcagccacttcgtgggtgtctgggcctgtttgggggactcctaggccgtcagagggccagacaggtacagactgagggcctctctggaggggtcaggctggactcacctttttgtcctgtggggctctgagggtctgagtgggagagatgtccatgccatcctttcccatcatctcctccgttcatggcattgtcctctttctttctctgttcccacgtcccccttactcctccatccctgcacccccatccctcccgggaagctggacagaggagga

SEQ ID NO: 63040 - DNA, 601 bp, Human
ctgattggggctctgggtactctagagtttctgggctgaaaaggcctagggaggagttttggtgcagaggatgcagggagcagcctcccttccttgttctcagtgagggcacttctgggccaggggctgaacaggaagtgggtggagagggagagtccctccaggtctggggctggagggaggggaagcgtgactgccaggccaggctgagagctccctgggagagtagggcccctctcagattctctgcccgaaggtccctcattgttaccttcatccctaccaaacatagtttccaggyggaaactcaagagtttttgtatcccagcaatcctgtccaggacctgagccagggctctctgtgcttccagttcactctggtctcattttgactgaataggaaggcaaggggaatggacattagcctggggcctagtacctgtacactccccacggctcctttggtccctgacacccccagggcccaggaacagattactactaagggcttggctgtcactgactcccagcctcgtatctatctgcctgggaggggacttggcgagtgtctgggacacagggtgatggtagtaaagtggcc

SEQ ID NO: 63041 - DNA, 601 bp, Human
ccagcaatcctgtccaggacctgagccagggctctctgtgcttccagttcactctggtctcattttgactgaataggaaggcaaggggaatggacattagcctggggcctagtacctgtacactccccacggctcctttggtccctgacacccccagggcccaggaacagattactactaagggcttggctgtcactgactcccagcctcgtatctatctgcctgggaggggacttggcgagtgtctgggacacagggtgatggtagtaaagtggccctttctcccagggaccccaggggrctgagccatggtttgtagatcagtcaccaggctcaggcccaatggccatatcgttaatcgtggctgtctagaccgccagccaggacacccttcctccaccaaaaacacacacacatatacacactcggttggccacacctctggtggtgcttggggatggacctgggccaagtgtgcccacaggaagtggtgctaaaggagcaggatttcctgggggatggcattgccagggccagcacctctcctcttcagggttttgcaatgagtttatcaaaccatggtctccagacctcctgcatc

SEQ ID NO: 63042 - DNA, 601 bp, Human
aggatgatttaggtgggggtccttctttcccaccagctaccggaggccggccccatcccagcagctccccacactctgcccacagcccctttcccgctaacctctgttcgtgtcttattctcaaacttccagccagatgtttaataataaacggagtttctttcggatccacgccagctggagaccgaggtaccccctcgcctgctcctcctgtccccactcctccttgccccacccaatttgggggctggagaggggacaggatgggccaaggacaaggtgcatgtgcctgccgcctgcygtctgccttgggtgcccagtgaacccctcgcctttctgggatgcctctgctaggtctggggcatgggcccagggtgccaggaggggcacgtgcaggagccttaaggatgtgtgctggctctgctgctgatgccctctgtgatcttggccaaattgcttcccttcttggacctcagttttccgtctgtggaatgggcagattgaactagaggacctctgagggtccttctcactctgacttttgccaggccttgggcttagctttctgtctccctgctacccacctggggacctagcagat

SEQ ID NO: 63043 - DNA, 601 bp, Human
atgggcagattgaactagaggacctctgagggtccttctcactctgacttttgccaggccttgggcttagctttctgtctccctgctacccacctggggacctagcagatgcctgaaggagctgggtttggcacctttgccagctccaggaccccagctcttttagcggcatctccatggcattccttggtacctgccctgtgccaggacttgctctgtgcactagggacacggtgatgaataaaacatcgtcctcggagagttgcaaagagtaattgcagctcagtgtgatgagtgcaayaaagggaggaagcacaggggctgtggagcccgggtcaggcacacaacccagaggaagccctaaaagcagtgggtttcagggagggcattccaggcagtgaagcagcacggacccaagcaaggaggcaagagggagcacagtgtggggaaaaaagctggcagcccagtttggcccccctgagactggacatcagagcgaaggttgggggcagagctgggtcatgcagaacctaaaagcccagtgtgagcttcaccctgttggcatgcttggcagcctgagctcatggagtcctgggtttcc

SEQ ID NO: 63044 - DNA, 601 bp, Human
cactagggacacggtgatgaataaaacatcgtcctcggagagttgcaaagagtaattgcagctcagtgtgatgagtgcaacaaagggaggaagcacaggggctgtggagcccgggtcaggcacacaacccagaggaagccctaaaagcagtgggtttcagggagggcattccaggcagtgaagcagcacggacccaagcaaggaggcaagagggagcacagtgtggggaaaaaagctggcagcccagtttggcccccctgagactggacatcagagcgaaggttgggggcagagctgggtyatgcagaacctaaaagcccagtgtgagcttcaccctgttggcatgcttggcagcctgagctcatggagtcctgggtttccaaaggtgcctctggggccctgtgggctggggtcccggagctaggagatgagtggcagggctcctggctgcccatgtgtgcttctgctgagaggtgttttttcctagaaacgtgggttctggaccacaatctagctactacccactattcgtgtgtccttgggcaaatcacctgacccctttgcacctcagtttcctcagatgtaaaatgcagatgtaaat

SEQ ID NO: 63045 - DNA, 601 bp, Human
aaaagctggcagcccagtttggcccccctgagactggacatcagagcgaaggttgggggcagagctgggtcatgcagaacctaaaagcccagtgtgagcttcaccctgttggcatgcttggcagcctgagctcatggagtcctgggtttccaaaggtgcctctggggccctgtgggctggggtcccggagctaggagatgagtggcagggctcctggctgcccatgtgtgcttctgctgagaggtgttttttcctagaaacgtgggttctggaccacaatctagctactacccactattcrtgtgtccttgggcaaatcacctgacccctttgcacctcagtttcctcagatgtaaaatgcagatgtaaatagggtctgcttccactaaaactggacctggctccaataaatattggccttatttgatttggtatgttcagcagttaagatcttatttaccttaaaagaaaatagcttagaaaccatggctgtgggcaatggtttgagctgaagcgttgagctaaggagtctctgggtcaggcccgccattttgcaagcctcctttggctgtggagggtgtggacaggaaggacacagcca

SEQ ID NO: 63046 - DNA, 601 bp, Human
catgcagaacctaaaagcccagtgtgagcttcaccctgttggcatgcttggcagcctgagctcatggagtcctgggtttccaaaggtgcctctggggccctgtgggctggggtcccggagctaggagatgagtggcagggctcctggctgcccatgtgtgcttctgctgagaggtgttttttcctagaaacgtgggttctggaccacaatctagctactacccactattcgtgtgtccttgggcaaatcacctgacccctttgcacctcagtttcctcagatgtaaaatgcagatgtaaayagggtctgcttccactaaaactggacctggctccaataaatattggccttatttgatttggtatgttcagcagttaagatcttatttaccttaaaagaaaatagcttagaaaccatggctgtgggcaatggtttgagctgaagcgttgagctaaggagtctctgggtcaggcccgccattttgcaagcctcctttggctgtggagggtgtggacaggaaggacacagccatggcagaggccagtggcgaggctgtttccatagtccctgaagaggggctgtatgtggcttcagaagtcgt

SEQ ID NO: 63047 - DNA, 601 bp, Human
cttctgctgagaggtgttttttcctagaaacgtgggttctggaccacaatctagctactacccactattcgtgtgtccttgggcaaatcacctgacccctttgcacctcagtttcctcagatgtaaaatgcagatgtaaatagggtctgcttccactaaaactggacctggctccaataaatattggccttatttgatttggtatgttcagcagttaagatcttatttaccttaaaagaaaatagcttagaaaccatggctgtgggcaatggtttgagctgaagcgttgagctaaggagtytctgggtcaggcccgccattttgcaagcctcctttggctgtggagggtgtggacaggaaggacacagccatggcagaggccagtggcgaggctgtttccatagtccctgaagaggggctgtatgtggcttcagaagtcgtaggctgcctctgttcccccagtgagagtggccctgggagggcagatcatgaggccctaaagaaagtccttgtggaagtgagttcaaggggttgggaccagcagggcagcctgggcagagctcggcctccccagcagggcagccacagtccagcccacccc

SEQ ID NO: 63048 - DNA, 601 bp, Human
gttttttcctagaaacgtgggttctggaccacaatctagctactacccactattcgtgtgtccttgggcaaatcacctgacccctttgcacctcagtttcctcagatgtaaaatgcagatgtaaatagggtctgcttccactaaaactggacctggctccaataaatattggccttatttgatttggtatgttcagcagttaagatcttatttaccttaaaagaaaatagcttagaaaccatggctgtgggcaatggtttgagctgaagcgttgagctaaggagtctctgggtcaggcccrccattttgcaagcctcctttggctgtggagggtgtggacaggaaggacacagccatggcagaggccagtggcgaggctgtttccatagtccctgaagaggggctgtatgtggcttcagaagtcgtaggctgcctctgttcccccagtgagagtggccctgggagggcagatcatgaggccctaaagaaagtccttgtggaagtgagttcaaggggttgggaccagcagggcagcctgggcagagctcggcctccccagcagggcagccacagtccagcccaccccatctttctcccaggt

SEQ ID NO: 63049 - DNA, 601 bp, Human
cagcagttaagatcttatttaccttaaaagaaaatagcttagaaaccatggctgtgggcaatggtttgagctgaagcgttgagctaaggagtctctgggtcaggcccgccattttgcaagcctcctttggctgtggagggtgtggacaggaaggacacagccatggcagaggccagtggcgaggctgtttccatagtccctgaagaggggctgtatgtggcttcagaagtcgtaggctgcctctgttcccccagtgagagtggccctgggagggcagatcatgaggccctaaagaaagtcmttgtggaagtgagttcaaggggttgggaccagcagggcagcctgggcagagctcggcctccccagcagggcagccacagtccagcccaccccatctttctcccaggtaccaacagatccttagccagagtttcttgaccttggcatcattgacattagataattctttgtggattgcgactatcacatgcatggtaggatgtggaacagcacccttggcctctacctactagatgtctacctactagacattgccacatgtcccctgagtgggggaacttgctccagttgagaaccactg

SEQ ID NO: 63050 - DNA, 601 bp, Human
ggtctcctctaaggctggctggtactctcttgatctggggccccagacatttggggtgggtccccctgaacccgaacctgaacctgtcggaatctctagtggcaaaccacagcaggggaggcagcgatgacgtcacagggcatgggatggaggacatttgcataggtcctaccccaacagccataacattgtccttgaacctcttggacacagagttactctaccagatcatggttaaccagggcttgtcctggggaatgaggcctctgctaacttgttttcctccaacgtttggggaacrtggtggggagttggatgcgggaagggaagtctgagtgcatgtgtagacgtgcacgtacacgttcacatgcacacagactgtgtaaatgctgttgaaccgggagctcagtaggcagtatgggggggtagatctttagcggggatccaagaccacacaggcaggatgtcaatcaaggtgggctgaacttaggtaggagagaccacagaagaacatgttatcaaatagagaccctcactgagagggcaggcaccaggcatggcctgggcatacatgtgggcccagcagctagaaccatggggc

SEQ ID NO: 63051 - DNA, 601 bp, Human
ggtttgttttaagggccttccctagtagcagagctgggcctgggagccagccacttgggtgtccttccatcttagctgaaggagaagactgtgtgcatgattacatgcagtgccatcaaaccccttatctctggggctcactgttctgcaaggtggaaccagtggggcttcctccagggctttgtgcaacaaacttgccctggactaggccagctgtgccctaaagcagctcccacctacccaccaggcagatgtttaccctgactggccaccggggcagatgggcatgcaacacactggrgctttccaccctggggagggcagtgagacacaggagcccccaagaaggttctgagccctttctgggcctctgtcttcctattggacactctactggtggtttggcatacaagggtcggatgggaggttgggagtggccccttcggtgggccacttgccccatacctgccttttcagatgccccctcagaggaagtagcagaggagaagagctaccagtgtgagctcacggtggacgacatcatgcctgctgtgaagacagtcatccgctccatcaggtaagactgaggcctgaggcgagc

SEQ ID NO: 63052 - DNA, 601 bp, Human
ttctgcaaggtggaaccagtggggcttcctccagggctttgtgcaacaaacttgccctggactaggccagctgtgccctaaagcagctcccacctacccaccaggcagatgtttaccctgactggccaccggggcagatgggcatgcaacacactggggctttccaccctggggagggcagtgagacacaggagcccccaagaaggttctgagccctttctgggcctctgtcttcctattggacactctactggtggtttggcatacaagggtcggatgggaggttgggagtggccccttyggtgggccacttgccccatacctgccttttcagatgccccctcagaggaagtagcagaggagaagagctaccagtgtgagctcacggtggacgacatcatgcctgctgtgaagacagtcatccgctccatcaggtaagactgaggcctgaggcgagcacccccctccgtgtgccacccactgctgctccccatctgggcgggtggatcacttgaggtcaggagtttgagaccagcctggccaacatggtgaaaccccgtctctactaaaaatacaaaaaattagccagacgtggtggtgg

SEQ ID NO: 63053 - DNA, 601 bp, Human
catcaggtaagactgaggcctgaggcgagcacccccctccgtgtgccacccactgctgctccccatctgggcgggtggatcacttgaggtcaggagtttgagaccagcctggccaacatggtgaaaccccgtctctactaaaaatacaaaaaattagccagacgtggtggtggatgcctgtaatcccagctacttgggaggctgaggcaggagaatcacttgaacctgggaggcagaggttgcattaagccaagatagtgccattgcactccagcctgagcaacaagagtgaaactgtatwaaaaaaaaaaatgtattttttatggtgggtcttggtcaaaaaagtttgaaagcccctgctctactggctgtctccatgcctcaaaaattaagcagggaccagggtctcctaggccacggcctaggcatggatctggcctccaagctccttggtgtgccgtcctggcctagtctccatctccagcctgcagctctagctccagaaaccccctcaacctccaagttttctgggctccccactttcttccctggctgatacacctgcccacaagcctcttttcttgtattccttttaaaatta

SEQ ID NO: 63054 - DNA, 601 bp, Human
aaaagtttgaaagcccctgctctactggctgtctccatgcctcaaaaattaagcagggaccagggtctcctaggccacggcctaggcatggatctggcctccaagctccttggtgtgccgtcctggcctagtctccatctccagcctgcagctctagctccagaaaccccctcaacctccaagttttctgggctccccactttcttccctggctgatacacctgcccacaagcctcttttcttgtattccttttaaaattagagtcaggctgggcgtggtggctcatgcctgtaatcccamcactttgggaggctgaggcaagagaatcacttgaggtcagaagttcgagaccagcctgggcagcatagtgaaatcttgtctttgcaaaaaaaaaaaaaaaaaattaaaaaattagccaggcatgttggtgtgcccctgtagttccagctacttgggaggccaaggtggaaggatggcttgagtgcaggagtttgaggctgtagtgagccgtgattgagctactgcactccagcctgggtgacagagtgacaccttgtctctaaatagataaatagataaaatcagagtcagctggacctg

SEQ ID NO: 63055 - DNA, 601 bp, Human
ctggtggccaaaaggaaattcaaggagacactgcgaccgtacgacgtgaaggacgtcattgagcagtactcagcaggccacctggacatgctgggccggatcaagagcctgcaaactcggtgggtgcaccgggcctgttgggaggcaggggcagggaggcagcgaccccagccctgaatgaagtctgaggccaacccccgagcacccccaagggctcactgctgcagctgagtttctagactgaggaggtccctggcttgcagtgccagcctgaggccagacccagcacccgtcccaaggmtgagaaacaacccaaccatagtttctctgtgaggtgggtcctctgtgcaagccctattgactcatatgccttgggggctttgtttagaatgactgtttcctggtcctaaaataatcagcctaaaataatcactgacctcccatctcccaagagaataggcaaattgtcctcactgcccacctcttgcctctggaatcctcccacatctctctggtagacccagcattaggaagaatcctcaccccaagacccacatcacctgcaccttgcccttctcctcttctggcctgcattttcact

SEQ ID NO: 63056 - DNA, 601 bp, Human
actcagcaggccacctggacatgctgggccggatcaagagcctgcaaactcggtgggtgcaccgggcctgttgggaggcaggggcagggaggcagcgaccccagccctgaatgaagtctgaggccaacccccgagcacccccaagggctcactgctgcagctgagtttctagactgaggaggtccctggcttgcagtgccagcctgaggccagacccagcacccgtcccaaggctgagaaacaacccaaccatagtttctctgtgaggtgggtcctctgtgcaagccctattgactcataygccttgggggctttgtttagaatgactgtttcctggtcctaaaataatcagcctaaaataatcactgacctcccatctcccaagagaataggcaaattgtcctcactgcccacctcttgcctctggaatcctcccacatctctctggtagacccagcattaggaagaatcctcaccccaagacccacatcacctgcaccttgcccttctcctcttctggcctgcattttcactgtccactcattcatttaatcactcgagaaatagtcagtgggcatttactacttgccagcctgtgggg

SEQ ID NO: 63057 - DNA, 601 bp, Human
agttgatcaatggatttagcaacatggggttatttgggagcttgacaacagtagttttggtgaaatggcaggggtgaaagcctgactggagtaggtttaagagagaaggggaggaaaggaattggaggtagaggatagagataacactttcaagaattttgctgcaaaggagagcagaaaaataaggtgaggtcagttctagccttgtccacccaccttaaaagtcacattcccacgtgtctccactcctcccatcctctttccccttttccccaatccatcttttcttttcttttctttctttttttttttgagacagtatcttgctctgtcgcccaggctggagtgcagtggtgcaatcacagcgcactgcagcctcgacctctccggctcaagtgatcttcctgcctcagcctcctaagtagctgggaccacaggcatgagctaccatgtccagctaatttttaaaaaattatttttgtagagaggagggcttgctatgttgccaagtctgtctcgaattcctgggctcaagtgatacctccctacctagcctccccaaatgctgggattataggcatgcgccactgcgctgggcctc

SEQ ID NO: 63058 - DNA, 601 bp, Human
tggatttagcaacatggggttatttgggagcttgacaacagtagttttggtgaaatggcaggggtgaaagcctgactggagtaggtttaagagagaaggggaggaaaggaattggaggtagaggatagagataacactttcaagaattttgctgcaaaggagagcagaaaaataaggtgaggtcagttctagccttgtccacccaccttaaaagtcacattcccacgtgtctccactcctcccatcctctttccccttttccccaatccatcttttcttttcttttctttttttttttttttgagacagtatcttgctctgtcgcccaggctggagtgcagtggtgcaatcacagcgcactgcagcctcgacctctccggctcaagtgatcttcctgcctcagcctcctaagtagctgggaccacaggcatgagctaccatgtccagctaatttttaaaaaattatttttgtagagaggagggcttgctatgttgccaagtctgtctcgaattcctgggctcaagtgatacctccctacctagcctccccaaatgctgggattataggcatgcgccactgcgctgggcctcctagtccact

SEQ ID NO: 63059 - DNA, 601 bp, Human
cccccgccctcgccgccagacattcccataaacccgccctctcctgctaagccccgcccccaggctgcataagcccgcccataaccttcagataagcctacctcagttccccctactccatttgaccccgcctctcagttgtcgctgtagctcgcggactatccccatcggtcacacctaaccaccccccgggttatgcaccagtgcccagcttcgcccctcgctctagccaagctccacctttccaggcgggatttgtgcttcccagataagccccgcccactccaccggctagggtccrccccgagacccaagccccgcccccggccgcgtcccctccggtcccaggccctgcttcccagctgcgccccgtccccaggtgcagtccatcgagcacaagctggacctgctgttgggcttctattcgcgctgcctgcgctctggcacctcggccagcctgggcgccgtgcaagtgccgctgttcgaccccgacatcacctccgactaccacagccctgtggaccacgaggacatctccgtctccgcacagacgctcagcatctcccgctcggtcagcaccaacatggactgagggacttct

SEQ ID NO: 63060 - DNA, 601 bp, Human
aagtcatatctacaaaacaggagccgcctggatccgcccactacccccaggacttgtctcaccttcctctgatggccatggtactgaaagcgtctgctctcatcgtccccctttatagtctaaacatgttttctgtctgcttccaccgtcactgaattactcatttatttgttaatgtttcatctctccaactggactgccagaaagttgagatatgggcccaaatctgattaatgtttgcagtccccaagcacagtagctgtcatgtaagtcagtagcccataaggatgaatgaatgagyctcccgcctgatctttatgtacactggcatatgtattgccaggcactgagactgcaagaatctaaagagagaaactaaagaacgtaaagagagatgttaaactcttagagtaaaattgggacaaatcaaatgtaattggatgagatgaatcttttgtagaagtaactcactcggtggcagaggaatttctaggatcatccaaaacttagggagaccagggtatagtctcagtaaggtatatgtctggttagaacatatctaaaatgtacctaagactgattttcatgtgtcaataaggaa

SEQ ID NO: 63061 - DNA, 601 bp, Human
gtggtgagcctgtcacggtctcctcacctcttgtcgatgctgttttcacctgcatcttgactctgctgcccttatatcttatttctcctttccctgccaccgtggcactgctttttggatttaatctcatctcccctctctttgagtcctctgcccgtcatgtgcttcagactggtttcttatctgatgtccctctcccccagtatttacagtctctcttcattgcatgcctgggagagatttctgacaaggagcaagttgttgttaaattatagaagagaactactttttttttttttttgaggtagtcttattctgtcgcgcacgctggagtgcagtggcatgatcccagctcactgcaacctctgtctcctgggttcaagcgattctcctgcctcagtctcctgagtaactgggactacaggcgtgcgccatcacagccggctaatttttgtatttttagtagagatgcggtttccccatattggccaggctggtctcgaactcctgacctcaagtgatcctcctggctctgcctcccaaagtgctgggattacaggcatgagccaccatgcccagccagagaactacttttaattaa

SEQ ID NO: 63062 - DNA, 601 bp, Human
taaattatagaagagaactactttttttttttttttgaggtagtcttattctgtcgcgcacgctggagtgcagtggcatgatcccagctcactgcaacctctgtctcctgggttcaagcgattctcctgcctcagtctcctgagtaactgggactacaggcgtgcgccatcacagccggctaatttttgtatttttagtagagatgcggtttccccatattggccaggctggtctcgaactcctgacctcaagtgatcctcctggctctgcctcccaaagtgctgggattacaggcatgarccaccatgcccagccagagaactacttttaattaaaggaattttggtttagctgcaaccacttttaaatgttgatgttctttccttttagtctatcttttgtaacctagaggagctgtgttttcttgatgatatgttgtagtttagccaaagacattatttatttcctggagaactggagtacttatccaagtttgaatttttttcccatgtagggaaaataatgaggcacctgcctggtatcccagtgtctggcagtgatgtcagcaaacatttggggtgtagtgttctatcagccagc

SEQ ID NO: 63063 - DNA, 601 bp, Human
aaaggaatcattgccagcagtgtgggcacaatactcaagtcatgtggtttacatgtaacttcaatcaaaattgacccctacattaacattgatgcaggaacattctctccttatgagcatggtaagcacagtggatttcttcataataattgcatgtggcagaacatgtcagcacttgggaattatgtgcacggtttgcataacttttattttctgccttctaacaggtcccttaatacagcagaatgatacttttctcacctagaaaggaagaagcagaattctttttttttttttttttctttgagacaggatcccactctgtccctcaggctggagtgtagtggtgtgatcatggctcgctgcagcttccacctccttggctcaagcgatcctctcacctcagcctcctgagtagctgggactacaggtgtaaatcaccatgcctggctaatttctaaattttttgtacaggtggggttccactgtgttgtccaggctggtcttgggtcctcccacctgtaatcccaaagtgctgggttttataggtgtgagccaccatgcccgactgccttttacttctttgttgttattgagaacc

SEQ ID NO: 63064 - DNA, 601 bp, Human
aaggaagaagcagaattctttttttttttttttttctttgagacaggatcccactctgtccctcaggctggagtgtagtggtgtgatcatggctcgctgcagcttccacctccttggctcaagcgatcctctcacctcagcctcctgagtagctgggactacaggtgtaaatcaccatgcctggctaatttctaaattttttgtacaggtggggttccactgtgttgtccaggctggtcttgggtcctcccacctgtaatcccaaagtgctgggttttataggtgtgagccaccatgcccractgccttttacttctttgttgttattgagaacctgtcaatggtgtgacatacaactgtggctgttacttcaaagattaattgcttaaaactgggagagatgttaaaacatacctcttaagttttaaaattctgcattcgtactcctactctctagcgttgaggtgaaaatatgcaagcattaaatgtcactagtgcagaaatcctcgtaacaaatggcaacaggaaaagatccatatacctgagtgatatttaatacagaattcttgagcagaggatgagttacctctctgagggagaa

SEQ ID NO: 63065 - DNA, 601 bp, Human
tgagccaccatgcccgactgccttttacttctttgttgttattgagaacctgtcaatggtgtgacatacaactgtggctgttacttcaaagattaattgcttaaaactgggagagatgttaaaacatacctcttaagttttaaaattctgcattcgtactcctactctctagcgttgaggtgaaaatatgcaagcattaaatgtcactagtgcagaaatcctcgtaacaaatggcaacaggaaaagatccatatacctgagtgatatttaatacagaattcttgagcagaggatgagttayctctctgagggagaaaatgagactttttttcctttcctgtgtttgagcttgtctcctattgtgatggtaggaatgaatcattctgggcaaaatttctagagtgaagtttcatggaatgaatgtgcaacaaaagaatggggtaaatatgtgcagtttcacaaagttgtttagaacaaaagcagagctcggaagctgatttttataatcagcacaagcttaatatgcatatatccaggttttgaatcaaatattgttatcatactttaaaccatattatgctcaattaggagacgtttctga

SEQ ID NO: 63066 - DNA, 601 bp, Human
ccttgacctcctgggctcaagcagttctcctaccttagcctcccaagtagctgggactacagtgcgcaccaccatgcccggctagtttttgtacttttttgggagaggcagggtttcgtcattttgcccaggatggtctctaactcctgaactcaagccatctgcctgccttggcctcccaaagtgttaggattacagatgtgagccaccgtgcccagccaactgatgctttttcagtacaaaaattatttatggttaactaaggagataagatttaggtttttcttttttttttttttttactttgtcactgtgatagagataacattcctggcacctctctcatctgacctttttcttgaaatgatgtggaaagttccataataacctttgggaaggatgagcctgtccaaaagaataaccttttagtacaaagagttgtctaattcctgttaactgttaactaacattatacagggttagagagtccgtgttacataattactgatactgaatcaggaagacagaacagttgttagaaaactaaactgccagagaagggtttagtgcctaacctctgaaacaactttgttcttctagc

SEQ ID NO: 63067 - DNA, 601 bp, Human
tttaaagacaaatcttgtggagaggagtcaatagtaacaaaaattgggaagccggaaagcagatggatgcatagaaccgactaagctgaccttgagtgccggatcttaagcccgcagcagtgaaagcagagaagcagccctgtttgccctgcagaaccccaaaagctcaggagtgggatgagggtgggcctcatgtaactactgcttcagaagactcagaccctgacatctttttcctacagtgcacagttgggcgttagcctcctcccaccttggcagaagactggaggcttgttctctrgggagggttcctggatgagcagacagtagggacagttgagggcagtaacactggactacaaacatggggttatgtgtaatgttaacgctgttgacagtccttgccttcttccaccatttggttcccagaatcatcatgtttaggcttggccattccacgtaggaggttgtaagattgtcttctggggtatggatagcccaggataaaagacactggctctggcggctccccatgaaataagccagccagattttcaccatgacaagcctacacactcacacataacttataggtagcatt

SEQ ID NO: 63068 - DNA, 601 bp, Human
gccacatgaacctacccccccgtatttggaaatcaagtttatggaaatacagctgtgtctgcttgtttatgtgctgtctgtggctgcttttgctctagaacagtagagttgaatacttgtggcagagactgtgtggcccacaaaacctaaaatacttactatcagggcctttacagaaaaaattttctgaccccttatctgaacaattcaaggaaatttctagacatcagtttctgggttgaaagggcccccttggtgcctatcatattggatgacagatgacctacaccaaggcatattrttgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgtctcgatttaaaaaaaaagaaaaagtccaacagaaaatgatttcca

SEQ ID NO: 63069 - DNA, 601 bp, Human
gacagatgacctacaccaaggcatattgttgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgtctcgatttaaaaaaaaaraaaaagtccaacagaaaatgatttccatcctacaagtccatgtgtaacgtgtatctgttaagtgtgagagaagaataaagatgatttagtacagaaaggaaaagtgtggcacatggtttgggaacagtatttaaatacttaaaaagtatgtaaacccaaaagaggactgcaggcacaggaaagtgtctaatgggggcaggatcctcatttaacagggaaatcaatagaaaatgcctccaagtaaatgtggagaagtagcacaccagcaagatcagttaagagttgaagagcggttgtttc

SEQ ID NO: 63070 - DNA, 601 bp, Human
atttagtacagaaaggaaaagtgtggcacatggtttgggaacagtatttaaatacttaaaaagtatgtaaacccaaaagaggactgcaggcacaggaaagtgtctaatgggggcaggatcctcatttaacagggaaatcaatagaaaatgcctccaagtaaatgtggagaagtagcacaccagcaagatcagttaagagttgaagagcggttgtttctagggattggaaaggggagagtgggtgagggccgatactgcttacaagctcggttagaaccatttgattctaaaatgcatgcaygtgtaactttgacaaacataaaagctaaattacacaagtgaccaaatgatctatttccttattaaaagaggttcaaggaaaagtcatacttgaaaattccttatcagagggaaactaactttttttttttttttcttttgtgaaatagccaagttcaacaggggaacagaagactaaacctacccagaatagtgttcgggaacttagaggacttgggctttccccagatctggtaagatttcctgatagctggttgcagtgtaatcttttatgtctagttaagatcactctatcatgaca

SEQ ID NO: 63071 - DNA, 601 bp, Human
cgaatagctgggattataggcacctgccacgatgccgagctaatttttgtatttttagtagaaatggtgttttgccatgcgggccaagttggtctggaactcctgtacctcaggtgagccacccgtcttggcctcccaaagtgctaggattacaggtgtgagctaccacgcctggccttgccttttttttttaagagacaaggtcttgctgtgtcaccctgactagagtgcagtggtgctgtcacagctcactgcagcctgggcttaaacagccctcctgcctcagcctcctgagtagctrgtaccttaggcggacgctaccatgttcagctgttttattttttgtagagatgaggtcttgctatggttgcccaggctggtcttgaactctttgggctcaggcagtcttcttgcttcagtcttccaaaatgttgagattacaggcgtgagccggcaatgcccagccttacttactcttttaattggaatgtttatcttactgagttgacttgatatagtctgaatacaagtctttcatcaggtatgtgattttcacatattttctccctatctgtgccttgtcttttcattttcttctctc

SEQ ID NO: 63072 - DNA, 601 bp, Human
tttatattgccaaattttccctaatcttaatttaccaataatttttattatgaatttggttttgaatttttatcaagtctacatctactgagggaattgttttcctccttaatctgttttctatttatgtggtgaattccactgttaaatttcctaacacagtagttctcaaacttgactgcacactggaatcacttggggagctttaaaaatactgatgcctgcctcctaccccacaagatcctaattcaagtggtctggggtgcagcatgggcttttgaccttttataagctctgaatrattccaatatgcagctgagtttgagaaccactgttcctagttaagccattcataggttcgtggacatgatttttttaaagctacatttgtgatttggatcatgaattattattattattatttttaagacaggttctggctctgttgcccaggctggagtacagtgatgcgatcttggctcactgcaacctccaactcccaggctcaagtgatcctcccacctcagcctcccgagtagctgggaccatgggcacatgccaccacacccagctaattttttgggtgttttttttttttttt

SEQ ID NO: 63073 - DNA, 601 bp, Human
ggaattgttttcctccttaatctgttttctatttatgtggtgaattccactgttaaatttcctaacacagtagttctcaaacttgactgcacactggaatcacttggggagctttaaaaatactgatgcctgcctcctaccccacaagatcctaattcaagtggtctggggtgcagcatgggcttttgaccttttataagctctgaataattccaatatgcagctgagtttgagaaccactgttcctagttaagccattcataggttcgtggacatgatttttttaaagctacatttgtgrtttggatcatgaattattattattattatttttaagacaggttctggctctgttgcccaggctggagtacagtgatgcgatcttggctcactgcaacctccaactcccaggctcaagtgatcctcccacctcagcctcccgagtagctgggaccatgggcacatgccaccacacccagctaattttttgggtgtttttttttttttttgagacagagtctcactctgtcacccagactggagtgcagtggcacaatctcagctcactacagcttcaagctcccaggctcaagtgattctc

SEQ ID NO: 63074 - DNA, 601 bp, Human
cacatgcccaccatgcctggctaaattttgtatttttttgtagagacagtgttttaccatattgcccagtctggtcttgaactcctgagctcgagcaatcctcctgccatggcctcccaaagtactaggattataagcataagccaccttgcccagccatgaattttttttaaaggacttttgcatccatgttcataatagattggccactaattttctattctattcttgagtctgttttagtagtttatctagaaaattgtccttttttctgttttcaaatacataatatttttacaasgtcacgtagctagtaggaggctgtaagcctggtgagtttttgcttttatttaataacttgcttttttctaaacaggtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacaggtttgcctgcaatgaggagctgggagtgctagcctcctttactcttttgtagggctggtgaagccgactctag

SEQ ID NO: 63075 - DNA, 601 bp, Human
ggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcgtcytggtggcagcgggtgagtgtgcatatccaaagcccacacgaatggctgacagtggctggagcactcctgggtaccactccagagttctgagctgtgtttgggaatgtgtctcaccccacaccagaaagggatcacattaggacggggatgtgttgctgcctactccactacatccttttaaggctcggtgatgctgtcacattccttcagaaatcttcacttcgtgtcttagagcaatgggcaggccttatcttagttgcaagatcaatatgatggcctagaagcatttggagagggcat

SEQ ID NO: 63076 - DNA, 601 bp, Human
atttttctttacaaagcctgccatgttgatctgaaaattacttcctctttactggtctgtacacagaactcagataatagctattcccgttatattcttcccaggtgtgtttttgttgttttttgtgggggttttttgaggcagggtctcacactgttgcccaggctgtagtgcagtggtgcagtcagctcactgtaacctccaactcctgggctcaagatccccccgcctcagcctttcaaagtgctgggattataggattatgggcgtgagctcatcctggccagacgtggtttttttycccttgaaatagctattttggtctcatgatagcgtgtaccttctgagtaattgggtttttcttgacgtttatttgatagatatgatcgcttgctggagacctgctctattgcccttgtgggcaaatacacgaagttctcagactcctatgcctctgtcattaaggctctggagcattctgcactggccatcaaccacaaattggaaatcaaggtaaggagggtggcacaggtacagccaaaggatgagcagggaagcagtctgtagtctcgtaggtgctgtgtcatatctgctttctgtt

SEQ ID NO: 63077 - DNA, 601 bp, Human
ctgtcatctacaagcggtgagacctagacaacttacttaaccctctttgtgcctcagtttccacattgttaaaaagggatggtgatggtgccttcctcctagggttgttgtaagaagttcatgaatacaaagtgctgagaattatgcctggcatatggtaagcactatgtcagctgtcgttaaaccctcccttctgcctgtcccctttattccttttcttcctggcccatcagctgaagcttttcaggaagagatgaaggtcagaggtaaagttggggctcagtgctgaggttgttaaacrggccccatgtagctgtccccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaaggcaacggtctccgcctttaaggaatattgagtctc

SEQ ID NO: 63078 - DNA, 601 bp, Human
cgtccaagggcttggagatgtggagcagttggaaacactgtggatggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcasatgaagtcacaatgagatagtgacacaaaccccctagagcggctgagtgttagagaggctgtggagctcttaccttgctgccgggagtgtaaaatggcaccaccacactagaaaacagtctggtagtttcttatcaaggtagagacgtgtgatccaataagtccattcccagatactcacttgagagacttgaaaacgtccacaaaaaaagatttttattcaaatggacaaattattcgtaatagctgaaatctcgaaacaacccaaatatttatagcctgtcaatggatcaatttgtaa

SEQ ID NO: 63079 - DNA, 601 bp, Human
tttgttttgtttgagatggagtctcgctctgtcacccaggctggagtgcagtggcatgatcccagttcactgcaacctctgccttccaggttcaagcagttctcctgcctcagcctcttgggtagctgggactacaggtgcatgccaccacacccagctattttttttttttttttgtatttttagtagagatggggtttcaccatgtttgccaggctagtctcgaactcctgacctcaagtgatccacccgcctcggccttccaaagtgctgggattataggtgtgagccaccacgcccrgctcattctatatcttggtgtgtatgtttgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggagtttaatgattttgaaggaaactgttgtattttaaaacctcatatttaaa

SEQ ID NO: 63080 - DNA, 601 bp, Human
gcctcggccttccaaagtgctgggattataggtgtgagccaccacgcccagctcattctatatcttggtgtgtatgtttgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggartttaatgattttgaaggaaactgttgtattttaaaacctcatatttaaaaaatgtttaagttattaaatatattaagatgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcag

SEQ ID NO: 63081 - DNA, 601 bp, Human
tgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggagtttaatgattttgaaggaaactgttgtattttaaaacctcatatttaaaaaatgtttaagttattaaatatattaagwtgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcagtgagtagagttcactgccttgggtttccagagttcttttggtttgttttaatgaaaaagt

SEQ ID NO: 63082 - DNA, 601 bp, Human
ttaaaacctcatatttaaaaaatgtttaagttattaaatatattaagatgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcagtgagtagagttcrctgccttgggtttccagagttcttttggtttgttttaatgaaaaagtcctcttgttttcatgtgccagtagtaggtaattgacttgttaaaatattttttaattgttgaaaagactacatgccatctgatttaatccttaaaaaatgcagcttgtcaatatcattggatctgaaaagctgctctgattttgatattgtttgccatatgcatctattgatgaggctcatttaaggatttttcatccagaacatttgatgagtacccatcagtagagtctcatcagttgttttggcagctgt

SEQ ID NO: 63083 - DNA, 601 bp, Human
cttttcaatggagttttgtttgttttttccccccgactggaaggcgtgtgcttagggatgcagttggcagtggttgaattctcaagaaacgtgctgggatggcaaggtaagcgtgcattaagacactcattcaattcccgcttgtgtatttctggaggatatgaggcctgttgccgcctgggtgatcaggagctttggagaagggcaggcctgggttcctagcacctcatggtgtgccgtaagggagctgccttgcctcttgaggaacagcacggctcctccatgcaggaaggagggagcrcagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagataatgta

SEQ ID NO: 63084 - DNA, 601 bp, Human
gggagcacagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagayaatgtatgtaaatagtctctagtagtgcctggaaaatagggaaatgctcagataatatcagctcttcgcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagccca

SEQ ID NO: 63085 - DNA, 601 bp, Human
ctggaaaatagggaaatgctcagataatatcagctcttcgcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggmctccaaaatgacaggcctgttatgcaggcacttatcaggcctgctgatgtcccgttggccaaaacaagtcacgtggccaagccccgagccggcaggggaggagaacacacatgggtgtgaagactgagcatgctgcactggggccaccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtgg

SEQ ID NO: 63086 - DNA, 601 bp, Human
caccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtggccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccrccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctattgagtgaaacagttg

SEQ ID NO: 63087 - DNA, 601 bp, Human
agctacttgggaggccaagacatgagaatcacttgaattctggaggtgtaggttgcagtgagccaagattgtgccactgcactccattctgggtgacatagtgagactcttgtcttaaaacacaaacaaacaatataagaactgtcacaggcggggcgcagtggctcacgcctgtaatcccagcactttgggaggccgaggcaggcagatcacctgaggtcaggagttcgagaccagcctgaccaacatggagaaaccccgtctctactaaaaatacaaagttagctgggcatggtggtgyatacctgtaatcccagctactcgggaggctgagacaggagaatcgcttgagacctggaggtggaggttttggtgccgagatcacgccattgcactccagcctgcccacacttgttgcccacaagtgtgaaattctgtctcaaaaaaaaaaaactgtcaaagatacagtatctaattaaaaattactaggttatgccattagttttgattttcccattttgtactgattgactttccagagagttatacttaacgtaaaaaaattcacgtgtgtgtgggttgagtattttatgtcttaaaa

SEQ ID NO: 63088 - DNA, 601 bp, Human
agtcttgtttctgttacagctttctgtagtgttgtcagaaagagtcaaaagcccaagaattagtctaaactgtgttgttaagagcaggtgaccttagcagattcatagaaatagccctcaaaagacctggctgtgtggatgatgaaaagtaaagcaggaaggaggatgtctttgtgaacgcatcatcctgtgagataaagttctttacatacagcccgtttgttttgccagggaaactctatggagacgcagactacttggaagagaggcaccgccaccgatttgaggtgaggattccagsttgctggtactctggaaagatagtgagctgagagaccagcagaattatttttcatgcctcaacaggtgaatccagtctggaaaaagtgtttggaagaacaaggcttgaagtttgttggccaagatgttgaaggagagagaatggaaattgtggagttagaaggtgattattcgggcagttttatttaatggaaaacttagtaaagttttcttggcatatgggaaaatataaaaatgttatcttgttgctcctgacctaacagaattaggaagcagcactgtctcatgagggaaggggtct

SEQ ID NO: 63089 - DNA, 601 bp, Human
tctccttctccaaaatgcttggagttggtactaaagccacttcagccctctcctgaaccgcaagactcagtctacagaaatcctgggagccagggtcttgggcgggaccctggacaggaggccttcagccaggaggggacagcacaaaccgtgctgagaaagggtatcagatcactcatgctttgaggttccctttatctagattcaaatgagaaagtcattttcaaattattttagggcctatggaaacaaacatttaagcagattttgttcttttacactttgtgcataaccttcacartgaagctgtttcttttgaatctctatttcagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtga

SEQ ID NO: 63090 - DNA, 601 bp, Human
attctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattatt

SEQ ID NO: 63091 - DNA, 601 bp, Human; identical to SEQ ID NO: 39492

SEQ ID NO: 63092 - DNA, 601 bp, Human; identical to SEQ ID NO: 39491

SEQ ID NO: 63093 - DNA, 601 bp, Human; identical to SEQ ID NO: 39490

SEQ ID NO: 63094 - DNA, 601 bp, Human; identical to SEQ ID NO: 39489

SEQ ID NO: 63095 - DNA, 601 bp, Human; identical to SEQ ID NO: 39488

SEQ ID NO: 63096 - DNA, 601 bp, Human; identical to SEQ ID NO: 39487

SEQ ID NO: 63097 - DNA, 601 bp, Human; identical to SEQ ID NO: 39486

SEQ ID NO: 63098 - DNA, 601 bp, Human; identical to SEQ ID NO: 39485

SEQ ID NO: 63099 - DNA, 601 bp, Human; identical to SEQ ID NO: 39484

SEQ ID NO: 63100 - DNA, 601 bp, Human; identical to SEQ ID NO: 39483

SEQ ID NO: 63101 - DNA, 601 bp, Human; identical to SEQ ID NO: 39482

SEQ ID NO: 63102 - DNA, 601 bp, Human; identical to SEQ ID NO: 39481

SEQ ID NO: 63103 - DNA, 601 bp, Human; identical to SEQ ID NO: 39480

SEQ ID NO: 63104 - DNA, 601 bp, Human; identical to SEQ ID NO: 39479

SEQ ID NO: 63105 - DNA, 601 bp, Human; identical to SEQ ID NO: 39478

SEQ ID NO: 63106 - DNA, 601 bp, Human; identical to SEQ ID NO: 39477

SEQ ID NO: 63107 - DNA, 601 bp, Human; identical to SEQ ID NO: 39476

SEQ ID NO: 63108 - DNA, 601 bp, Human; identical to SEQ ID NO: 39475

SEQ ID NO: 63109 - DNA, 601 bp, Human; identical to SEQ ID NO: 39474

SEQ ID NO: 63110 - DNA, 601 bp, Human; identical to SEQ ID NO: 39473

SEQ ID NO: 63111 - DNA, 601 bp, Human; identical to SEQ ID NO: 39472

SEQ ID NO: 63112 - DNA, 601 bp, Human; identical to SEQ ID NO: 39471

SEQ ID NO: 63113 - DNA, 601 bp, Human; identical to SEQ ID NO: 39492

SEQ ID NO: 63114 - DNA, 601 bp, Human; identical to SEQ ID NO: 39491

SEQ ID NO: 63115 - DNA, 601 bp, Human; identical to SEQ ID NO: 39490

SEQ ID NO: 63116 - DNA, 601 bp, Human; identical to SEQ ID NO: 39489

SEQ ID NO: 63117 - DNA, 601 bp, Human; identical to SEQ ID NO: 39488

SEQ ID NO: 63118 - DNA, 601 bp, Human; identical to SEQ ID NO: 39487

SEQ ID NO: 63119 - DNA, 601 bp, Human; identical to SEQ ID NO: 39486

SEQ ID NO: 63120 - DNA, 601 bp, Human; identical to SEQ ID NO: 39485

SEQ ID NO: 63121 - DNA, 601 bp, Human; identical to SEQ ID NO: 39484

SEQ ID NO: 63122 - DNA, 601 bp, Human; identical to SEQ ID NO: 39483

SEQ ID NO: 63123 - DNA, 601 bp, Human; identical to SEQ ID NO: 39482

SEQ ID NO: 63124 - DNA, 601 bp, Human; identical to SEQ ID NO: 39481

SEQ ID NO: 63125 - DNA, 601 bp, Human; identical to SEQ ID NO: 39480

SEQ ID NO: 63126 - DNA, 601 bp, Human; identical to SEQ ID NO: 39479

SEQ ID NO: 63127 - DNA, 601 bp, Human; identical to SEQ ID NO: 39478

SEQ ID NO: 63128 - DNA, 601 bp, Human; identical to SEQ ID NO: 39477

SEQ ID NO: 63129 - DNA, 601 bp, Human; identical to SEQ ID NO: 39476

SEQ ID NO: 63130 - DNA, 601 bp, Human; identical to SEQ ID NO: 39475

SEQ ID NO: 63131 - DNA, 601 bp, Human; identical to SEQ ID NO: 39474

SEQ ID NO: 63132 - DNA, 601 bp, Human; identical to SEQ ID NO: 39473

SEQ ID NO: 63133 - DNA, 601 bp, Human; identical to SEQ ID NO: 39472

SEQ ID NO: 63134 - DNA, 601 bp, Human; identical to SEQ ID NO: 39471

SEQ ID NO: 63135 - DNA, 601 bp, Human
aaaacattataaaataacttcttaaaattaaataatgtacacgtcaaaaatatcagagcccacttgacctggtatatacagtttaataaccacatggctcttttttcctgtaggcctgggtaggtgcatagtttctaaaaagggagagaactgtcactgctgtggatggggtgccaagggaagtgcctggggtcaagtgaacagtgacacaactgcaagtcaagagcctgtgttggagtctttccccactatttcaaatagtatagaaaatagagctgagtcactcaaatagagctgagtyagtcactcagctcttggacctcagattcttattcttaaccgctagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaaggtaaatcatttcatatca

SEQ ID NO: 63136 - DNA, 601 bp, Human
ataaccacatggctcttttttcctgtaggcctgggtaggtgcatagtttctaaaaagggagagaactgtcactgctgtggatggggtgccaagggaagtgcctggggtcaagtgaacagtgacacaactgcaagtcaagagcctgtgttggagtctttccccactatttcaaatagtatagaaaatagagctgagtcactcaaatagagctgagttagtcactcagctcttggacctcagattcttattcttaaccgctagggggatggagacagaagtcacaaactcacatgccaccagscatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaaggtaaatcatttcatatcactctattttctttttcttttttgagacagagtcttgctctgttgcccaggctggagtgcaatggcacaatcttgactcactgcaa

SEQ ID NO: 63137 - DNA, 601 bp, Human
gtcaggcttagaataaaatcctcacccctaccctaggaggggtcaggtcagacccctcccacctccctgactgcatctaccaccatccactctttttttttttgaaccacagttcagccaaacaggctttcttttttttcttttactttctcttttttcttgaaacagagtctaactctgtcacccagtctggagtggagcaatcctctaatctcagccccctgagtagctgggattacaggcatgcaccaccacacctggctaatttttaaaaatctttggtagagatgggatctcactrtgttgcccgggctggtctcaaattcctaggctcaagtgatctcctgcctcagcctctcaaagtgctgggccttctgcttccctgggctttgccaggcctccctatgcattgtgatagccaaagtttgctttctacaaagtcacctccaggcagtgactgtccaccagggcactgtagagcctcccagctaatgatgaagtcactcactctcctctctttttcctttaagataatccctttccagacccgccattttggctcaccctgtaagttacagccccacttctcactgccaagtgt

SEQ ID NO: 63138 - DNA, 601 bp, Human
cctcaggtaatccacctgcctcagcctcccaaagtgctgggattacaggtgtgagccacggtgcctgacctcattttagccacttttaagggtagaattttctggctgttttcattcatgtactgatagacacttgggttgcttccatgttttagctgttgtggaaaatgctgctttgaacatgggtgggcaagtggttttcaagaccctgctttcagttttttgggttcagagtaacgaatggaattgctgagtcatatgttaattctcatttttctaattgtaatttttgggggcacarcacctctccagcagcggcagcactcgacctttccccagcggtgcacggggttccaacttctccgcatcctcacctacgtgtgttttgttttttggtagtagtagccattctaatgcgtgtgatatgggatctcattgtggttttgatttgcatttccctaatgattagtgatgctaagcatcttttcatggcttactgaccattcatacatctttggagaaaagcctacacaagccttctgcccatttttgcattgagttgtttgctttgttgttgttaagttttatctgagctgttttt

SEQ ID NO: 63139 - DNA, 601 bp, Human
tttgttgatgaggaggttgaggcacagaggggtggagggatgtgctgcagggcccacagctacaatgggcagagctggaaattgcaccaagtctgtctgatgcgggggtctcctctgctcctctggcctccgctgcatccctggagaatctctgagacttctggttagagcctgggtctaagccaactcccattattttcaagtgaggggaagggccgacaactgccagtgctggcccaccagagtctggcaccagccgaggagtgcacgcacccattggtggtgtggcggttcactgatyccccagccttctgctcgatctacggggaaaactggggaaggcaggaaggccaaggaggctcaactcctgcttcctaccgtggctcatttcctgggtcctttgctgtatgactgtctggatggaaggttcagagtcctctcaaaaaaggaaaaaagtatgggttttgacatcctgcgtggcttgtcctctgaggcctaaatctccagaagattcctggcctctcttgagaggtctttctctgatgtgtttgcgtgtctgtcaggaagcagcagtgatgcctagatgtggtacattcgacct

SEQ ID NO: 63140 - DNA, 601 bp, Human
ctggggaaggcaggaaggccaaggaggctcaactcctgcttcctaccgtggctcatttcctgggtcctttgctgtatgactgtctggatggaaggttcagagtcctctcaaaaaaggaaaaaagtatgggttttgacatcctgcgtggcttgtcctctgaggcctaaatctccagaagattcctggcctctcttgagaggtctttctctgatgtgtttgcgtgtctgtcaggaagcagcagtgatgcctagatgtggtacattcgacctcacctatgcctctccccaccccctctgggttygttttgtcttccagattgctggactcgctgaagagagactacgcaggaaagccccagccacccatcaaatcagagagaaggaatccaccttcttacgctatggcaggtaatgattcactattgtggagtaagacttttttttttttgagatgggattttgttgtattgcccaggctggtctcaaactcctgagctcaagtgaccctcccacattgaccttccaggtgggagttagactcttaatcagaaattggatacattgttgtaaaaaatccaagccacgtggaagtgtataaatta

SEQ ID NO: 63141 - DNA, 601 bp, Human
aaagtatgggttttgacatcctgcgtggcttgtcctctgaggcctaaatctccagaagattcctggcctctcttgagaggtctttctctgatgtgtttgcgtgtctgtcaggaagcagcagtgatgcctagatgtggtacattcgacctcacctatgcctctccccaccccctctgggttcgttttgtcttccagattgctggactcgctgaagagagactacgcaggaaagccccagccacccatcaaatcagagagaaggaatccaccttcttacgctatggcaggtaatgattcactrttgtggagtaagacttttttttttttgagatgggattttgttgtattgcccaggctggtctcaaactcctgagctcaagtgaccctcccacattgaccttccaggtgggagttagactcttaatcagaaattggatacattgttgtaaaaaatccaagccacgtggaagtgtataaattatctggaattatcttgttttctatgttctcacttgtttcattgttcctttcgactccctccagaatttaggttcctcaaaagtggggccctgcctatcctgtctttgctgtgcctccaggc

SEQ ID NO: 63142 - DNA, 601 bp, Human
ttcgttttgtcttccagattgctggactcgctgaagagagactacgcaggaaagccccagccacccatcaaatcagagagaaggaatccaccttcttacgctatggcaggtaatgattcactattgtggagtaagacttttttttttttgagatgggattttgttgtattgcccaggctggtctcaaactcctgagctcaagtgaccctcccacattgaccttccaggtgggagttagactcttaatcagaaattggatacattgttgtaaaaaatccaagccacgtggaagtgtataaaytatctggaattatcttgttttctatgttctcacttgtttcattgttcctttcgactccctccagaatttaggttcctcaaaagtggggccctgcctatcctgtctttgctgtgcctccaggccctgaaattctccctgggctgtagcaggggctcaagtgaatgaaccccaggaggcatcttgggtaaaaattcagtacgattctatctttgcttttgcaactgcttatcatgcacatatacatgaacatgcaatctctcaactttttaatttcacctaacgatataacatggagagcct

SEQ ID NO: 63143 - DNA, 601 bp, Human
gtagcaggggctcaagtgaatgaaccccaggaggcatcttgggtaaaaattcagtacgattctatctttgcttttgcaactgcttatcatgcacatatacatgaacatgcaatctctcaactttttaatttcacctaacgatataacatggagagcctttcgtgttagaacgcacaggttcaccttactctatacattatggtgtagattcggattttcgcccttggcaccactgacattctgggccagataatcctatgttttggggggtcatcctgtgcaccctgtttagcacctagcmccatccctggcctctgcccaccagatgccagtagcacccctcccccaccggctgtgacaaaccaaaatgtctccaggcattgagaaacgtcccctagcaggcacaacactgccccagttgagaaccattggtgtaggtatttcatttgcatctattctcctgttaagcccctaagtatagttcctttattgaaacaagagtctgagaaagtaaaattaaaatgttaaccatgaatctaacttatggaattcaacctttgtagccagctcaatgccctgaaacccattgcttcaaactgat

SEQ ID NO: 63144 - DNA, 601 bp, Human
tgctctgcaaacaatttgtgcagttaacacaatcatcacagggtcctgaggcaatatacatcctcctcagcttatgaagatgatgggattaagagattaaagtaaagacaagcataggaaatcacatgggtattgattggggaagtgataactgtccatgaaatcttcacaatttacgttcagagattgcagtaaagacaggcataagaaattacaaaagtattaatttggggaactaataaatgtccacgaaatcttcacaatttatattcttctgccatggcctcagccagttgctccrttcggggtccctgacttcccacgaaacacacctgtagtcccagctagtcaggagactgaggcatgagaatcacttgaacctgggaggcagaggttgcagtgagctgagatcatgccactgcattccagcctgggtgacagagtgagactgtctaaaaagaagagagagaaagagacagaaagaaaagaaaatttgatatttcttagcttcaattactatgatgcacctgaacattcaattttcatcttagtcttcattgaatttaacagagagaggttgttcttcaagaggaactgtttc

SEQ ID NO: 63145 - DNA, 601 bp, Human
gaaatcttcacaatttacgttcagagattgcagtaaagacaggcataagaaattacaaaagtattaatttggggaactaataaatgtccacgaaatcttcacaatttatattcttctgccatggcctcagccagttgctccattcggggtccctgacttcccacgaaacacacctgtagtcccagctagtcaggagactgaggcatgagaatcacttgaacctgggaggcagaggttgcagtgagctgagatcatgccactgcattccagcctgggtgacagagtgagactgtctaaaaaraagagagagaaagagacagaaagaaaagaaaatttgatatttcttagcttcaattactatgatgcacctgaacattcaattttcatcttagtcttcattgaatttaacagagagaggttgttcttcaagaggaactgtttcttatcctgatttaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggc

SEQ ID NO: 63146 - DNA, 601 bp, Human
agttgctccattcggggtccctgacttcccacgaaacacacctgtagtcccagctagtcaggagactgaggcatgagaatcacttgaacctgggaggcagaggttgcagtgagctgagatcatgccactgcattccagcctgggtgacagagtgagactgtctaaaaagaagagagagaaagagacagaaagaaaagaaaatttgatatttcttagcttcaattactatgatgcacctgaacattcaattttcatcttagtcttcattgaatttaacagagagaggttgttcttcaagagsaactgtttcttatcctgatttaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtgagtcatgggataaatgctctatttataaaaactatctttatgttttttactttaaaaaatgttgacttccagctgcaaaatggcattatagaagcaagctagcttcact

SEQ ID NO: 63147 - DNA, 601 bp, Human
gcccagccaccttcctgtatttgttcacaaggaggtgatgccactgcagagtgaactggcccagcaaaatgccctccaggagtgctgactcatcaggccacttcccgccactgcaaggaagatgtgcaggcatggctgtggctgtgtaaacctggcagcagagtacgcacatgagctttgagggaattgttgggtgacagaaattcctgtccaactagaaggaaaggggaatctattataagggctctggtcacttgggcctcctggatcccaaggacagagctgtagctgctctcgtccwcagattcccatctgctcctttctgcctcttggctctgttctctctcactgcttgccagggactggatcccctagatccagaatttccaaccaagggatctgattggttcagatcatttctgttttccaaccctgcttgaggatgcggagtgggcaggagaacgagagcactgttcgcatgagtccgccatgtgagggcaaggcagggggtgagcggcatgtgaccactttccagacaaaaccacctttccagaatgatgaggttcccaagccttcataaaagcaacctgcatgtgcggga

SEQ ID NO: 63148 - DNA, 601 bp, Human
tgcttgccagggactggatcccctagatccagaatttccaaccaagggatctgattggttcagatcatttctgttttccaaccctgcttgaggatgcggagtgggcaggagaacgagagcactgttcgcatgagtccgccatgtgagggcaaggcagggggtgagcggcatgtgaccactttccagacaaaaccacctttccagaatgatgaggttcccaagccttcataaaagcaacctgcatgtgcgggaagagggctgcctcatccctgcccaggcttgcctctgcacaccccttccygacaccagccctttctttactcagtgaccttgagctgctaatctgaccaaagtgcaggacgtcctttgtcctaattacaggtgggtggactcatagtcctcaggcctaggtgaccatgtggtttaccatctccgtcttaataccatgccagtatgacgggcctgtatcctggggtgcgtggtcccagcagagccacgctgagctctctgctctgcttctcctgtcccccttgggtcggccggccacgtggagcccgctttcctcctcgcacccactccactcccataacccggtggctgg

SEQ ID NO: 63149 - DNA, 601 bp, Human
attggcttccacctttggtaacagatgattgcctatgtttatttcccttcccaggcggtaacactggatgtaatgttagggcatctatgggatagggagatcttagcgctggtctaaggaatacaaacatgactttagttggtgtctaaatccatagatgctcagcaccgaactcagtctgacttccagatgctaacaacacaccccaggcaggcgaaggggcatgcttttccatactcttccttttgactggcttgatcacagactgctgctccaaagctggtgttacgcacagctcctygtcccctccctgcctgcccagggccagcatcaggggctgtcatcactgggggatgcagagctacctgtaacagcaacaaggaccattgtcaactccgttcccgtctgacacccacactgcacctttcagagctgaccataagggttaccctcacctgcccagctgccagggaagaggagggctgtgggcttcattccgaatcaccagataaactaaactaggaaacctgaggcgagccgcagcctcagtttctctttggtgttgccgcccacagttcccgctgtactggttcagcgtgcc

SEQ ID NO: 63150 - DNA, 601 bp, Human
gtcccctccctgcctgcccagggccagcatcaggggctgtcatcactgggggatgcagagctacctgtaacagcaacaaggaccattgtcaactccgttcccgtctgacacccacactgcacctttcagagctgaccataagggttaccctcacctgcccagctgccagggaagaggagggctgtgggcttcattccgaatcaccagataaactaaactaggaaacctgaggcgagccgcagcctcagtttctctttggtgttgccgcccacagttcccgctgtactggttcagcgtgccrgccatcctgaagggctggatggatagggtgctgtgccagggctttgcctttgacatcccaggattctacgattccggtttgctccaggtatgtgctcttggataaggatcactatggatagttggagggaggggacagaggatgcgtcttctatcaagttatatttctagtttccttccttttcttagcaaatatcgattgagcacccactatgtacaaagcaccatgtgctgcacacgggtggacacagcatcgtttctgaaatcatggagctttttgtctggtggggctgcgaacaca

SEQ ID NO: 63151 - DNA, 601 bp, Human
ggatggatagggtgctgtgccagggctttgcctttgacatcccaggattctacgattccggtttgctccaggtatgtgctcttggataaggatcactatggatagttggagggaggggacagaggatgcgtcttctatcaagttatatttctagtttccttccttttcttagcaaatatcgattgagcacccactatgtacaaagcaccatgtgctgcacacgggtggacacagcatcgtttctgaaatcatggagctttttgtctggtggggctgcgaacacatccacagcatactacaygcatggcaaacaagggagtgggtcaggtgtcaggtgacgggggacctgggcaaccttatgtgggcaacccggtggccagccctggctccagagagagtatctccctggtgcagagcccagccctggcctggcacaagttcacccccttgagcatcatgtgcctgctgtgagaaaagaccatgcgacacccacgtggcaggatgaggagggcatggaatctggtagatgtgccacatgtggtagctatgaattcttactaaaacaatgatttttaaggctgggtgcagtggctcacgcctg

SEQ ID NO: 63152 - DNA, 601 bp, Human
ggctttgcctttgacatcccaggattctacgattccggtttgctccaggtatgtgctcttggataaggatcactatggatagttggagggaggggacagaggatgcgtcttctatcaagttatatttctagtttccttccttttcttagcaaatatcgattgagcacccactatgtacaaagcaccatgtgctgcacacgggtggacacagcatcgtttctgaaatcatggagctttttgtctggtggggctgcgaacacatccacagcatactacacgcatggcaaacaagggagtgggycaggtgtcaggtgacgggggacctgggcaaccttatgtgggcaacccggtggccagccctggctccagagagagtatctccctggtgcagagcccagccctggcctggcacaagttcacccccttgagcatcatgtgcctgctgtgagaaaagaccatgcgacacccacgtggcaggatgaggagggcatggaatctggtagatgtgccacatgtggtagctatgaattcttactaaaacaatgatttttaaggctgggtgcagtggctcacgcctgtaatcccagcaatttgggaggcc

SEQ ID NO: 63153 - DNA, 601 bp, Human
acacatccacagcatactacacgcatggcaaacaagggagtgggtcaggtgtcaggtgacgggggacctgggcaaccttatgtgggcaacccggtggccagccctggctccagagagagtatctccctggtgcagagcccagccctggcctggcacaagttcacccccttgagcatcatgtgcctgctgtgagaaaagaccatgcgacacccacgtggcaggatgaggagggcatggaatctggtagatgtgccacatgtggtagctatgaattcttactaaaacaatgatttttaaggcygggtgcagtggctcacgcctgtaatcccagcaatttgggaggccgaggagggtggatcacttgaggccaggagttcaagaccagcctggccgacatggtgaaaccccatctctactaaaaatacaaaaattagccgggcatggtggtaggcgcctgtagtcccagctacttgggaggccgaggcaggagactggtttgaacctgggaggtggaggttgcagtgagccaaaatcgcaccattgcattccagcctgggtgacaaagcgagactctgtctcaaaaaaaaaaaaaaaaaaaagg

SEQ ID NO: 63154 - DNA, 601 bp, Human
gctgggtgcagtggctcacgcctgtaatcccagcaatttgggaggccgaggagggtggatcacttgaggccaggagttcaagaccagcctggccgacatggtgaaaccccatctctactaaaaatacaaaaattagccgggcatggtggtaggcgcctgtagtcccagctacttgggaggccgaggcaggagactggtttgaacctgggaggtggaggttgcagtgagccaaaatcgcaccattgcattccagcctgggtgacaaagcgagactctgtctcaaaaaaaaaaaaaaaaaaaaggaacgatttttaaattctaaaagcttcagaaaataaatgcacgtaagggaaacatactgagtaaccaagatgtgtcttggaccatgaatggtgctaccacttactgagcagccctgtgtgctgggaaccttgtcctgtggtcagtgcctcggccgtatccatcacacatggtgtcatggaaaccaggtttccaccagcaacctgggcatgttagagcttctgtgtctgcttggtccattcacttggattgtctcctcctcctcttgggatgtcattgtcacctatggatgggagtgttg

SEQ ID NO: 63155 - DNA, 601 bp, Human
aggagggtggatcacttgaggccaggagttcaagaccagcctggccgacatggtgaaaccccatctctactaaaaatacaaaaattagccgggcatggtggtaggcgcctgtagtcccagctacttgggaggccgaggcaggagactggtttgaacctgggaggtggaggttgcagtgagccaaaatcgcaccattgcattccagcctgggtgacaaagcgagactctgtctcaaaaaaaaaaaaaaaaaaaaggaacgatttttaaattctaaaagcttcagaaaataaatgcacgtaarggaaacatactgagtaaccaagatgtgtcttggaccatgaatggtgctaccacttactgagcagccctgtgtgctgggaaccttgtcctgtggtcagtgcctcggccgtatccatcacacatggtgtcatggaaaccaggtttccaccagcaacctgggcatgttagagcttctgtgtctgcttggtccattcacttggattgtctcctcctcctcttgggatgtcattgtcacctatggatgggagtgttgcatttgtccatccctggagggtgtccacacgcatgttccctgctggct

SEQ ID NO: 63156 - DNA, 601 bp, Human
cacacgcatgttccctgctggctgtgctgagcccgtgtgctggaggctcagcaacatttctgtcctcttctggagtccacacaaatgcatctgctttctcccttgcagggtaaactagcgctcctttccgtaaccacgggaggcacggccgagatgtacacgaagacaggagtcaatggagattctcgatacttcctgtggccactccaggtagaccagctgcgagtggctcccttgcttgttggcacacgcacacacagacacacacatgcacacatgcatacacacacacacgcacacrcatacatgccctcagctccccgaggggtgagatgagatgggatggaagcgtgatgccccacaccattttgactcccctggatacaagaaaattataacattttgccccttttaaatgctttacttgacagatttgaaaagcttgaccaatagggaaaacatgccctaattatagcttttgatatggtttgggcagaagctaagccaaacctgcttagcttggtcagcagaatggccccaaggtggccctgcgtgtgttgtgatacgtgcgggtggaggccatccatatggctctggcagt

SEQ ID NO: 63157 - DNA, 601 bp, Human
tcgatacttcctgtggccactccaggtagaccagctgcgagtggctcccttgcttgttggcacacgcacacacagacacacacatgcacacatgcatacacacacacacgcacacacatacatgccctcagctccccgaggggtgagatgagatgggatggaagcgtgatgccccacaccattttgactcccctggatacaagaaaattataacattttgccccttttaaatgctttacttgacagatttgaaaagcttgaccaatagggaaaacatgccctaattatagcttttgatatrgtttgggcagaagctaagccaaacctgcttagcttggtcagcagaatggccccaaggtggccctgcgtgtgttgtgatacgtgcgggtggaggccatccatatggctctggcagtgcttggtgagggcagcactgcccttggaccctggcaagtggcaccccaggccctgcattctgatggccgcatgctggtctctgctggccatgccaacccccacaggggcaaggggcctatggagccagcacacacccacctcccagtccgcaggcccctcccaggcctgcttccccaggggacct

SEQ ID NO: 63158 - DNA, 601 bp, Human
gcacacatgcatacacacacacacgcacacacatacatgccctcagctccccgaggggtgagatgagatgggatggaagcgtgatgccccacaccattttgactcccctggatacaagaaaattataacattttgccccttttaaatgctttacttgacagatttgaaaagcttgaccaatagggaaaacatgccctaattatagcttttgatatggtttgggcagaagctaagccaaacctgcttagcttggtcagcagaatggccccaaggtggccctgcgtgtgttgtgatacgtgckggtggaggccatccatatggctctggcagtgcttggtgagggcagcactgcccttggaccctggcaagtggcaccccaggccctgcattctgatggccgcatgctggtctctgctggccatgccaacccccacaggggcaaggggcctatggagccagcacacacccacctcccagtccgcaggcccctcccaggcctgcttccccaggggacctcttggtgcctgcgtgagtgtccctgggcctgaaatgtggccgagtagtggccacctgccaaagggaaggtggtgggcagagcagt

SEQ ID NO: 63159 - DNA, 601 bp, Human
tgcccttggaccctggcaagtggcaccccaggccctgcattctgatggccgcatgctggtctctgctggccatgccaacccccacaggggcaaggggcctatggagccagcacacacccacctcccagtccgcaggcccctcccaggcctgcttccccaggggacctcttggtgcctgcgtgagtgtccctgggcctgaaatgtggccgagtagtggccacctgccaaagggaaggtggtgggcagagcagttccaacgtgctggggtgtcccacgaaggaacccctggtgaggggtggcrgagggagggagtggggagcagactccaggtcaggggctccagggaacccagaaacctaggggtcaactgttcttccaggttgtttaagggaggtttgtcgagacagggggagagctcgttcttgaggggtagggagtttgctgggaaaatgcacgcgtcaccccttttctgtgaactctctctaggtgcacgtgccttgcccatgtcctattggtttggtattttttaattttctatttgtcagtgctcttcatatatcagagaaattaatcctattatgtcctttcaaaacacaatgat

SEQ ID NO: 63160 - DNA, 601 bp, Human
gagcagttccaacgtgctggggtgtcccacgaaggaacccctggtgaggggtggcagagggagggagtggggagcagactccaggtcaggggctccagggaacccagaaacctaggggtcaactgttcttccaggttgtttaagggaggtttgtcgagacagggggagagctcgttcttgaggggtagggagtttgctgggaaaatgcacgcgtcaccccttttctgtgaactctctctaggtgcacgtgccttgcccatgtcctattggtttggtattttttaattttctatttgtcagygctcttcatatatcagagaaattaatcctattatgtcctttcaaaacacaatgatttttccttctacaggcagtgcacattgactaagttcattccttgcttttgttgttgtttgctattataaataggattttgtcttcaattatatcttctaaaagttcttttgattggtgaaagctattgattgctgaatattggtttttgaccccgaccatttgctgttttctcctcctaatcataattttttcttagttggtttccagtaataaagtcatgttgtctgaagctgggtgcggtggc

SEQ ID NO: 63161 - DNA, 601 bp, Human
tcctaatcataattttttcttagttggtttccagtaataaagtcatgttgtctgaagctgggtgcggtggctcacgcctgtaattccagcactctgggaggctgaggcagtggatcacctgaggtcaggagtttgagaccagcctggccaacatggcgaaaccccatctctactaaaacacaaaaattagccgagtgtggtggcggacacctgtagtcccagctacttgggaggctgaggcagcagaatcgcttgaacctgagagacggaggttgcagtgagccaggattgcaccactgcrctccagcctgggcaacagaatgagaatccacctcaaaaacaagcaaacaaacaaacaaataaataaaatgatgttgcctgaggaaaaaaatgtggatagtggtgtgtgggcctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttataaacctgaccttgcttcttcac

SEQ ID NO: 63162 - DNA, 601 bp, Human
ctcacgcctgtaattccagcactctgggaggctgaggcagtggatcacctgaggtcaggagtttgagaccagcctggccaacatggcgaaaccccatctctactaaaacacaaaaattagccgagtgtggtggcggacacctgtagtcccagctacttgggaggctgaggcagcagaatcgcttgaacctgagagacggaggttgcagtgagccaggattgcaccactgcactccagcctgggcaacagaatgagaatccacctcaaaaacaagcaaacaaacaaacaaataaataaaatsatgttgcctgaggaaaaaaatgtggatagtggtgtgtgggcctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttataaacctgaccttgcttcttcacaggccaactggtctcttatgtgtcattagccaagttcaaattcttcttgcttttaaaaaaatcttttttt

SEQ ID NO: 63163 - DNA, 601 bp, Human
cagtggatcacctgaggtcaggagtttgagaccagcctggccaacatggcgaaaccccatctctactaaaacacaaaaattagccgagtgtggtggcggacacctgtagtcccagctacttgggaggctgaggcagcagaatcgcttgaacctgagagacggaggttgcagtgagccaggattgcaccactgcactccagcctgggcaacagaatgagaatccacctcaaaaacaagcaaacaaacaaacaaataaataaaatgatgttgcctgaggaaaaaaatgtggatagtggtgtgwgggcctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttataaacctgaccttgcttcttcacaggccaactggtctcttatgtgtcattagccaagttcaaattcttcttgcttttaaaaaaatctttttttttttcagtttgcagaagtacatattatggccaaaaaa

SEQ ID NO: 63164 - DNA, 601 bp, Human
tgagccaggattgcaccactgcactccagcctgggcaacagaatgagaatccacctcaaaaacaagcaaacaaacaaacaaataaataaaatgatgttgcctgaggaaaaaaatgtggatagtggtgtgtgggcctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttakaaacctgaccttgcttcttcacaggccaactggtctcttatgtgtcattagccaagttcaaattcttcttgcttttaaaaaaatctttttttttttcagtttgcagaagtacatattatggccaaaaaaaaaagagacaatatgaaatataaaaagagaaaatccctttaatccctcccacctcagaaagaatcactttaaatggtttgatttattttcttagggcctatatattttctcacatacataatttttattataggtttattacatttactgctcttttacatgaatggtata

SEQ ID NO: 63165 - DNA, 601 bp, Human
aaatgtggatagtggtgtgtgggcctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttataaacctgaccttgcttcttcacaggccaactggtctcttatgtgtcattagccaagttcaaattcttcttgcttttaaaaaaatctttttttttttcagtttgcagaagyacatattatggccaaaaaaaaaagagacaatatgaaatataaaaagagaaaatccctttaatccctcccacctcagaaagaatcactttaaatggtttgatttattttcttagggcctatatattttctcacatacataatttttattataggtttattacatttactgctcttttacatgaatggtatatcataaatacggcttaaaatttgtttgttattttcatttaacagatatcttgaacaaacttccatggtatatattatagctagaataacctcattctggaataatctata

SEQ ID NO: 63166 - DNA, 601 bp, Human
cctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttataaacctgaccttgcttcttcacaggccaactggtctcttatgtgtcattagccaagttcaaattcttcttgcttttaaaaaaatctttttttttttcagtttgcagaagtacatattatggccaaaaaaaaargagacaatatgaaatataaaaagagaaaatccctttaatccctcccacctcagaaagaatcactttaaatggtttgatttattttcttagggcctatatattttctcacatacataatttttattataggtttattacatttactgctcttttacatgaatggtatatcataaatacggcttaaaatttgtttgttattttcatttaacagatatcttgaacaaacttccatggtatatattatagctagaataacctcattctggaataatctatagtgtgaatgtaccataatttgcc

SEQ ID NO: 63167 - DNA, 601 bp, Human; identical to SEQ ID NO: 29738

SEQ ID NO: 63168 - DNA, 601 bp, Human; identical to SEQ ID NO: 29739

SEQ ID NO: 63169 - DNA, 601 bp, Human; identical to SEQ ID NO: 29740

SEQ ID NO: 63170 - DNA, 601 bp, Human; identical to SEQ ID NO: 29741

SEQ ID NO: 63171 - DNA, 601 bp, Human; identical to SEQ ID NO: 29742

SEQ ID NO: 63172 - DNA, 601 bp, Human; identical to SEQ ID NO: 29743

SEQ ID NO: 63173 - DNA, 601 bp, Human; identical to SEQ ID NO: 29744

SEQ ID NO: 63174 - DNA, 601 bp, Human; identical to SEQ ID NO: 29745

SEQ ID NO: 63175 - DNA, 601 bp, Human; identical to SEQ ID NO: 29746

SEQ ID NO: 63176 - DNA, 601 bp, Human; identical to SEQ ID NO: 29747

SEQ ID NO: 63177 - DNA, 601 bp, Human; identical to SEQ ID NO: 29748

SEQ ID NO: 63178 - DNA, 601 bp, Human; identical to SEQ ID NO: 29749

SEQ ID NO: 63179 - DNA, 601 bp, Human; identical to SEQ ID NO: 29750

SEQ ID NO: 63180 - DNA, 601 bp, Human
gttagccaggatggtctcaatctcctgacctcgtgatgcacccgcctcggcctcccaaagtgctgggattacaggcataagccactgcacttggccttcttcttttttttttttttttttgtttttttttttaagagacagggcttgcactgtcatccaggctggagtgcagtggtgtgatcacggctcattgcagccttgaactcctggactcaagtgatcctcccacctcagcctcccaagtagctcagacataggcacgtaccaccactcctagctaattttttgtgtatgtattttktgtagagaaagggccttgccgtgttgtccaggctggtcttgaactcctgggctcaagcaatcctcctgccttggcctcccaaagtgccgggattacaggtgtgagccactgcacccagcctctttattcatatctctaacagctgctaacgtgaatgcaattcttcccatgttgaacactccaccgcctatcccaggatgtggtctagagcatctgaacatgctcagtgcatgttgaaagagagagagggagagcaagaggtgcacagagggccatgtctctgtggatgggctggggtca

SEQ ID NO: 63181 - DNA, 601 bp, Human
tttttttttttttttttgtttttttttttaagagacagggcttgcactgtcatccaggctggagtgcagtggtgtgatcacggctcattgcagccttgaactcctggactcaagtgatcctcccacctcagcctcccaagtagctcagacataggcacgtaccaccactcctagctaattttttgtgtatgtattttgtgtagagaaagggccttgccgtgttgtccaggctggtcttgaactcctgggctcaagcaatcctcctgccttggcctcccaaagtgccgggattacaggtgtragccactgcacccagcctctttattcatatctctaacagctgctaacgtgaatgcaattcttcccatgttgaacactccaccgcctatcccaggatgtggtctagagcatctgaacatgctcagtgcatgttgaaagagagagagggagagcaagaggtgcacagagggccatgtctctgtggatgggctggggtcaccagtgcaggaccagccgcgtgttctgagcccaggcctgagggccagagccggtgggaaagtccatgtggcacagagttggcatcttaagttcgtgtcaacta

SEQ ID NO: 63182 - DNA, 601 bp, Human
taggtcaggcaagttgccatctgttccaactttcagcaccattattatttgtgttatttttaaattttttaagagaaggtctcgctctgttgcccaggctggagtgcagtggcccgatcatagctcctggcagcctcaacctccttacttcaaaggatgctcccgcctcagcctcctgaatagctaagacaacaccattattagtgtaggtatatgggcatatttgggttctccaaaaaaaaagaaccaacaagacgtatatgtgtgtatgtatatataggtagaaaaaagagattcattwtagggaattggttcatggagtatggaagctgacaagtcccaaggtctgcagagtgagttggccagctggagacccaggagagctaaaggtgtgattccagtctaagtctgaaggcctgacagccaggagaggagatggtgtggttctagtgtgaaagccaggaggcttgagacccaggaagagccaatgtttcagcctgagtccaaaggtaggaaaaagccaatatcgcagactgaaggccaaggaattccctgttctcagccttcttgttctactcaggcttttagcagattggacaag

SEQ ID NO: 63183 - DNA, 601 bp, Human
tgggttctccaaaaaaaaagaaccaacaagacgtatatgtgtgtatgtatatataggtagaaaaaagagattcattttagggaattggttcatggagtatggaagctgacaagtcccaaggtctgcagagtgagttggccagctggagacccaggagagctaaaggtgtgattccagtctaagtctgaaggcctgacagccaggagaggagatggtgtggttctagtgtgaaagccaggaggcttgagacccaggaagagccaatgtttcagcctgagtccaaaggtaggaaaaagccaayatcgcagactgaaggccaaggaattccctgttctcagccttcttgttctactcaggcttttagcagattggacaagacccaccacactggggagggcctctgcctttattcagtcagtggattcaaatgctaacccatccagaaacaccctcatgaacacactcagaaataatgtttgaccaaatatctgggcaccctgtagcccagtcaagttgacacaaagtgtacagtcacagggtgaagggctgatggatgccatctctacagaggtctgggccttgtgttgggttcaccagaggg

SEQ ID NO: 63184 - DNA, 601 bp, Human
ttcagctccatagaaaagtgaagccaggttctggtggggaggtagacgctgcaggcagccagggctgcagcttccgttctggactgcctccagcctggacgcagtggtttgccagctcctctgctactgccccaggtgacagttccccaccactggcatcccagccctcctcttcccaggtgctgctttcagctcctcccagctgctgctcaggtggaagggaaaaccatcagctccacacgctgcttgtgggctcgttacaggatttactgcacacagaattagccagtgcttatcaagytgagtcttttgtattaatatttcaaaaacagtgtggtctgaacctttccagacaaatcttacatgcaagattatattaaaacctctcttaagagaagaaacctccagttggaggtgttgtgttagccaacaaatgtagattaattgtgctcccctgagtcagtcattgtttaatatgctgcacagattaacaccttcaggaattctgcacattgtaaagtgcaatacaaatatactaataaaataacagcagacatttattaagcttaccacgtacccgcagaccctatgctgcatacgt

SEQ ID NO: 63185 - DNA, 601 bp, Human
aattagccagtgcttatcaagttgagtcttttgtattaatatttcaaaaacagtgtggtctgaacctttccagacaaatcttacatgcaagattatattaaaacctctcttaagagaagaaacctccagttggaggtgttgtgttagccaacaaatgtagattaattgtgctcccctgagtcagtcattgtttaatatgctgcacagattaacaccttcaggaattctgcacattgtaaagtgcaatacaaatatactaataaaataacagcagacatttattaagcttaccacgtacccrcagaccctatgctgcatacgttgaatctactatctcattcatcctcagaatgattctatggggtagattctattactgtccgcattttccagatgaggaattgtgactcagggagatggatgtagcctgtcagtatggactctgtgctggttagacaaaactgtcctggccccgtaaagccagtgttttcctcccacgatgatgcctccagtttacatccaaatgtcacaggaagaaagctttcctgcagtccagggcccgactaggtccccacagtcacagcagatttggaaaggcttt

SEQ ID NO: 63186 - DNA, 601 bp, Human
tattactgtccgcattttccagatgaggaattgtgactcagggagatggatgtagcctgtcagtatggactctgtgctggttagacaaaactgtcctggccccgtaaagccagtgttttcctcccacgatgatgcctccagtttacatccaaatgtcacaggaagaaagctttcctgcagtccagggcccgactaggtccccacagtcacagcagatttggaaaggctttgtcctccacacaccacttaaaagcaccaacccaagcagcccgagggtcctctagcagcccacttcaagccrccacactgcccagaaagtagcctccggggcagttttgcttctaatgcttgtgtctaatgcttgagacatggttgcttttgagaaatggagctgctcagtgagctgtcgcccccaccatccccaaatgcctggtcagccctaaccagaggagagcctggccagccagggcagcccccaacttcatcagcagcaaggagcttgtggtttgaccattacctttttgtttgtttgtttgtttgttgtgagatagagccttgctctattgcccgggctggagtgcagtggcgggatctcggctca

SEQ ID NO: 63187 - DNA, 601 bp, Human
acaggaagaaagctttcctgcagtccagggcccgactaggtccccacagtcacagcagatttggaaaggctttgtcctccacacaccacttaaaagcaccaacccaagcagcccgagggtcctctagcagcccacttcaagccgccacactgcccagaaagtagcctccggggcagttttgcttctaatgcttgtgtctaatgcttgagacatggttgcttttgagaaatggagctgctcagtgagctgtcgcccccaccatccccaaatgcctggtcagccctaaccagaggagagcctrgccagccagggcagcccccaacttcatcagcagcaaggagcttgtggtttgaccattacctttttgtttgtttgtttgtttgttgtgagatagagccttgctctattgcccgggctggagtgcagtggcgggatctcggctcactgcaacctccgcctactgggttcaagtgattctgcctcagcctcccgagtagctgggattataggcgcgcatcaccacgccggctaatttttgtgtttttggtagagatggagtttcaccacattgaccaggctggtctcgaactcctgacctcaa

SEQ ID NO: 63188 - DNA, 601 bp, Human
tgcttttgagaaatggagctgctcagtgagctgtcgcccccaccatccccaaatgcctggtcagccctaaccagaggagagcctggccagccagggcagcccccaacttcatcagcagcaaggagcttgtggtttgaccattacctttttgtttgtttgtttgtttgttgtgagatagagccttgctctattgcccgggctggagtgcagtggcgggatctcggctcactgcaacctccgcctactgggttcaagtgattctgcctcagcctcccgagtagctgggattataggcgcgcaycaccacgccggctaatttttgtgtttttggtagagatggagtttcaccacattgaccaggctggtctcgaactcctgacctcaagtgatccacctgcctcggcctcccaaaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagt

SEQ ID NO: 63189 - DNA, 601 bp, Human
gctgtcgcccccaccatccccaaatgcctggtcagccctaaccagaggagagcctggccagccagggcagcccccaacttcatcagcagcaaggagcttgtggtttgaccattacctttttgtttgtttgtttgtttgttgtgagatagagccttgctctattgcccgggctggagtgcagtggcgggatctcggctcactgcaacctccgcctactgggttcaagtgattctgcctcagcctcccgagtagctgggattataggcgcgcatcaccacgccggctaatttttgtgtttttrgtagagatggagtttcaccacattgaccaggctggtctcgaactcctgacctcaagtgatccacctgcctcggcctcccaaaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaaga

SEQ ID NO: 63190 - DNA, 601 bp, Human
aaatgcctggtcagccctaaccagaggagagcctggccagccagggcagcccccaacttcatcagcagcaaggagcttgtggtttgaccattacctttttgtttgtttgtttgtttgttgtgagatagagccttgctctattgcccgggctggagtgcagtggcgggatctcggctcactgcaacctccgcctactgggttcaagtgattctgcctcagcctcccgagtagctgggattataggcgcgcatcaccacgccggctaatttttgtgtttttggtagagatggagtttcaccayattgaccaggctggtctcgaactcctgacctcaagtgatccacctgcctcggcctcccaaaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaagatccagcggcctgctttgggtt

SEQ ID NO: 63191 - DNA, 601 bp, Human
aatgcctggtcagccctaaccagaggagagcctggccagccagggcagcccccaacttcatcagcagcaaggagcttgtggtttgaccattacctttttgtttgtttgtttgtttgttgtgagatagagccttgctctattgcccgggctggagtgcagtggcgggatctcggctcactgcaacctccgcctactgggttcaagtgattctgcctcagcctcccgagtagctgggattataggcgcgcatcaccacgccggctaatttttgtgtttttggtagagatggagtttcaccacrttgaccaggctggtctcgaactcctgacctcaagtgatccacctgcctcggcctcccaaaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaagatccagcggcctgctttgggttc

SEQ ID NO: 63192 - DNA, 601 bp, Human
atggagtttcaccacattgaccaggctggtctcgaactcctgacctcaagtgatccacctgcctcggcctcccaaaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaagatccagcrgcctgctttgggttccagtaaacacaaaagtacgtactggcactctgcggattacagactcactgacaacttcatggattcatagatcaagttttgttacattgatccaaggtgaaggcacgccacagcaggttacttgtggccttgttactgtctgtaactccttgagttacagatgaaagttcagctaaagatgaaaagggctccaggcggggcaggaaaggtagcatcgtgaggccagcatctcacctatggcattttgacctaaaagagctgtatcaacagaggtaaagtgaccca

SEQ ID NO: 63193 - DNA, 601 bp, Human
aaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaagatccagcggcctgctttgggttccagtaaacacaaaagtacgtactggcactctgcggattacagactcactgacaacttcrtggattcatagatcaagttttgttacattgatccaaggtgaaggcacgccacagcaggttacttgtggccttgttactgtctgtaactccttgagttacagatgaaagttcagctaaagatgaaaagggctccaggcggggcaggaaaggtagcatcgtgaggccagcatctcacctatggcattttgacctaaaagagctgtatcaacagaggtaaagtgacccatacatttaccttggggttagacagcttctagttccttggactatctggaaccatgtctctttctgaaggtgcca

SEQ ID NO: 63194 - DNA, 601 bp, Human
tctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaagatccagcggcctgctttgggttccagtaaacacaaaagtacgtactggcactctgcggattacagactcactgacaacttcatggattcatagatcaagttttgttacattgatccaargtgaaggcacgccacagcaggttacttgtggccttgttactgtctgtaactccttgagttacagatgaaagttcagctaaagatgaaaagggctccaggcggggcaggaaaggtagcatcgtgaggccagcatctcacctatggcattttgacctaaaagagctgtatcaacagaggtaaagtgacccatacatttaccttggggttagacagcttctagttccttggactatctggaaccatgtctctttctgaaggtgccacatgcagtgaggaacctgccctggcagaggaactcgt

SEQ ID NO: 63195 - DNA, 601 bp, Human
gctgcccagtttcacactggaagagatcctgtgcaaagatccagcggcctgctttgggttccagtaaacacaaaagtacgtactggcactctgcggattacagactcactgacaacttcatggattcatagatcaagttttgttacattgatccaaggtgaaggcacgccacagcaggttacttgtggccttgttactgtctgtaactccttgagttacagatgaaagttcagctaaagatgaaaagggctccaggcggggcaggaaaggtagcatcgtgaggccagcatctcacctatgscattttgacctaaaagagctgtatcaacagaggtaaagtgacccatacatttaccttggggttagacagcttctagttccttggactatctggaaccatgtctctttctgaaggtgccacatgcagtgaggaacctgccctggcagaggaactcgtgttcatcctctgaggccccttcgtttccaactgagccatgtgcttagcagttgggggtttcctactaatttttcggagaatgttattgtttgaaaagtgctctccacagagcatgtgattagatctttttgttacttgggtgag

SEQ ID NO: 63196 - DNA, 601 bp, Human
gcttagcagttgggggtttcctactaatttttcggagaatgttattgtttgaaaagtgctctccacagagcatgtgattagatctttttgttacttgggtgagaatctagagctcctgtcttgccttgacagctaatattcatgcccatctattgtggtcctgtttccaaagaggaacacacaacagagtttctgtgcagtgaaacctgtgtcagacctaaaggaggcaagggctgctgaggagcttgaaatgacccttaaaagatatcaaggagaagagttgtcttcatactctcttctrtctgtctgtccatctgtctattcatccattcatccatccagcattcagagcaggtctcccatattttaatgaagggaacctcatttttatttccccaagatctagagattaggaagagtgcagacagtgctgaacggctaaaaagaaacgattcacagcgaggttctccttccttccttatgggaaaccaacaaatcatagccagataggctggactgtctacagagaaagacttcacatgtggcaggctggggattccctgcctcccagtccagcttagtgcagattaggggatgcaat

SEQ ID NO: 63197 - DNA, 601 bp, Human
tcacagcgaggttctccttccttccttatgggaaaccaacaaatcatagccagataggctggactgtctacagagaaagacttcacatgtggcaggctggggattccctgcctcccagtccagcttagtgcagattaggggatgcaatttagcctatacgtgaccttctatgacctcgcagcatccttggcaattcgttctttcctgtttcctgaaaacaaaggccttgagtgtccctgcaagccctgttccttgtgtaggcaactgggatcctatctctggggtgggtgcaactcatccktcttttctgaatagtgttaaagttgaatttagaatgtcgtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcgcacctactgaggttctgagctgtcagccccccagtattgaaactcaaaaaattagggaacatgataacgcattctgccctaatat

SEQ ID NO: 63198 - DNA, 601 bp, Human
caaatcatagccagataggctggactgtctacagagaaagacttcacatgtggcaggctggggattccctgcctcccagtccagcttagtgcagattaggggatgcaatttagcctatacgtgaccttctatgacctcgcagcatccttggcaattcgttctttcctgtttcctgaaaacaaaggccttgagtgtccctgcaagccctgttccttgtgtaggcaactgggatcctatctctggggtgggtgcaactcatccttcttttctgaatagtgttaaagttgaatttagaatgtcrtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcgcacctactgaggttctgagctgtcagccccccagtattgaaactcaaaaaattagggaacatgataacgcattctgccctaatattgtccttttaatgtctaattatcattgtagacaaagtgg

SEQ ID NO: 63199 - DNA, 601 bp, Human
aaacaaaggccttgagtgtccctgcaagccctgttccttgtgtaggcaactgggatcctatctctggggtgggtgcaactcatccttcttttctgaatagtgttaaagttgaatttagaatgtcgtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcrcacctactgaggttctgagctgtcagccccccagtattgaaactcaaaaaattagggaacatgataacgcattctgccctaatattgtccttttaatgtctaattatcattgtagacaaagtggcttgaacttaggctttcatcctagaagctttaccacttttactgtttctatacttttgtagctaataagtcaaatgtagaacaaagagaaggctgcatttgttcaggaaactgtaaatctgtcccatttgatcacaatcctgttgaaaggaagaagccttacgaggacagtgtgtt

SEQ ID NO: 63200 - DNA, 601 bp, Human
aggcaactgggatcctatctctggggtgggtgcaactcatccttcttttctgaatagtgttaaagttgaatttagaatgtcgtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcgcacctactgaggttctgagctgtcagccccccagtattgaaastcaaaaaattagggaacatgataacgcattctgccctaatattgtccttttaatgtctaattatcattgtagacaaagtggcttgaacttaggctttcatcctagaagctttaccacttttactgtttctatacttttgtagctaataagtcaaatgtagaacaaagagaaggctgcatttgttcaggaaactgtaaatctgtcccatttgatcacaatcctgttgaaaggaagaagccttacgaggacagtgtgtttgctacaatgctgagccgtgacagctgcagcagcggctcctgg

SEQ ID NO: 63201 - DNA, 601 bp, Human
gcaactgggatcctatctctggggtgggtgcaactcatccttcttttctgaatagtgttaaagttgaatttagaatgtcgtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcgcacctactgaggttctgagctgtcagccccccagtattgaaactmaaaaaattagggaacatgataacgcattctgccctaatattgtccttttaatgtctaattatcattgtagacaaagtggcttgaacttaggctttcatcctagaagctttaccacttttactgtttctatacttttgtagctaataagtcaaatgtagaacaaagagaaggctgcatttgttcaggaaactgtaaatctgtcccatttgatcacaatcctgttgaaaggaagaagccttacgaggacagtgtgtttgctacaatgctgagccgtgacagctgcagcagcggctcctggag

SEQ ID NO: 63202 - DNA, 601 bp, Human
tgttaaagttgaatttagaatgtcgtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcgcacctactgaggttctgagctgtcagccccccagtattgaaactcaaaaaattagggaacatgataacgcattctgccctaatattgtccttttaatgtytaattatcattgtagacaaagtggcttgaacttaggctttcatcctagaagctttaccacttttactgtttctatacttttgtagctaataagtcaaatgtagaacaaagagaaggctgcatttgttcaggaaactgtaaatctgtcccatttgatcacaatcctgttgaaaggaagaagccttacgaggacagtgtgtttgctacaatgctgagccgtgacagctgcagcagcggctcctggagcacagggctgctggcatgggctcaccaccctcacagccatttgtctggcggcttg

SEQ ID NO: 63203 - DNA, 601 bp, Human
ccccaatgtggtggctgagttggaagaggcccagcatcttccaagcacagctccctgccccacagttcctccctcgcacctactgaggttctgagctgtcagccccccagtattgaaactcaaaaaattagggaacatgataacgcattctgccctaatattgtccttttaatgtctaattatcattgtagacaaagtggcttgaacttaggctttcatcctagaagctttaccacttttactgtttctatacttttgtagctaataagtcaaatgtagaacaaagagaaggctgcatttrttcaggaaactgtaaatctgtcccatttgatcacaatcctgttgaaaggaagaagccttacgaggacagtgtgtttgctacaatgctgagccgtgacagctgcagcagcggctcctggagcacagggctgctggcatgggctcaccaccctcacagccatttgtctggcggcttgtattcagatgtatttgttcagtaatccaaaaatggaagggtgatttggaaccttgagcagcaggctggggatggctgtgaattctgctttgcacttgcccactacatcaacacgccaagaaactc

SEQ ID NO: 63204 - DNA, 601 bp, Human
tctatacttttgtagctaataagtcaaatgtagaacaaagagaaggctgcatttgttcaggaaactgtaaatctgtcccatttgatcacaatcctgttgaaaggaagaagccttacgaggacagtgtgtttgctacaatgctgagccgtgacagctgcagcagcggctcctggagcacagggctgctggcatgggctcaccaccctcacagccatttgtctggcggcttgtattcagatgtatttgttcagtaatccaaaaatggaagggtgatttggaaccttgagcagcaggctggggrtggctgtgaattctgctttgcacttgcccactacatcaacacgccaagaaactcacctgccccatcccagtgcattctgaacatttcttatttttatcttcttaccaaccttctctcttaaaatcagcttcattaaaatggatttttctagagtaaccaccagatcacctcccccactctcagtccgttttccagtcaaaccatttgttacttgattcagttccaaatataatgtgtgtctgctactgttaagtcattgccttatagtcaacctcaagggtagtcataaactccaagagt

SEQ ID NO: 63205 - DNA, 601 bp, Human
cggctcctggagcacagggctgctggcatgggctcaccaccctcacagccatttgtctggcggcttgtattcagatgtatttgttcagtaatccaaaaatggaagggtgatttggaaccttgagcagcaggctggggatggctgtgaattctgctttgcacttgcccactacatcaacacgccaagaaactcacctgccccatcccagtgcattctgaacatttcttatttttatcttcttaccaaccttctctcttaaaatcagcttcattaaaatggatttttctagagtaaccaccaratcacctcccccactctcagtccgttttccagtcaaaccatttgttacttgattcagttccaaatataatgtgtgtctgctactgttaagtcattgccttatagtcaacctcaagggtagtcataaactccaagagtttcacgtgtctgactatattcttaggagattgatgggttacatttttctcctcgatagtggtcatgggggaaatgtgttaatttttcactttagatgtttgtgaaatgttggggagagtgaggggtttgttcttaagtggtgggccattgacccaaagtattt

SEQ ID NO: 63206 - DNA, 601 bp, Human
ccctcacagccatttgtctggcggcttgtattcagatgtatttgttcagtaatccaaaaatggaagggtgatttggaaccttgagcagcaggctggggatggctgtgaattctgctttgcacttgcccactacatcaacacgccaagaaactcacctgccccatcccagtgcattctgaacatttcttatttttatcttcttaccaaccttctctcttaaaatcagcttcattaaaatggatttttctagagtaaccaccagatcacctcccccactctcagtccgttttccagtcaaacsatttgttacttgattcagttccaaatataatgtgtgtctgctactgttaagtcattgccttatagtcaacctcaagggtagtcataaactccaagagtttcacgtgtctgactatattcttaggagattgatgggttacatttttctcctcgatagtggtcatgggggaaatgtgttaatttttcactttagatgtttgtgaaatgttggggagagtgaggggtttgttcttaagtggtgggccattgacccaaagtatttttaattccttttttaggctgcatttgatgccagaaggca

SEQ ID NO: 63207 - DNA, 601 bp, Human; identical to SEQ ID NO: 29751

SEQ ID NO: 63208 - DNA, 601 bp, Human; identical to SEQ ID NO: 29752

SEQ ID NO: 63209 - DNA, 601 bp, Human
tagtgtgatcaggattatgtgaggagagtggcatgtaggaaggattggagtgggcaaagagaagctgaagacagagcagttcagaccccagtgatatagggactgagctaaggttgaggcaactggagggacagtttcttcatccattcaggctgctataacaatatgccttagacccaataatttacacacaacagaaacttaactcttcacagttgtagagactgggaggtgtaagatcaaggtgctggcagattctgtgtctggtaagggtttgttcctcataaaagggctccttgcygcatcctcaaatggtggaagggaggaacaagccccttgggcctcttttataagggcagtaatcccattcagaatcatttcccaaaggcctcacttcttcataccgccaccttgggaattaggtctcaagctatgaattaggacataaacattcagaccatagcagaaagaaaaggaagcatgggcagtgctgagatggattccacaggactgtgctagaaggaaaaggaagcatgggcagtgctgctgagatggattccgcgggactgtgtttagttgtgctctttctttttccacggca

SEQ ID NO: 63210 - DNA, 601 bp, Human
atttcagattggaatatgagaagaaaatttatttatgtgactcttttcctttttggcattttctttgtttacatgactttttttttaagaaagttaaattttaaataatttatgaagctagagtttgggggatttatatgtataaaatttccttcaagcttctagagtatcggagtatttgtgaatgataaaaagaaaggtaggggaatgaggaagaccagtttattacgaaggccaaaatttattgtatctatttctgtgtgacctttgataacaaaaatcaagaacttttgtttccctyttaggtgacaggagcctgttgcctctttctggctgggaaagtagaagaaacaccaaaaaaatgtaaagatatcatcaaaacagctcgtagtttattaaatgatgtacaatttggccagtttggagatgacccaaaggtaagaatgataataacttcctgccttctggtcttgattccttatggtagtattgtacagttccacatgttgacagtgcctgtagcccttgtgtctgccagtctcttgagttcctaagagggccttctgtagaagttacttgatgcttttgtaagaaaggaggg

SEQ ID NO: 63211 - DNA, 601 bp, Human
acaaaagtatgtatgctgtatgtacacatacacatgcctacatatgccatgtgtcttttgcttctaaagaatgttggaaggtatcaacatttgcagcatttttatgcacccagagcttgatactggtcacaccagccatcctatcttttccatacagctcacgccagtgtcagcaagtggtgctcaaataattgtacatattttgttgtgtttttaaaataccacttttagggacccatggcagtgttcctccactcccattcgcatcaagttccccttgttgcaacctcagtaacacctgttaattatccttcataacatttatcacagtttgcaattaaatagattttcaaaaatactttaggccaagccgggcagattgcttgagcccaggaattcaagaccagcctagccaacatagcgaaaccccatctctactatataagaataaactggccaggcgtggtggctcacgcctgtaatcccagcactttgggaggctgaggcgggcggatcacgaggtcaggagatcgagaccatcctggctaacatggtgaaaccccgtctctactaaaaatacaaaaaattaaccgggcgtggt

SEQ ID NO: 63212 - DNA, 601 bp, Human
attggaatcatataggatgtagctttttcagattggtctctttcacttagtggtgtgcatttagatagtagtatccattagatgatttttatcaaattatcacacacataactccctccccttctcagctgtaagatgcatgaaagcaaagactatctgttttgtctaatgcctcattcagtggcaggacagagtaggcattcagcaagtactcgtggaataaatgtcaaactaatggtctgaggaaatttctaaatcacagttaaagctaaagcgatgaagttcagccccattcatggtgttgtttttcctaactagcttgtattgtctcacaatagttatctttttctctgccaagcattatgtatgtatatacaaaatgtatagtcattctcctcattgctttgaggagttaacaagggcccagaacacttttatacatattgtggttgtgattaacactagtattttctaagtattgccaatgtgggtaactcttttgaacttaattataaatccattaatctgtttataaacatttgaacctattaggaactcatattaactataaccaaaaatgcagttttatagaaataatttc

SEQ ID NO: 63213 - DNA, 601 bp, Human
tttgaacctattaggaactcatattaactataaccaaaaatgcagttttatagaaataatttcaccatcagataatgttttcaatgtgcatgggtatttgatttttactgagtagtggggccctgtgtcctaacgtgataagtctgattgtaggaacatgctgtggttcagtcacacccccgtcacaggggcaggtgaaccttgtggctggcaagctgtgcttaaggataaggcatcacacagatctgggaccacagcagggcatggactcgtggcagctgctggtttgtgccatcccagsgtgccttggagaagccccctttacttttagcctttacccactgtaccatgaagtcaggaaaccaagccccagtccaggaacagtgaaagtagaagttctgaagctcctgtgccccagaaaatgggaaaagaggggtcaccataccaattaggtctgaatgggggagggggctttgcaacctgccccctgcctctctatctcgcgcagtcttccctggtcggagtcggggccaaaggaaaacacctggagctgggagcagtgaagacattggggaagatgttttcctctgcagacaggagg

SEQ ID NO: 63214 - DNA, 601 bp, Human; identical to SEQ ID NO: 37332

SEQ ID NO: 63215 - DNA, 601 bp, Human
ttaaggtagaaggaagaaagggagaataaagatgtcaccactaaaccaagtaaccgaaaactaccaaaatgaccatctaaaagaacataccaaacaatactaaatatactttaaaaacaaaagtttacaagaagtaaatcataaatgtacattttttgtgtattttgttttgttttgattttttttttcttgtattttttggttgagatggggtttcaccacattggccaggctggtctcgaactcctgacctcaagtgatcagccaacctcggcgtcccgaagtgctgggattacaggcrtgagccactgcacccgccccataaatgtaaattttatatgtatacacacatatacttttttttttttttttgctctgttgcccaggctggagtgcagtagtgcgatctcagctcactgcaacgcccccctcccaggttcaagcgattcccctgcctcagcctcccaagtagctgggattacaggcacctgccaccacgcctgactaatttttgtatttttagtagagacggggtttcaccatgttgaccaggctggtctcgaactcctgacctcaagtgatccacccacctcagcctctc

SEQ ID NO: 63216 - DNA, 601 bp, Human
gggcacagtggctcatgcatataatcccagcactttgggaggccaaggcgggcagattgcctgaggtcaggagttcgagaccagcctggccagcatggtgaaacccgatctctactaaaaatacaaaacttagccaggtatgttggcaggcacctgtaatcccagctatttgggaagctgaggcagaagaatcacttgaacccgggaggtggaggttgcagtgagccgagatcgcgccattggactccagcctaggcaacagggcaaaactctatctcaaaaaaaaaaaaaaaaaaaaaaagcctgggctgggcaacacagcaaaaccccatctccaccaaaaaaaaaaaaaaattagctgggcgaggaggcacatgcctgtggtcctaactactcaggaggctgaggtgggaggattgcctgagcccaggagatggaggctgtcgtgagctgtggctacaccacagcactccagcctgggcaacagactctatctcaaacaaaaaagaaagttcagacaggaaaaaagagtggtactttaactagactagataaggggaaacttttccaagtcaggatctgactgatgttttcattcttt

SEQ ID NO: 63217 - DNA, 601 bp, Human
tcctgaggccagcaagaccacgaacccaccaggaggaatgaacaagtccagatgcgccgccttcagagcgataacactcaccgcgaaggtctgcagcttcactcctgaagccagtgagaccacgaacccaccagaaggaagaaactctcaacacatctgaacttcagaaggaacaaactccagacacactgcttttaagaactgtaacactcaccgtgagggtctgaggtttagttcttgaagtcagtgagaccaagaacccaccaactgcggacacaccagcatttaagaaagacaaatwacttgactctttccatggcggaaaaaaaaaaagacagtttaaacctcattgtaattacaacagatacttttaaaaattctctctgggccggacgcagtggctcacgcctgtaatcccagcactttgggaggccgaggcgggcagatcacctgaggtcaggagttcgagaccaacctggccaacatggtgaaaccccatctttactaaaactacaaaaattaaccaggtgtggtggtttgcacctataaatcccagctactcgggaggctgatgcatgagaattgcttgaaccctggaggc

SEQ ID NO: 63218 - DNA, 601 bp, Human
caagccagcagtggcaacatgctccagtccccttccacaatgtggaagctttgttctttcaccctttaaaataaatcttgctgctactcactctttgggtccaggctgcttttatgagctgcaacactcactgcaaaggtctgtagcttctctcctgaggccagcaagaccacgaacccaccaggaggaatgaacaagtccagatgcgccgccttcagagcgataacactcaccgcgaaggtctgcagcttcactcctgaagccagtgagaccacgaacccaccagaaggaagaaactctsaacacatctgaacttcagaaggaacaaactccagacacactgcttttaagaactgtaacactcaccgtgagggtctgaggtttagttcttgaagtcagtgagaccaagaacccaccaactgcggacacaccagcatttaagaaagacaaattacttgactctttccatggcggaaaaaaaaaaagacagtttaaacctcattgtaattacaacagatacttttaaaaattctctctgggccggacgcagtggctcacgcctgtaatcccagcactttgggaggccgaggcgggcagatca

SEQ ID NO: 63219 - DNA, 601 bp, Human
caaaaattgatgctcacagaaggagatgaaaaggattatttgaggtaccttttttgattccatgaaaatactagtgagaggtgatagcgtgctggcagcccttgaagccctcgctggctctcggcacctcctcggcctcggtgcccactctggccacgcttgaggagcccttcagctcgccgctgcactgtgggagcccctccctgggctggccggggccagagccggctccctcagcttgcggggaggtgtggaggaagaggcaccgcgaggtgtggagggagaggtgcaggcgggaacyggggctgcacgtggtgcttgcgggccagcatgagttctgggtgggtgtgggctcagcgggccccgcactaggtgcggccagctggtgctgctggccccgggcagtgacgggtttagcacccgggccagcagctgctgagggtgcaccggataccctgcagtgccggcccaccggccctgcctgtgctcaaattctttctgggcctcagctgctacccacgaggcagggcttcagacctgcatcccgccatgcctgagcctcccaacccccgctgtgggctcctgcgcagcccaagcctcc

SEQ ID NO: 63220 - DNA, 601 bp, Human
acaaggtcaggagatcgagacaagcctggccaatatggtgaaaccctgtctctactaaaaatacaaaaattacccaggcgtggtggcagacacttgtagtcccatctacttgggaggctgaggtgggagaataccttgaacccaggaggcagaggttgcagtgagctgaaatcacaccactgcactccagcctgggcaacacagcgagactctgtctcaaaaaataataataaataggctgggcacggtgactcacgcctgtaataccagcactttgggaggccaaggtgggcagatcackaggtcaggagatcaagaccatcctggctaacacggtgaaaccccatctctactaaaagtataaaaaaattagcagggtgtggtggcgggcgcctgtagtcccagctactctggaggctgaggcaggagaatggcatgaacccaggaggcggagctcacagtgagccaagattacgtcactgcactccagcctggtccacactgcaagactccgtctcaaaaataataataacaataacaaataaataaacaaataaaataaaaacaaaaattgatgctcacagaaggagatgaaaaggat

SEQ ID NO: 63221 - DNA, 601 bp, Human
ctgtaatcccagcactttgggaggctgaggcaggtggatcacaaggtcaggagatcgagacaagcctggccaatatggtgaaaccctgtctctactaaaaatacaaaaattacccaggcgtggtggcagacacttgtagtcccatctacttgggaggctgaggtgggagaataccttgaacccaggaggcagaggttgcagtgagctgaaatcacaccactgcactccagcctgggcaacacagcgagactctgtctcaaaaaataataataaataggctgggcacggtgactcacgcctstaataccagcactttgggaggccaaggtgggcagatcacgaggtcaggagatcaagaccatcctggctaacacggtgaaaccccatctctactaaaagtataaaaaaattagcagggtgtggtggcgggcgcctgtagtcccagctactctggaggctgaggcaggagaatggcatgaacccaggaggcggagctcacagtgagccaagattacgtcactgcactccagcctggtccacactgcaagactccgtctcaaaaataataataacaataacaaataaataaacaaataaaata

SEQ ID NO: 63222 - DNA, 601 bp, Human
aatatgcatagaaaatgtatgaatgtccatctaagacaatgttaaccaggatttactgtggcaaataggggaaggtcctgaggctaactcaaaaccttctatggtttggatttatcacaaagccagtattaagtttacctcattttgtttttatttcaagagaaacagttgctagataatgcatctacttataaaaacagaaagtggccaggcacagctgtaattccaacatattgggaggccgagacaggaggaccaccagatcccaggattttgagaccagtctaggcaacatggtgaraccctcatctctaaaaaaataataataataaataagtaaaataaaatggctcacacctgtaatcccagcactttgggaggctgaggcaggtggatcacaaggtcaggagatcgagacaagcctggccaatatggtgaaaccctgtctctactaaaaatacaaaaattacccaggcgtggtggcagacacttgtagtcccatctacttgggaggctgaggtgggagaataccttgaacccaggaggcagaggttgcagtgagctgaaatcacaccactgcactccagcctgggcaacacag

SEQ ID NO: 63223 - DNA, 601 bp, Human
ctttgggagaccaagacgggtcgatcacctgaggtcaggagttcaagaccagcctggccaatatggtgaaaccgagtctctactaaaaatacaaaaattagccaggcgtggtggtgcctgcctgtaatctcagctacctggaaggctgaggcaggagaatcgcttgaacccagaaggtggagagtacagtgagccaaaatcacgccactgcactccagcctgggcaacagactgagagtacgtctcaaaaaaaaaaaaaaaaaatagcaagatctattacaaaaaaaaaactatgttcaarcatcttcatagatgcatcatcctacaagctacaatacaacatatttaatgtaatcccatttgattttgggtaaggaacaaccatatatttatatgtatatacacacacaccaatatataaaacttgtgtgtatatacacaaaaatatgcatagaaaatgtatgaatgtccatctaagacaatgttaaccaggatttactgtggcaaataggggaaggtcctgaggctaactcaaaaccttctatggtttggatttatcacaaagccagtattaagtttacctcattttgtttttatttca

SEQ ID NO: 63224 - DNA, 601 bp, Human
cggtggctcacgcctgtaatcccagcactttgggaggctgaggcaggcggatcacctgaggtcaggagttcgagaccagcatgaccaacatggagaaaccctgtctctactaaaaatacaaaattagccaggtgtggtggtgcatgcctgtaatcccagctactcgggaggctgaggcaggagaatcacttgaacccaggaggcggaggttgcggtgagccaagatcatagcaccattgcactccagcctgggcaacaagagcgaaactccatcacaaaaaaaaaaaaaaaaaaaaaaaargaaaagaaaagaaaaaaaagaaaaagactgaatataaatatgtaatttttttaatgtatctgagtgggactgaaggtgatttaaattttcttcattataattatctacattactcaatgttcgcaatgaatacacattactttaaatgtgtgtaaaggtgaacatttcaagaattttaagaaatcagtgaaagtgttggctaagtgccacgaaaaacatgaacttaaaatgaactgtcttaaaactacaatatccttttaaaggaagacagtcataaagatcacgggaaggggccaggtg

SEQ ID NO: 63225 - DNA, 601 bp, Human
gctaacacggtgaaaccccatctctactaaaaatgtgaaaaattagccgggcatggtggcagacagctgtagtcccagctactcaggaggctgaggcaggagaatggcgtgaacccaggaggtggagcttgcagtgagccgagatagcaccactgcactctagcctgggcaacagagcaagactccatctcaaaaaacaaaacaaaacaaaacaaaacaaaaaaacaactaattatggagtacatagtgtgtaataccaaatacatggtgctctggattccaatcttccaggaccggcctrggaagctttcaagcagatgtctttcttccttctgtgtgcaccttgtcctcctgttacagaactgctcatgctccactatgcaccttctcctcataaagccataaacctcttaaatagaaagtccacaatctgttctctcttgtgccattacacttagagaaacaaaaaccaacaggaaaaaaaaaaagcttggggaattaaatattattttagtattaaaaccattcaatttgtatatgagtgaatctgtacattaacagccacattgaggctgggtgtggtagctcatgcctgtaatcc

SEQ ID NO: 63226 - DNA, 601 bp, Human
cttgcagccaagtgcggtggctcacacctgtaatcccagcactttgggaggccaaggtgggcagatcacctcagatcgggagtttgagaccagcctggccaacatggtgaaaccccatctctactaaaaatacaaaaaattttccaggcatggtggcctgtgcctgtaatcccagctacttgggaggctgagacagaagaactgtctgaacctgggaggcggaggttgcagtgagccgagatcacgccactgtactgaagcctgggcaacagagcaaaactctgtctcaaaaaaaaaaaaactaacaataataataataaagacttcttagcaccagctatataccacacactgtgccatgcactgtagacacaaatatcattaagacgtaatccctagtcttgagaatttacagtatgtccctatacccctaattttaggtcctttccttataaaagagggagggaggaaatggaacatttttgtttagaaaatatcaatggtcaaattatggagtacataggccgggtgcggtggctcatgcctgtaatcctagcactttgggaggctgaggcgggtggatcacaaggtcaggagatcg

SEQ ID NO: 63227 - DNA, 601 bp, Human
gagcctctctacaactggaaacctaattaaattccattaaatcctaaaaccaggcaataaagattctttggtgcatctccaagaagcttctgcaaaagaaatggaccaaaatacaggccctggccctgaccactaatttgtacagtttaaaacctcattaagtaattttgacaagtttcttgaggagcctccaaacttgaaactttgtgggaaaattcaacagcctaaacatcttctgccctcaagcagaccctcatactgacctaccaggccctgttcatactagtcaagggatagctgytgcttgctaaaacaccaccaaaatttaccccttctcttaaatgaattaaactggaaagcccagaaatttctctacaagaagatcagtgtcttcattgtgcagaagagctcacacagcaggcctgggacttctctccttagaaaggtctgcttgcagccaagtgcggtggctcacacctgtaatcccagcactttgggaggccaaggtgggcagatcacctcagatcgggagtttgagaccagcctggccaacatggtgaaaccccatctctactaaaaatacaaaaaattttccaggcat

SEQ ID NO: 63228 - DNA, 601 bp, Human
aacaggtctccaccctatttcccaggtggcttccttgttcgaaatgaaaaccctctgggaagggtttgagtattacttggtcctggaaacttacaagaagcaggagataaaatgcattacacttagagaaaaaaaaaaaaaagactaggtatggtggctcacgcctataatcccagcactttggaaggccgaggtgggcagatcatctgaggtcgggagttcaagaccagcctgaccaacatggaaaaaccccatctctactaaaaatacaaaattagccgggtgtggtggtgcatgcctstaatcccagctactcaggaaggctgaggcaggcgaatcgcttgaacccaagaggaggaggttgcggtgagccgagatcacgccactgcactccagcctgggcaacaagagcaaaactcagtctcaaaaaaaaaagagagaaacaaacaaacaaaaaaaatagtaaaaatgaacaaaaaaggcttggggaatggaacattaaccattcaatttgtgtataagtaaatcggtatattaaaagtcacagcctgagacagagccaagtgtcacaactggtctgtgttatgagcaaaagaaaggt

SEQ ID NO: 63229 - DNA, 601 bp, Human
gacatcctcttctggtttctcaaaacaggtctccaccctatttcccaggtggcttccttgttcgaaatgaaaaccctctgggaagggtttgagtattacttggtcctggaaacttacaagaagcaggagataaaatgcattacacttagagaaaaaaaaaaaaaagactaggtatggtggctcacgcctataatcccagcactttggaaggccgaggtgggcagatcatctgaggtcgggagttcaagaccagcctgaccaacatggaaaaaccccatctctactaaaaatacaaaattasccgggtgtggtggtgcatgcctctaatcccagctactcaggaaggctgaggcaggcgaatcgcttgaacccaagaggaggaggttgcggtgagccgagatcacgccactgcactccagcctgggcaacaagagcaaaactcagtctcaaaaaaaaaagagagaaacaaacaaacaaaaaaaatagtaaaaatgaacaaaaaaggcttggggaatggaacattaaccattcaatttgtgtataagtaaatcggtatattaaaagtcacagcctgagacagagccaagtgtcacaactggtc

SEQ ID NO: 63230 - DNA, 601 bp, Human
actaaaggataaagaacacttcttcaacagtcttcctaacaaggagactagattctttttctccatggttagaacgagacatcctcttctggtttctcaaaacaggtctccaccctatttcccaggtggcttccttgttcgaaatgaaaaccctctgggaagggtttgagtattacttggtcctggaaacttacaagaagcaggagataaaatgcattacacttagagaaaaaaaaaaaaaagactaggtatggtggctcacgcctataatcccagcactttggaaggccgaggtgggcaratcatctgaggtcgggagttcaagaccagcctgaccaacatggaaaaaccccatctctactaaaaatacaaaattagccgggtgtggtggtgcatgcctctaatcccagctactcaggaaggctgaggcaggcgaatcgcttgaacccaagaggaggaggttgcggtgagccgagatcacgccactgcactccagcctgggcaacaagagcaaaactcagtctcaaaaaaaaaagagagaaacaaacaaacaaaaaaaatagtaaaaatgaacaaaaaaggcttggggaatggaacatta

SEQ ID NO: 63231 - DNA, 601 bp, Human
gtaaggagatttactggtccttacaattgaaactaaaacaattctcttaataagaactaaaggataaagaacacttcttcaacagtcttcctaacaaggagactagattctttttctccatggttagaacgagacatcctcttctggtttctcaaaacaggtctccaccctatttcccaggtggcttccttgttcgaaatgaaaaccctctgggaagggtttgagtattacttggtcctggaaacttacaagaagcaggagataaaatgcattacacttagagaaaaaaaaaaaaaagacyaggtatggtggctcacgcctataatcccagcactttggaaggccgaggtgggcagatcatctgaggtcgggagttcaagaccagcctgaccaacatggaaaaaccccatctctactaaaaatacaaaattagccgggtgtggtggtgcatgcctctaatcccagctactcaggaaggctgaggcaggcgaatcgcttgaacccaagaggaggaggttgcggtgagccgagatcacgccactgcactccagcctgggcaacaagagcaaaactcagtctcaaaaaaaaaagagagaaacaa

SEQ ID NO: 63232 - DNA, 601 bp, Human
ggaagattaatgattgcaccattaatcaatacagtaaagctgataacccaaatggcccccataggaaactggattaatatggtttacctgtataacggaatatactgtaaatatttaaaataatgggtggcaggtgcctgtagtcccaactatttgagaggctgacgcaggagaatcacttcaaccagggaagtggaggttgcagtaagctgagattgcgccactccactccagcctgggcaacaaagtgagactccgtctcaaaaataataataataataataataataataataataatgtccttaaaaactatacacacacacagaattaatactggctctgtctgaggttacaggtgtctcattttctaagttagatattttccacaatgttgttttttgaaataagagcatgattttcactgttttatttcaaaataacaaaaactaaatactcctcccccagaaaagatggtggtggggaaaatggtaaaatgctgatcactgctgaaattcggtgatggatttatgagggttcagtgggcgtggtggctcacgcctgtcatcccagcactttgggaagccgaagcaggcagatt

SEQ ID NO: 63233 - DNA, 601 bp, Human
gttagcaagaaatacagaagtatttccaggtgaaaatgatacaataattggaatttactttaaaatatccctggccggctcacacctgtaatcccagcactttgggagacccaggtcggtggatcacttgaggccaggagttcgagaccagtctggacaacatggtgaaaccacgtctctactaaaaatacaaaaattagctggatgtgatggtgcgcacctgtaatcccagctacttgggaggctgaggtagaagaattgctcaaacccggaaggcagaggttgcagtgagccaagatcrcaccactgcactccagcttgggggacaagagcaaaactctgtctcaaaaaataaaataaaatacaatacccctgtacattcccattcactactgctgaaattataaactggcatagtctctttggagggcaatttggcagcagctattaaatctttaagatgtgcatccgggccgggcgcggtggctcacgcctgtaatcccagcactttgggaggccgaggcgggcggatcacgaggtcagaagatcgagaccatcctggctaacacggtgaaaccccgtctctactaaaaatacaaaa

SEQ ID NO: 63234 - DNA, 601 bp, Human
ggcgcggtggctcacgcctgtaatccctgcactttaggaggccgaggcaggcagatcacccacctgaggtcaggagttccagaccagcctggccaacatgccaaaaccctgtctctactaaaaatacaaaaaattagccaggcgtggtggcatgcacctgtagtcccggccacttgggagggtggggcaggagaatccctcgaacccaggaggtggaagttgcagtgagccaagatcacactactgcactccagcctgggctacagagtgagatgccatctcaaaaaaaaaaaaaaaaaaagaaaatgcaggcttgagaactagatctagaagagaaccttgggtgtggaactgaccagaagcaaacagaccagaaatctttaaacatcacttagattgtggcagaaacaagcctagagtaaaagaggccttcacttcaggccccaaacctgcacctgcacaaagcagatggggtcttgctatgttgcccaggctggcctcaaactcctgggctcaagcctaaacttctacctcagcctcccaagtggctagcatgagccactgcacccaattcacaggttttcaaaactgcagcgctgaa

SEQ ID NO: 63235 - DNA, 601 bp, Human
aattactactgactgccttaacaagctatttcaagacaaagataagtacaggcaagaatggctataccacttttcaagcagaaatggaaggaataagtaaaatctagagagcaaaagtctcaccagttgtaaaagtttctacagcccaaataataggagagtaagactgcaacaacattggcagagaacggtctgtgagccttctccattgaacaaatggctcatctttgcggcagagatcacaggaaggctgttacaatctctgggcatttgtttcagaaagcttcaaggaagctcctayaaattgagacccagaggcatatgagcgaggccacaaagaaataaggcaggcttggggccaggcgcggtggctcacgcctgtaatccctgcactttaggaggccgaggcaggcagatcacccacctgaggtcaggagttccagaccagcctggccaacatgccaaaaccctgtctctactaaaaatacaaaaaattagccaggcgtggtggcatgcacctgtagtcccggccacttgggagggtggggcaggagaatccctcgaacccaggaggtggaagttgcagtgagccaagatcaca

SEQ ID NO: 63236 - DNA, 601 bp, Human
ttgcccaggctgatcttgaactcctgtgctctagcaatcctcctgcctcagcctcccaagtagctggaatttcaggtgtgagccacagcacccagctgtctgctctttagatacgggataatcagtatactgtgcatcaaatcctctctcatcagtggtttacaagtaaagatggagtcggggaaagataaagaaacacagagaatgcagaatgcatagagaggaagaagtgctagaagagaaggagcagaacacctggtggcttcagtcttcctagtggtaggtaaactaccatatgcaytgggcagtgaagaacaaggatttgccttagcagaatctgggttcacatctggctctgcccacccagtaatctagaaaaaatgtcaaattacctcacatctctaagcacctatcctcatatatgaaacaaggataactaccctatccagatgtcatgaggatgaaattactgttcttggccaggtgtggtggctcacacctataattccagcactttgggaggctgaggcagaaggatcacttgagcccgggagttcatggtcagcttgggcaacacagtgaaatcccatctccattttaa

SEQ ID NO: 63237 - DNA, 601 bp, Human
tgctgtgacgcacgcctgtagtcccagatactcgggaggctgaggcaggagaattgcttgaacctgggaggcagaggttgcagtgagccaagatcacgccactgctctccagcctaggtgacaatgcgagactctgtctcaaaaaaaaaaaaaaattacaaaaattatctaggcatttggtggcttgcacctgtagtccctgttactcatgaggctgaggctggataatcgcttgagccctggaagcagaggttgtagtgagctgagatcacaccactgcactctagcctgggcaacagartgagaccctgactcaaaaaaaaaaaaaaaaaagaaaaaaaaaagcatcacaccctactgttcaaaatcctgtactggcaactttgggtcaaaggtggctgtttaaggaagtctgtttttttgtgttttttttttaatttttgtagagatggggtcttgctatgttgcccaggctgatcttgaactcctgtgctctagcaatcctcctgcctcagcctcccaagtagctggaatttcaggtgtgagccacagcacccagctgtctgctctttagatacgggataatcagtatactgtgcat

SEQ ID NO: 63238 - DNA, 601 bp, Human
agaccctgtctctacaaaaatacaaaaattaggctgggcatggtggctcacacctgtaatccctgcactttgggaggccaaggtgggcagatcacttgaggtcaggagtctgagaccagcctggccaacatggtgaaaccccatctctactaaaaatacaaaaattagccgagtgctgtgacgcacgcctgtagtcccagatactcgggaggctgaggcaggagaattgcttgaacctgggaggcagaggttgcagtgagccaagatcacgccactgctctccagcctaggtgacaatgcragactctgtctcaaaaaaaaaaaaaaattacaaaaattatctaggcatttggtggcttgcacctgtagtccctgttactcatgaggctgaggctggataatcgcttgagccctggaagcagaggttgtagtgagctgagatcacaccactgcactctagcctgggcaacagaatgagaccctgactcaaaaaaaaaaaaaaaaaagaaaaaaaaaagcatcacaccctactgttcaaaatcctgtactggcaactttgggtcaaaggtggctgtttaaggaagtctgtttttttgtgttt

SEQ ID NO: 63239 - DNA, 601 bp, Human
tgcccaaagagagcctattcttaattgtgtacttttggcaagtattggtggaggaaaattctgaggatataccagaaaagatacaaaacgactcagttctgttgaggcctcaggcaagtaactaacttccttatccctaactaagtccttgagtgactcaaaaggcaaacaatgctcaggagtgaaagtgccctccctgccacagtactaatccattatgtgtatttttttacctttctttaacttcatattaactaagattactgcaaaagccatccgtttctatttgaattaaagcatrggaaaggagcagaagtaatactggagggggtaggggtcagaggctccaaataccaacctcatgctgcccaagtgactcagtatgactttctgctactaatgcttcacattcctcacaccacccacacaactgtgcaaggtgactctggggattcacttacacaatgataagcaagcagaaacggatttttgcgtgtgtgcggttacctaacggacatggtttcctggtggtgaggtacatcctggatctgctttctgccaaatccctcgcataccaaaagtgcctggtccagcggaattt

SEQ ID NO: 63240 - DNA, 601 bp, Human
gtattatctgttatggaaaaactgatttacatagcaagttgctttattacggtgtgccagcactgcactaagtgcttcatctgcattatttaatttgaccctcacaacaatcttatggggtagatactgtggttatccccattgtataaagaaagaaacagaggcacggagaaattagggaattgtccaagattgcatgaactaaaatggaggagctgctggttccgacctttagagtcagagctggtaaccctacactgaaccccgggtttagcagacttgtgccaatgtcactgcctcrgggcacaaagggagatcctacaaataccaagactagggattttttttaagagactcactccatttcttctatttctataggaaaaatatagactaaaagcatagcaagagaaccgttgttgttgttgttgttgttgttgtttgagacagggtcttgctctgtcacccaggctggagtgcagtggcacaatcatggctcactgcaacctcaaccgcaacctccaggactcaagcaatccccccacttcaccctcctgagtagctaggactacaggcaccaccactatgcccagctaacttt

SEQ ID NO: 63241 - DNA, 601 bp, Human
ttatcaccctccagaactgtaagaaataaatgtctgctgtttaagccagacagaatacagtataatttgttatagcagcccaagtagaggaaggacactgggtggaggtatagattaaataaaaatagcagggatgttgattctggctgctggatacctagggctgctgttcattttgtatatgcttgaggtttttcatattatacttttaagtaaaaaaaaaaaaaaaggcttttagagagactaataaattccttgcctttgtttctatttataaccttacacagcagactttttgttkttgtaaaagtaatttgaggactgcttagaggtgtgacttgagaaaaaccatgtaccacatgtagacctgacgttggcatcagcatctgcagctgggaagaacggtgggaagatcaccagctcaggacctatacagacctgggctcagagtcagctccacgacgtgtaggttgggtagcaacgggccaggtggggaacttgatctctccgaatttcaattccctagtctgaaagatgtaacaatggatcttcctcccagggccgcagtgaggattcaatgacacatgcatataattcacct

SEQ ID NO: 63242 - DNA, 601 bp, Human
ttgactttaaaaaactgtataacgttatagattgcatgtttgtgtcctctaaaattcatacgttgaaaccctaaacccccaatgggatgatatgaggaggtggggcttttgagaggtaattagagcacatggcattagtggctctaagaagaaatgccagaaagactctagagaacatgcgacctctctctctctctctgctatctgtcatttgaggacaaagcaagaagagggccacctgcaaatcctaaagcaagccctcgccagataccagacctgtctgccagcatcttaatcttgyacttatcaccctccagaactgtaagaaataaatgtctgctgtttaagccagacagaatacagtataatttgttatagcagcccaagtagaggaaggacactgggtggaggtatagattaaataaaaatagcagggatgttgattctggctgctggatacctagggctgctgttcattttgtatatgcttgaggtttttcatattatacttttaagtaaaaaaaaaaaaaaaggcttttagagagactaataaattccttgcctttgtttctatttataaccttacacagcagactttttg

SEQ ID NO: 63243 - DNA, 601 bp, Human
agatatacaaattttgactttaaaaaactgtataacgttatagattgcatgtttgtgtcctctaaaattcatacgttgaaaccctaaacccccaatgggatgatatgaggaggtggggcttttgagaggtaattagagcacatggcattagtggctctaagaagaaatgccagaaagactctagagaacatgcgacctctctctctctctctgctatctgtcatttgaggacaaagcaagaagagggccacctgcaaatcctaaagcaagccctcgccagataccagacctgtctgccagmatcttaatcttgcacttatcaccctccagaactgtaagaaataaatgtctgctgtttaagccagacagaatacagtataatttgttatagcagcccaagtagaggaaggacactgggtggaggtatagattaaataaaaatagcagggatgttgattctggctgctggatacctagggctgctgttcattttgtatatgcttgaggtttttcatattatacttttaagtaaaaaaaaaaaaaaaggcttttagagagactaataaattccttgcctttgtttctatttataaccttacac

SEQ ID NO: 63244 - DNA, 601 bp, Human
tataaaaagctacaggccgggcgtggtggctcacgcctgtaatcccaacactttgggaggctgaagtgggcggatcacaaggtcaggagatggagaccatcctggctaacatggtgaaaccccatctctactaaaaaatacaaaaaaaaaattagccgggcgtggtggcgggcgcctgtagtcccagctactcaagaggctgaggcaagagaatggcgtgaacccaggagtcagagcttgcattgagccgagatagccagcctgggtgatagagcgacactctgtctcaaataaataaatwaattaattaaattaaataaaaaaataaaaagttacaatcactttgagaaaaggcttgtcagtttcttataaagttaaacatatacctaccctttgacccagtgattctgtttctaggtaactgcctaagaaaaaatgaaaacatacaaaaaattagccgggtgtgatggtgcatgcctgtaatcccagctactctggaggctgaggcaggagaatcacttgaacccaggaggcggaggttgtggtgagctgagatcatgccagtgccctccagcctgggcaacaagagcgaaactccgtc

SEQ ID NO: 63245 - DNA, 601 bp, Human
cgaggtgggtggactgtgaggtcaggagatcgagaccatcctggctaacacggtgaaaccccgtctctattaaaaatacaaaaaattagccgggcgtggtggtgggcgcctgcggtcccagctactcgggaggctgaggcaggagaatggagtgaacctgggaggcggagcttgcagtgagcagagatagcgccactgcagtccagcctgggtgacagagcgagactccatctcaaaaaaaaaaaaaaaaaaaagatggatcacagacctaaatgtaaaaagttaaaatgataaggttttyaggagaaaatacaggagaatacattcacaacctagaagtagacaaaaatttcttctaagacagaaaacaaaaaacaataaccacaaaagaactccataaattggacttcactgacattaaaaaacttcagcacatggaaagatgccataaagaaaatggataggcaaaccacagacttggagaaactacctgcaaaacacatttaataaaagacttctatacagaatatataaagaactcctaaattcaataaaaaggcaaacagcctaatttttaaaattattttttctttttttctcc

SEQ ID NO: 63246 - DNA, 601 bp, Human
ggccgggcacggcggctcacgcctgtaatcccagcactttgggaggccgaggtgggtggactgtgaggtcaggagatcgagaccatcctggctaacacggtgaaaccccgtctctattaaaaatacaaaaaattagccgggcgtggtggtgggcgcctgcggtcccagctactcgggaggctgaggcaggagaatggagtgaacctgggaggcggagcttgcagtgagcagagatagcgccactgcagtccagcctgggtgacagagcgagactccatctcaaaaaaaaaaaaaaaaaaaagatggatcacagacctaaatgtaaaaagttaaaatgataaggttttcaggagaaaatacaggagaatacattcacaacctagaagtagacaaaaatttcttctaagacagaaaacaaaaaacaataaccacaaaagaactccataaattggacttcactgacattaaaaaacttcagcacatggaaagatgccataaagaaaatggataggcaaaccacagacttggagaaactacctgcaaaacacatttaataaaagacttctatacagaatatataaagaactcctaaattcaataa

SEQ ID NO: 63247 - DNA, 601 bp, Human
attgcctgaggtcaggagttcaagacagcctggccaacatggcaaaaccccatctctactaaaaatacaaaaattagccaggcatggtggcacgcgcctgtaatcccagctacttgggagcctgaagcagaattgcttgaggcggaggttgcagtgagccgagatcacgccaccacactccagcctgtgcaacacagcaagactccatcacgaaaaaaaaaaaagtatcccttatgagtacaaatacaaaaatacttgacaaaatactatcaaatccaggaacatgtaaaactgatcatawgttatgactaagtggggaatcccagctatactgggaatgcaaggttgagttattattcaaaaatgaatgaatgttatccaccacaatacaagaaaaaggaaaaaataataataccaaaaagtcatttgacagaattcgataccaattcaggacaaaaattctcagcaagctattcatgaaagggaactctgtcaatttgataaaagacatatacagcaaacatcatgcttctaatgttgaaatgctgaacacttccccgctacttgcattcaatattgtactggaaatctgaactaatgg

SEQ ID NO: 63248 - DNA, 601 bp, Human
atcttaagccatcctcctacctcagcctcccaagtggctgggaccacaggtgcctgccaccatgcccagctgttttttatttgtagaaacaaggtctcatcttgtccaggctggcctcaaactcctgggcttaagccatcctcccacctcagcctcccaatgtgctgggattaaaggtatgagacgccacgcctaactccctaacaaagacttttatataataagaaaagtataggccaagcatggtagctcacgcctgtaatcctagtgctttgggaggccaagtctggcgaattgcctraggtcaggagttcaagacagcctggccaacatggcaaaaccccatctctactaaaaatacaaaaattagccaggcatggtggcacgcgcctgtaatcccagctacttgggagcctgaagcagaattgcttgaggcggaggttgcagtgagccgagatcacgccaccacactccagcctgtgcaacacagcaagactccatcacgaaaaaaaaaaaagtatcccttatgagtacaaatacaaaaatacttgacaaaatactatcaaatccaggaacatgtaaaactgatcatatgttatga

SEQ ID NO: 63249 - DNA, 601 bp, Human
ctgcaatccccactactcaggaggctgaggcaggagaattgcttgaactcaggaggcagaggttgcagctagccaagactgcaccactgcattccagcctggatgacagagcgagactccatctcaaaagaaacaaaaggaaatcatccttcaataaagcttttaaaaaatcatatggaaatccttccaaattatttggcatagttctggtttttttctttaatattccttgatacagatgtgccttgaggtcattccttgttccaccacttcgtcgtgatcccatctttttatcactacraatgatgttataataaacatcattgtgggagggaccttccccacaaggaaaactcctagaccagacaatttcactggtgaattatttcaaacatttaaaaaagaaatactcttacacaaactttttcagcaaaaaatggaggaatgaacacttcccaacttgttctgttagacctgaaaacctttataccaaaacctaacaaaaacttttttttttaagacagattctcgctctgttgcccaggctggagtgcacgagcgcaacctcggctcactgcaaactctgcctccagggttcaag

SEQ ID NO: 63250 - DNA, 601 bp, Human
agtattacaaataactgtatgccaataaatatgacaatttagggtaaacaaattcctcaaaaaacacagttaccaaatctgacacaaaataaaactggaaattgaaacagccctatttaataaaatagccctattttattcttattagttgttatcaaaaacctcccaacagatgatgaaagtgttctaaaacggaattgtggtgacagttgcacagccgtataaatgtcctgaaactcacttacaatagctgaattttatgaaaggaaaattatacttcaggctgggcacagtggctcaygcctataatcccaacactttgggaggccgagacgggtggataacctgaggtcaggagtttgagaccagcctggccaacatgatgaaaccccatctctactaaaaatacaaaaattaatggtggcaggtgcctgcaatccccactactcaggaggctgaggcaggagaattgcttgaactcaggaggcagaggttgcagctagccaagactgcaccactgcattccagcctggatgacagagcgagactccatctcaaaagaaacaaaaggaaatcatccttcaataaagcttttaaaaaa

SEQ ID NO: 63251 - DNA, 601 bp, Human
tcatgaggtcaggagatcgagaccatcctggctaacacagtgaaaccccgtctctactaaaaaatacaaaaaattagccgggatggtggcgggtgcctgtagtcccagctactctggaggctgaggcaggagaatggcgtaaacctgggaggtggagcttgcagtaagccgaaatcacgccactgcactccagcctgggcgacagtgtgagactccgtctcaaaaaaaaaaaaaaattatttaaagatcaactatgaaatttcaacatttcattttattggatgaattttatggaaaatargtttatctaaccaatacaatctatatgaagaaagtcctcaaagtaaaggggaggaagaaatggttatattaatattagacaaaatagactgcaaaataaggattactactacttatgatttcatgatgataaaaaaagagtcaatacattaggaagcaatgacaattgtaaatgtgtatgtgtcaaataagagaatttttttttttttttgagacaaaatcttgctctgtcattcaggctggagtgcagtggcacgatctaggctcactgcaacctccacctcccaggtgcaagctattg

SEQ ID NO: 63252 - DNA, 601 bp, Human
gaagagcctaagaatatttttggactaaaagttctagcccccattttcatttgtatcctgtatttcctccctcacatccaagttggtattgaaagtgttagcaactcgcaccccaggtccacaaccaatcagaaaagacacagcccaccatgctggagctgggtcctcaaagtggccagaactagggagtgctgaacaagggggctaggcgagactcagaagggtcaggacagcagctatttaccaatgaatacaaatcattcaatattctacaatgcacagaacagaaaaaaaaaaaaarttccaggccaaaatgccaacagtgttgagatagagaaatcctgcttcaggtggaaagagcaagaagctaacaagctagcagtagttccaatttttgaacacccgatctgaaaaacttagtttttagaaccgggcagccaaacagctatgctatttacacaaatatccattcttctcctctgtaataggaaaaccagttatcacaccccaaaacatattttgcttattgtagataggattctttcatgtctccacaggcattcactgagaaataatgagctaagacaaatatttagaaagg

SEQ ID NO: 63253 - DNA, 601 bp, Human
tgcaatcaggcccaaggcctgaggctagctatcactgccctctagacagacctcttttgagaatgccacttcaccacggtaggcccatggggtcacacctaattgaataattcaattcaccagaaattttcatctcaggggctccaaaaggaactaattgtgggactattttttcaactggcaaattctgttctataaacttttaacatatattggaaagttcaacatttgtttggttatttgaagagtacccagtagtagtataggtatagtttaaaatcaatatggctgaggccaggcrtggtcgctcatgcctgtaatcccagcactttgggaggccaaggcaggtggatcacctgaggtcaggagttccagaccagcctggccaacatggtgaaaccccgtctctactaaaaatacaaaaatcagccgggcgcagtggcacgtgcctgtaatcccagccacttgggaggcagaggcaggagaatcgcttgaacccaggaggtggaggctgcagtaagccaagattgtgccattgcactccagcctgggcaacagagtgagactccatctcaaaaaataaataaataaatatgtctga

SEQ ID NO: 63254 - DNA, 601 bp, Human
caggttttatttctcccattagaaactgaagttaagcatacctcattgctgcattaaaaaatcaaggttcttatagctagaacatacgttaaaatttttcccatctaagatcctgaaagaatacttggtagtttattttacatattaacaaacataaaagtagacattaaaacttatgattaattaataagattaataattaagatttagtcttcagtttatagatacactatctgaaaatgagcatttcaaagttccaagaaaagacccacccctcctttttttttttgtttttgagacwaagcctcactgtcatccaggctggagtgcaatggtgcaatcatgtctcactgaagcctcaaccttccaggctcaggtgatcctcccaccttagcctcctgagtagctgggaccacaggtgcatcccactatgccctctcaaactcccaggctcaaatgatcggcccgcctcagccacccaaagtactgtgattacaagcgtgagccactgtgcccggcctctttcttatctttaatgatgctatactctttttgattttttgtttttttgaaacggagtttctctcttgttgcccaggct

SEQ ID NO: 63255 - DNA, 601 bp, Human
gtggtgagccgagatcatgccattgcactccagcctgggcaaaaagagcaaaactccatctcaaaaaaaaaaaaaaaaaaacttagctgggcatggtggcgtgctcctgtagtcccacctacttgggaggctgaggcaggagaactgcttgaacccaggaggcggaagttgcagtgagcagaaatcacaccactgcactccagcctggcgacagagtgagactccatcttaaaaaaataaaaaataaccgtatctgcctgacagggttgttggaaggttaaaatgagttaattcctataaagtattaagaacagtgcctggccatatgggtaccattcatgaactgttagctattatcattatcattatatttcatcaattctaggacaggcttttttttcaaattttaccaactctaaaatcaggatgcatatttcaatatttactaccctacaagcactgttggccattctccttacattttaacatctctgaacctaggatgctccatgttgctcacagcatctcagagttggtgcactgaacacactgcctggcctatggaagacaatatttatataatgaatggaggtctactgcg

SEQ ID NO: 63256 - DNA, 601 bp, Human
tggccctatgaatttaacttgaaacagttaaaaaaaaaaaaaaagagcagaatcagatacaattttgtaaaagagtagctgcctctatagtcagagtatgagggaaactaaacctcctttacggtttttccttcataaattccaagacaggctttcctactgcagatggcatgagcccagagccataagcacacgcgcccaaatacacaaactaggatcgctggcgggtagccatgctctattcaccccaattactaactcacgccaaagaattcagagacattcatccagagacagtggygggcaaagggccttcgccatcccttccccaggctcccacaccactcttgccttcatggcacacccgcagattggcttgctcaggtcctatcccaaacccccatctagcatgccaggcctgaacgtccaaatgacattcttcatgctgccttgcagctgagtgttccagatgtgacttaggctctgcctaaatgggaacacttgggaaagatgcttctggcccaggtatgggggcagatgagaggagggaaggcatctattctgacggcatggatcacggctgcctcctgatcctggcaga

SEQ ID NO: 63257 - DNA, 601 bp, Human
tggcgggtgtctgtagtcccagctactcgggaggctgaggcaggagaatggcgtgaacccgggaggcggagcttgcagtgagctgagatcgccactgcactccagcctgggcaacagagcgagactccgtctcaaaaaaaaaaaattgtttttttgtacagacagagtcttaggctagtctcaaactcctgtgctcaaataatcctcccgccttggcctcccaaagtgttgggactacacacgtgagccactgcacctggccctatgaatttaacttgaaacagttaaaaaaaaaaaaaaagagcagaatcagatacaattttgtaaaagagtagctgcctctatagtcagagtatgagggaaactaaacctcctttacggtttttccttcataaattccaagacaggctttcctactgcagatggcatgagcccagagccataagcacacgcgcccaaatacacaaactaggatcgctggcgggtagccatgctctattcaccccaattactaactcacgccaaagaattcagagacattcatccagagacagtggtgggcaaagggccttcgccatcccttccccaggctcccacacca

SEQ ID NO: 63258 - DNA, 601 bp, Human
ctggctaacacggtgaaaccccgtctctactaaaaatacaaaaaaaaattagccaggctaatttagtggtggcgggtgtctgtagtcccagctactcgggaggctgaggcaggagaatggcgtgaacccgggaggcggagcttgcagtgagctgagatcgccactgcactccagcctgggcaacagagcgagactccgtctcaaaaaaaaaaaattgtttttttgtacagacagagtcttaggctagtctcaaactcctgtgctcaaataatcctcccgccttggcctcccaaagtgttgsgactacacacgtgagccactgcacctggccctatgaatttaacttgaaacagttaaaaaaaaaaaaaaagagcagaatcagatacaattttgtaaaagagtagctgcctctatagtcagagtatgagggaaactaaacctcctttacggtttttccttcataaattccaagacaggctttcctactgcagatggcatgagcccagagccataagcacacgcgcccaaatacacaaactaggatcgctggcgggtagccatgctctattcaccccaattactaactcacgccaaagaattc

SEQ ID NO: 63259 - DNA, 601 bp, Human
gtgtaaggatgaaatcggggcaattagcacgtgcgtcagctctgtgaacattcagagcgcatgtgctatggtttcagtgggaacagcactgagcaatcgtcacacaagtagcatggtctgacagcctcagccggcctcggaggccttccaggacgctgtccttcagcctacactgattatgaaaatgttaggagtcactcgtcaacccagtgttccactaggctttcctgtttatgtggagatgtccactttaaagggggacagatcacagttcaagaagcagttcaactgctttcagtcwcagtccacatgtcttctttcacaggagaggccgtttagcgtggctggcacagtcccctgcagctgccctgtactcagcacctgggctggctgtgccttggtgcccgcagctttctaccgtgcttgaagacgtcataccacatgcccagcatcacagtttacccctgttccagaagatgtcaattttacttgattttaattttcaaagtgtgtgttttaagttattaagttttaaatctgcacaatgaccatgttcacctaacagtttggaaatccacttcctccctccatgagcacatat

SEQ ID NO: 63260 - DNA, 601 bp, Human
gcacacgtggtttttctgagttttgaaacaggtgaagcaggtttgggaaactgccaattaaaaaattaataaacaataaacgttactgaagaatgacagaattgttgataatttttttcctttttagtggaaatgtagtaattgtacctactaatgggacccagagagtgttattttgatccatacatacaatgtgtaaggatgaaatcggggcaattagcacgtgcgtcagctctgtgaacattcagagcgcatgtgctatggtttcagtgggaacagcactgagcaatcgtcacacaastagcatggtctgacagcctcagccggcctcggaggccttccaggacgctgtccttcagcctacactgattatgaaaatgttaggagtcactcgtcaacccagtgttccactaggctttcctgtttatgtggagatgtccactttaaagggggacagatcacagttcaagaagcagttcaactgctttcagtcacagtccacatgtcttctttcacaggagaggccgtttagcgtggctggcacagtcccctgcagctgccctgtactcagcacctgggctggctgtgccttggtgcccgc

SEQ ID NO: 63261 - DNA, 601 bp, Human
gacaccgcaagggcctgttttggaagccccgggcgagtcagctctatcagctgcatagtgactctgctgctgctctagcacacgtggtttttctgagttttgaaacaggtgaagcaggtttgggaaactgccaattaaaaaattaataaacaataaacgttactgaagaatgacagaattgttgataatttttttcctttttagtggaaatgtagtaattgtacctactaatgggacccagagagtgttattttgatccatacatacaatgtgtaaggatgaaatcggggcaattagcacrtgcgtcagctctgtgaacattcagagcgcatgtgctatggtttcagtgggaacagcactgagcaatcgtcacacaagtagcatggtctgacagcctcagccggcctcggaggccttccaggacgctgtccttcagcctacactgattatgaaaatgttaggagtcactcgtcaacccagtgttccactaggctttcctgtttatgtggagatgtccactttaaagggggacagatcacagttcaagaagcagttcaactgctttcagtcacagtccacatgtcttctttcacaggagagg

SEQ ID NO: 63262 - DNA, 601 bp, Human
catctctgtgaaatattccatttctgcattcagtataaaggaaaaatagaattacacttcatttattcaaattcttgaatctgaatgttaacacattttattaatttcagagctgtcaaatctccgagagcatacctgtgaatatgatccagggacttacataactggtacatatagtgcataatttttttttctgataatgggtatcttctccctgtacaatcaaggaaataggcaaatacggttactgatggtacatatcctcttttttgaaataaaaataatctatttttatttaacratgtgtgaaaatctaagttcccctgtaaaaaataatctgaagtagtcttaggaaatatgtagtgtgcctacaaaacataccatttaaaattccatatactggccaggggcggtggctcacacctgtaatcccagcactttgggaggctgaggtgggtggatcaggagtttgagaccagcctggccaaaatggtgaaaccccatatctactaaaaatacaaaaatttgccgggtgtggtggcgggtgcctgtaatctcagctacttgggaggctgaggctggagaatcgcttgaacccagg

SEQ ID NO: 63263 - DNA, 601 bp, Human
ggaacgcgaggaactcagcctggcgtgtgcagcgaccctcaccacacggaacacgaggaactcagcctggcgtgtgcagcgaccttagctgctgggaggctccactctcccttgtgcttgaccttttgtttccactttaccaataggtccgacatgtgttttctaagaggcaaaagacagatccacattccgtcatctgttcagcatgatgtctgtggtgaaatgtgactaattcacagtaaccgtgataaataaccccacagtgagcctcccatcggccaaggggagttttgctgacaarttcagggtgagacaggtcaggttttgtcaacaaatgagtcccaagaaaccttttggtttccagagcttttatagattttggaattgtgggaacaagattttaaacctgtgctgggcgcggtggctcatgcctgtaatcccagcactttgggaggctgaggcaggcggattacctgaagtcaggagttcaagaccagcctgaccaacatggagaaaccccgtctctactaaaaatacaaaattagccgggcgtggtggtgcatgcctgtaatcccagctacttggggggctgaggcaggag

SEQ ID NO: 63264 - DNA, 601 bp, Human
ctacacatcaagctcggggatttgcccctgcccaggactggcaaattgactttactcacatgccctgagtcaggaaactaaaatacgtctcggtctagatagacactttcactggatgggtagaggcctttcccacaaggtcaaaaaaaggccaccgtggtcatttcttcccttctgtcagacataattcctcggtttggccttcccacctctatacggtccaataacggactggcctttattagtcaaatcacccaagcagtttctcaggctcttggtattcagtggaaccttcataccscttaccatcctcaatcttcaggaaaggtagaatggaacagactaatggtcttttaaaaacacacctcaccaaactcagcctccaacttaaaaaggagggctctgtcaaggatagagcccaaaaactcaccaaccaagcaagtaattacgctgaacccccttgggcactccctaattggaagtcctgggtcctcccaattcttagtcctttaatacctgtttttctccttctcttatttggaccttgtgtcttccgtttagctctcaattcataaaaaaacacatccaggccatcaccaat

SEQ ID NO: 63265 - DNA, 601 bp, Human
accaaccccgatgaccagctatttatagatggccccccttctgggcccactggctcccccaaaattgctgggtatgcagttgtttcccttgaccgagtaattgaagctaagcccctacctccaggaacctcctctcaaaaagcagaattcatagctctcaccagagccctaaccctttccaaaggcaaacgagtcaacacttacacagactccaaagatgtatatcacattcttcattcccacgccaccatctggcaagagaggagattccttactgccaaagtgaccctatcactaaccrcccccttatttaccaactccttcaagccgcacatctcccaactgaggcaggagttatacactgttggggacatcacacaggaacagataaaatctcaagaggcaacagaaagaccaatggggcagcaaaagaagcctccctttcttccgctcctgcctccctcctcctcattacccctgcagtccaacctcagtaccccccactgaaaaagcctcattactataacaaggagccttcctccagggggactggatagataaggaccagaagctagaccttccccagggccaaaccgacaaa

SEQ ID NO: 63266 - DNA, 601 bp, Human
agaatatggattcccaactttgccctcctagctcacccactctatgaagcagccaaaggccctctcagtgagcctctaaatccctcacgtaacatactccccaacttctgcaaacttcaaaccgctcttgtcactgcaccagctctgtccttacctggtatctcccaacctctcacactctatactgccaaaagatgaggaatagccctcggtgtcttagggcaacagaaaggagaccctccttcctttgcccctgtagcctacctctctaaacagttagacaacacagtcagaggatggycaacctgtcttagaatgctagcagcagcggccactttagctgtaagcaggaaactaacattgagtcaaaataccaccacctacagtcctcataatctacaggatctcctctcctcccgagcatgaggctccctcctttccggattcaattactccatgccctctatcaaaaatcctgaattcggtcttgccaaaagtgctcccttcaacccagcatccttactccctgtatcttcttcccttcctactcattcttgcactgacgtcctagatcacctgcagccacactttcctaacattt

SEQ ID NO: 63267 - DNA, 601 bp, Human
tgttcacgccgtcttcttaggccaacacgttcttcatataacaccaccatcctcctggttaaaaaatcagacggctcataccgactcctgcaagacctccgagccatcagtcaggctgtctttcctattcatcccatagtccctaacccctctacacttctctgtctcattccctccaacaccacctgctacactgctattgacctaaaagatgactttttttactattcccctgcaccctgattcccaaaacctctttgctttcacctggaccgaccttgacaccctccagtcacaacarctaacctggactgtcctccctcaaggcttcagagataaccctcacttctttggacaagctttagctcaagatctcacttccttaaaccttttccctagccgtctccttcaatacgtggacaatcttctcctttgcagcccctctctagaagactctcaaactcacacagttactctcttaaaactttctctccatcaaagggtatagagtctccccctccgaagctcaactttccacctccatagtaacttacctaggagttcaactttcccctgggacccgggctatgacccctgccct

SEQ ID NO: 63268 - DNA, 601 bp, Human
ggaatctcccaaaaggccaatgaaaaccctgcccaattcctttctcgccttacagagactctccaaaaatacacgcgtgtcgatcccgcctcccgggaaggaactattgttctttacatccattttatttcccaatctgcccccgacatctggcgcaaacttaaaaaggctgaagatgcccctcagaccccacaacgagacctccttaacttggctttcaaagtctttaataacagggatgagcaaaataaattagataaagcccaaagagatcgtgctaaataccagcttctagcagcgrctgtccatcaacccagccgtatcacccaagggcacaaaagacccgatagcagcaaccctccgggccttgttttaagtgtggcaaagaaggccactgggcatgggtgtatcctaacccttgagtgccaaagagtccttgtccagtgtgccagcagacaggccactggaagtccgactgtcctctcaacagacagacaagcctgctcctcagagccaccacccctttaacaagacaaaaagtgaagaaccgcttgcattcccgcagctcctcagcctagccgctgaggactgaccgggccca

SEQ ID NO: 63269 - DNA, 601 bp, Human; identical to SEQ ID NO: 37333

SEQ ID NO: 63270 - DNA, 601 bp, Human; identical to SEQ ID NO: 37334

SEQ ID NO: 63271 - DNA, 601 bp, Human; identical to SEQ ID NO: 37335

SEQ ID NO: 63272 - DNA, 601 bp, Human; identical to SEQ ID NO: 37336

SEQ ID NO: 63273 - DNA, 601 bp, Human; identical to SEQ ID NO: 37337

SEQ ID NO: 63274 - DNA, 601 bp, Human
ctagacttgtcaacattcttttagtaatcttttagatgctcaagtgtgggagacttcaagcatctgaagatttggctaccttttatgctttggctgttctgtatttgtagatgtcatttctgtaatcatagttgtaatctgctttgttggataagaggtgctagataataaacttcacttattttgataccatctgggaggaaagctcttcatagcatatgtgtgctatattctggactttcccattatctcagacatgtacacaggaaaagagatttgatcactgggtctgcgtgatgtygtagaaatgaggggagccatgtttgcaagaatgagtcccaaagtgctgggcttacagatgagagccattcctgacccaggttctttttcgttagtgtgtagtagcttctattttggcatagctattggttaggaaaatttttaaaaacagtagttgggaaatgaccactttctgttatttctatgctttggacacagtgtaaaggctgaataaacaaatagcttgagtttctgagttaggaaaaggagtagttttttatcaataatgtaggtgcatgttaatttttactgcgttatattt

SEQ ID NO: 63275 - DNA, 601 bp, Human
gcaaaatttacttcctaacctatatctttatgtagtcatgtcatacttgctcagaacttttcagactcccagtttgtgctttcagatgtttacttcctaatgctttcctgtatatgtgccttccttcagctagactactttttggctaatgtatttttctagctggctcattaattttatctacagtggcctctatcctcctgtgtgcctgctgaaatcctgtgcagacatctgatgtgtctccaacaggaggtggtctttacctcaattcaggcattatctacatgtctgcttgtctgaygtcttggaaggaactgggttgcttagatttgttgaatgactatatatgaagtcatcaaatggatttgttatttgttagtgaacagctagctataatagagtgctaaaagaggtagggaaattaactttcaaaatgggtataggtagttgaggtttcaaatgcagtgagcatttttgcattattttcctttaataatctttatgcaaatgcatgtagtaatcacatctccacattgattgaataattttagagacctggattactgtgacatagtctgtagtgggctataattattagata

SEQ ID NO: 63276 - DNA, 601 bp, Human
aatgactatatatgaagtcatcaaatggatttgttatttgttagtgaacagctagctataatagagtgctaaaagaggtagggaaattaactttcaaaatgggtataggtagttgaggtttcaaatgcagtgagcatttttgcattattttcctttaataatctttatgcaaatgcatgtagtaatcacatctccacattgattgaataattttagagacctggattactgtgacatagtctgtagtgggctataattattagatattcagagagttgcagctttttttttttttttttttcagtgagttttagaacaaaattgccctggcggggcatggtggctcacgcctgtaatccccggacttgggaggccgtggtgggcagatcacctgatgtcaggagttcgagaccagcctggccaatatggtgaaaccctgtctctgctaaaaatacaaaaattagctgggcatggtggctcactcctgtaatcccagcgactcgggaggctgaggcagaagaattgcttgaaccctggaggtggaggttgcactgagctgggatcgcgctactgcactccagcctgggcaacagagcgagac

SEQ ID NO: 63277 - DNA, 601 bp, Human
ctgggaattacttttaaaggcctgtgagataaagatggaaaacaaaagtctagggattgtgggatgacagatgaatttgcttgttggcctgtgtccagtccttggtctcagttaagctatgtcagtgttgtgactcttggtcccatacgttcatcatcttaatatcttaatacttttggcacttgttcttgaatgaaagaatctaggtcagacagtatttaaaatgagaagcgcaatatttgtttctgcagacaaaaatttgatttagagtgactcaagaagtgtggctgaatttctcagmagtacatgcagatttttctttttgttttcttactttttttttttgaggcaggatcttgttctgtttcctgggctggggtgcaatggcacaattatagctcattgcaacttcagacttctgggctcaagcaattctcccacctcagcctctcgaggtagctggggttataggtgtgcaccaccatgccctgctaattttttttttttttttttaatttttggtagagatgaggtctcattctgtcatctaggctggggtccagtgagctgtgattgtgccactgcagccttgacctcctgg

SEQ ID NO: 63278 - DNA, 601 bp, Human
tggcttagaaggacaagataagttatggttgcattaatatagtagggcacatgaaatgaaaccaagtactgtttgctttcctttgtttcagatggaggagatgtataagaaagctcatgctgctatacgagagaatccagtctatgaaaagaagcccaagaaagaagttaaaaagaagaggtatgtcgtctttttttttgtcttttcaagaaaacaggttgggaatggttcccacgtggggcagactgttggtgtaattgtgcaaactcgatcactagctctgcgtgatgtggcagaagcraagggaaccaggtttgcaaaagtaactgtggtgatggaaatgtgttagcctcagacactactgaggtggttctttctatcctagtacagtctaagtactggttactgcatttttttattggctgacaagttgctttttgttgatctttcatgttttgatctttaaatggaatagaaagtaatacttaatgaacatgtaagcataaagtgatgtgatggcccacaaatacaatgtatagtaattaaatcaatgtatttaacatattcacctcaaatacttaacactttgtggcaacaacat

SEQ ID NO: 63279 - DNA, 601 bp, Human
tgcccaggctggtcttgaactcctgagctcttttttgagacagggtcttgctgtgtcacccaggctggagtgcagtggcacaatctgagctcattgcagcctctacctcccgggttcaagtggtccttccacttcagcctcccgagtagctgggactacagatgtgcaccaccacgcctgactgatttttgtattttttgcagagatggggggtttcatcttgttgtccagtctggtattgaactcctgccctcaagccatctgccctcctcagcctaccaaagttctgggattacaggcrtgagccacagcacccagcctatgacttttattaagcgctatatttccatatatgtgtaacatgaaaatcgtgaaagtagaagattgataaccaccttcaattcattttaatgtagtagtactcaatcttggccgcacatcagaagtaacagggaacttttaaaaaaccaacaaaactgattcccaggcgctctctccagagattgggacctgagcattggtatttttaaagacccacagctcctcatacctattaggatggctagtattaaaacaaaacaaaaaattactattggcaagg

SEQ ID NO: 63280 - DNA, 601 bp, Human
tgagccacagcacccagcctatgacttttattaagcgctatatttccatatatgtgtaacatgaaaatcgtgaaagtagaagattgataaccaccttcaattcattttaatgtagtagtactcaatcttggccgcacatcagaagtaacagggaacttttaaaaaaccaacaaaactgattcccaggcgctctctccagagattgggacctgagcattggtatttttaaagacccacagctcctcatacctattaggatggctagtattaaaacaaaacaaaaaattactattggcaaggktgtggagaaattgaactcttgtacgttgttagtgggaatgtgaaatcatgtattgaccatggaaaatgggatgggcttcctcaaaaaattagaaatataattgccatatgatctagcaattccacttgtgtatatatatccaaaagaattgaaagcagggtcctgagacacttgtaaacccatgttcatagcagcagtattcacaatatagtcaagaagtggaagcaacccaagtggcatcaatgaatgaatggataaagaaaatgatagacatacgatggaatattatttagccttaaa

SEQ ID NO: 63281 - DNA, 601 bp, Human
catttagaatttgttcaaaaccataggattattataccattataaaaaacccaatggatttaaatacaattaagaagcgcttggagaataaatattatgcgaaggcttcagaatgtatagaagacttcaatacaatgttctcaaattgttatttatataacaaggtatgtaagccttatgttatacttgctaattctttgccattacatataggagagaaatgtataaaatcatgtgatcatttcagatttcaattctcttcgtttgagatacttgacgtgtgtgtgtgtgtgtgtgtgtrtatataatttttttttttttttttgagatggagtctggctctgtcacccaggctggagtgcagtggtgtgatctcagctcactgcaacctctgcccccaggttcaagtgattctcctgcctcagcctcccgagtagctgggaatacaggcacccaccaacctgcctggctaattttttgtatctttttttagtagagatggggttttaccatgttggcctggctggtcttgaactcctgacctcaggtgttccacccacctcagcctcccaaagttctgggattataggtgtgagccact

SEQ ID NO: 63282 - DNA, 601 bp, Human
gagagcacttggacacaggaaggggaacatcacacaccggggcctgtcgtggggtagggggagtggggagggatagcattaggagatatgcctaatgtaaatgatgagttaatgggtgtagcacaccaacatggcacatgtatacatatgtaacaaacctgcactttgtgcacatgtaccctagaacttaaaagtataataaaaaaaatttaaaaaaaaaagtgaggttggaaggagggaagaagtgtggagaagaggacaagcagatcgtacacatgctgtgagcactttggtttttacwtagcgagattacaagccatcactgatttgagttttaaaagatcactttggttgctgttttgaggatagactatagaggaccgaagcagaagaaagacctgcctggatgttattgcaataattgagttgtgcactgatgatgccttgggccagagtgaatgccacttgtgagaagtgtttggagtctagataggaagataatgctaacagggtttgctggcgggttggatatggagtttgagagacagtggagtcaaagatgacttcaaggtttttgttgtgaacaattagaagaatagag

SEQ ID NO: 63283 - DNA, 601 bp, Human
ctaataagttagagcactttgtcttttatttgtaggataaaagtcttactgttcctgttagtttgaattatctaattataataaatgcttcaagtgttagaggaaaagtacaatataatacagagttttcaataaagtaccttaattttaatatgaattatcagtttctgatacaatattattatatattgcttggaggaaagaatatttatcactaacttgtgttcttaaaatagtgcaatatatactctctgtttttctaacattctatcagaataactcagtctcagaattcaaatctttttttttttttttttgagacggagtctccctctgttgcccaggctggagtgcagtggcgctatcttagctcactgcaagctccacctcctgggttcacgccgttctcctgcctcagcctcccaagtagctgggactacaggcacgcccagctaattttttgtatttttagtagagacggggtttcaccgtgttagccaggatggtctcgatctcctgaccttgtgatccacccacctcggcctcccaaagtgctgggatgccaggcattagccaccgcgcctggcctagaattcaaatc

SEQ ID NO: 63284 - DNA, 601 bp, Human
cttttatttgtaggataaaagtcttactgttcctgttagtttgaattatctaattataataaatgcttcaagtgttagaggaaaagtacaatataatacagagttttcaataaagtaccttaattttaatatgaattatcagtttctgatacaatattattatatattgcttggaggaaagaatatttatcactaacttgtgttcttaaaatagtgcaatatatactctctgtttttctaacattctatcagaataactcagtctcagaattcaaatctttttttttttttttttgagacrgagtctccctctgttgcccaggctggagtgcagtggcgctatcttagctcactgcaagctccacctcctgggttcacgccgttctcctgcctcagcctcccaagtagctgggactacaggcacgcccagctaattttttgtatttttagtagagacggggtttcaccgtgttagccaggatggtctcgatctcctgaccttgtgatccacccacctcggcctcccaaagtgctgggatgccaggcattagccaccgcgcctggcctagaattcaaatcttaaaacattgctgtgttgaat

SEQ ID NO: 63285 - DNA, 601 bp, Human
tatctaattataataaatgcttcaagtgttagaggaaaagtacaatataatacagagttttcaataaagtaccttaattttaatatgaattatcagtttctgatacaatattattatatattgcttggaggaaagaatatttatcactaacttgtgttcttaaaatagtgcaatatatactctctgtttttctaacattctatcagaataactcagtctcagaattcaaatctttttttttttttttttgagacggagtctccctctgttgcccaggctggagtgcagtggcgctatcttwgctcactgcaagctccacctcctgggttcacgccgttctcctgcctcagcctcccaagtagctgggactacaggcacgcccagctaattttttgtatttttagtagagacggggtttcaccgtgttagccaggatggtctcgatctcctgaccttgtgatccacccacctcggcctcccaaagtgctgggatgccaggcattagccaccgcgcctggcctagaattcaaatcttaaaacattgctgtgttgaatttttattttatggctgacatttttgtttaatgtcatctttttcaat

SEQ ID NO: 63286 - DNA, 601 bp, Human
caggcatgagccaccgcgcctggcaattttttgtatttttagtagaaatggggtttcatcatgatggctaggctggtctcaaactcctgatctcaggtgatctgcacacctcggcctcccaaagtgctgggattacaggagtgagccatcatgcctggtctttagtaattttttcttaatgtaattttcatttagtatctgtcttcctggattttcttatagcaatttggctatatgcaatttttcaaagcaagtcagtcttttataatgtttgtgtcagagacagagctttaattagttktgcttttttttttttttttttttgagacggagtctgctcttttgcccaggctggagtgcagtggcgccgtctgggcttactgcaagctccgcctcccgggttcacgttattctcctgcctcagcctgccgagcagctgggactacaggcgcccgccaccacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccg

SEQ ID NO: 63287 - DNA, 601 bp, Human
tttagtatctgtcttcctggattttcttatagcaatttggctatatgcaatttttcaaagcaagtcagtcttttataatgtttgtgtcagagacagagctttaattagttttgcttttttttttttttttttttgagacggagtctgctcttttgcccaggctggagtgcagtggcgccgtctgggcttactgcaagctccgcctcccgggttcacgttattctcctgcctcagcctgccgagcagctgggactacaggcgcccgccaccacgcccggctaattttttgtatttttagtaragacggggtttcaccgttttagccaggatggtctcgatctcctgacctcgtgatccgcccgcctcggcctcccaaagtgctgggattacaggcgtgagccaccgcgcccggcccaaatccttgaaaaatgagagctctatggactggaatcagcatgtcattgcaaattttaatgtgatttggttttatttatctttttgactggtgtcagcatatgcagataagtcaagaacatttattaaacttcggtataaatataaaatcttttaaaatgatttttcataactaaaatcaataaat

SEQ ID NO: 63288 - DNA, 601 bp, Human
ttttattggatttagtgtaatgttcagagaatgaaatttataagttctttaaataacatttgtttctttttttaaaaaactttcttagttatgggtgacatcaaacaggaataaataaatttgtaattttagtactaccacctaggtcttctatagacatgacaaggatatgatttttttcatgcaaggtttggaaaccaacaaactttgttcaagcctagattttaactttttagaggaggatgatttagtaagtgcaggaagtatacaaggaaagcctctaaataatctttgccattcraactagaaagctaaaggtacatgactagagtttattaaattattttagacttttataaatcttttttttttttttggagacagagtctcactgttgccaaggctggagggcagtggctcgatctcagctaactgcaaactctgcctcctaggttcaggccttccaattagctgggcaacagacatgcaccaccaagcctggctaatttttgtatttttagtagagagtgggtttccccatgttggccaggctggtcttgaactcctggcttcaagcgatctgcctgcctcggcctcccaa

SEQ ID NO: 63289 - DNA, 601 bp, Human
tttgagatggaatctcactctgttgcccaggctggagtgcagtggtgcgatctcggctcactgcaacctacgcttcctgggttcaagcaattctcctgcctcagcctcctgtgtagctggagctacaggtgcacaccaccatccccggctaatttttttgatattttttagtagagacggggtttcgccatattggccaggctggtctcgaacacctgacctcatggtctgcccacctcagcctgcctcagcctctcaaagtgctgggattacaggcgtgagccactgcgcccggccttgtttttgttttttgttttttgtttttttaaatcatattatgttcctattcaacttttcaagttttttagttcaaattggcttgctgataatatttagtatctctggaacatctatctcagtgctttgattggtgataggtattaagtaaactctttaatcaaatctctatgattgcagatctttttttagttctatgggttttttttgttttgttttgttgagacagagtctcgcagtttcacccaggctggagtgcaatggcacactctccactcactgcaacctctgcctcccggcttca

SEQ ID NO: 63290 - DNA, 601 bp, Human
ttgactagtagttgatgtgctttgaaaagaacagaagtggccaggcgaggtggctcacgcctgtaatcccagctctttgggaggccgaggcgggcagatcacgaggtcaggagatcgagaccatcctggctaatacggtgaaaccccgtctctactaaaaatacaaaaaattagccgggcgtgatggcgccatgcgcctgtaatcccagctacttgggaggctgaggcaggaggatggcgtgaacccgggaggcagagcttccagtgagccgagattgtgccactgcactccagcctgggygacagagcaagactctgtctcaaaaaaaaaaaaaaaaaaaaaaaaaagaaaagaaaaagaaaagaacagaagtgattttttactagctcaagttgtcatcctcatatacatttttttccctttgtaccccttccaaacatacaattatttatgtaacaacatctaactaggttagggaaacacaataataaataatactgtcttaaaagagctctaatttgtgaaaaagaaatataatcacatggttaagagataatatgattaatgctataatctatataattatttttagaaaatgaa

SEQ ID NO: 63291 - DNA, 601 bp, Human
tttcccagatctgagcagatctgggaaatactgttttaacttccatgacacctatctgggttagaaaagtaggaaagaataagggagggccgggcgcggtggctcacgcctgtaatcccagcactttgggaggccgaggcgggcggatcacgaggtcaggagattgagaccatcccggctaaaaaacggtgaaaccccgtctctactaaaaatacaaaaaattagccgggcgcagtggcgggcgcctgtagtcccagctacttgggaggctgaggcaggagaatggcgtgaacccgggagrcggagcttgcagtgagccgagatcccgccactgcactccagcctgggcgacagagcaagactccgtctcaaaaaaaaaaaaaaaaaaaaaaaagaataagggaaagatacttagagattctataagtaaagaaaagaagttacagatatataaaatagtttacagttaaggaaacttgggctagaaatacttgcctaagggtagttcctatttgtctaaaactggttaaatttttatatttttagattcatttgacttaatatcttatcagaagggaaagttttgcctgtctcaacttgg

SEQ ID NO: 63292 - DNA, 601 bp, Human
ttctggtgggttgaaggggatgtgtggcacgaagggtacttctgatacgagtttagcctagagcatgactaaaccttgagacactaatgtatttaggcctaggttaagggcagatatgaatattccttgtctattcttcttccctctagaatgttccctggtttccacttggccacccaagggcagaggtatctccctagcagaataaatttccaagctgttttgctgcaacacagattaggaggaagagggagatgttttgatccttcttcacagctttcagtttaaaatctccctactrttctgtgtgtgtgtgtgtgtgtgtgtgtgtgtgtgtgttgtttaaatttttttttgagatggagtctcgctctgtcttgcaggtgggagtgcagtggcacaatcttggctcattgcaacctccgcaatgattcccgggtttaagcgattctcctgcctcagcctcctgagtagctgggattacaggcatgtgccaccatgcccagctaatttttttgtagttttttttttttttgagacagagtttcattcttgttgcccagggtgggtgcagtggtgcaatcttggctcactgcaacct

SEQ ID NO: 63293 - DNA, 601 bp, Human
ttaccctttccccttctcataaaaacttcactaaattgccgccatgaaaagggatgagttcatgtcctttgcagggacatggatgaagctggaaaccatcatcctcagcaaactaatacaagaacagaaaaccaaacactgcatgttctcactcataagtgggagttgaacactgagagcacatggacacagggaggggaacatcacacactggggcctgttgggggatggggggctagcagaggggtagcattaggaaaaatacctaatgtagatgacaggttgatgggtacagcaaacyactatggcacgtgtaacaaacctgcacattctgcgcatgtatcccagaacttaaagtataataaaaaaatttttttaaacttcaccaaattatattgagtttttaaaatatttaggctgttatataaacatgaattcataattgcaaatgaaaaagtaaatccaggagtttgctatctcataggagaaataaacaactggtatataaagtaaaaataatgtgccctgaaagaacctaaagtgaactttaaggaggtgaagaaggcagaatcacctgatgtgtttggcagatacatatttt

SEQ ID NO: 63294 - DNA, 601 bp, Human
gaacagtttgactatacataactagtttttcaactgtgaattttatgaaatctaattatagatcaattgtttctagtaggaatttagcatttgaagttgaaatgtcctacaaatgtaaattgggatgacttagtatgaaaaaatactttatgtcttttatattgattacctgttgaaataatgctttgggtatatttggttaaataaatatattaaatttacttaaatttttaaaacgtggctattagaaaacattaaattacatatatttctggtgggcagcactaacctcaaccatggkgtatcttgtttaagaagagcagtcacatcacttaagttttttcttcttaaccaccaaaaggaaaaatatatccatgtcagaggactctcaacaaactccatggcatttttagggtacaatcttactttgcctcttattaatcctttgagcattttctttattttccctataggataataagtatcttgattacactgagggatttatttatttttatgctttctgcaaattatgcagttaatatatatgtcttaaaataattggcaagtgtgctactttaatgtggtctcagattaataa

SEQ ID NO: 63295 - DNA, 601 bp, Human
ttagctatagtattggttaaagtacaaattaattttctagggaataacaaaagttctgtcagccacgtattttataatactaaggtagaaacaaattgcatttaatagtgctgtacatttaacatatggtgaagtttactttagagcagtgtgatcttagtggaactttctacaatgatagaaatatgctttatccattcaaacatactagcaaatagccacatagggctgttgagcacgggaaatgtagctaatgcaactaaggaactgaattttaaactttaattttaatgaactcaaytttaaatagaaactttttggtattgtctttttggaggtttttaggaactcattgttaaatttcgttagtagttgacctaaagtctttcttttttttttcctgagatgtagtctgtgggattacaggcgtgagctaccacgcccagccgacctaaagtctttctgtagtgatgtaaaatgtttcctgttggcactcacacgggcctgacttaagtcacccccaagtgatttcactgcaccctagttgcggcccaacaacacaactaggtaacctgataaatttcccaatatcctaagcact

SEQ ID NO: 63296 - DNA, 601 bp, Human
cattcaaacatactagcaaatagccacatagggctgttgagcacgggaaatgtagctaatgcaactaaggaactgaattttaaactttaattttaatgaactcaattttaaatagaaactttttggtattgtctttttggaggtttttaggaactcattgttaaatttcgttagtagttgacctaaagtctttcttttttttttcctgagatgtagtctgtgggattacaggcgtgagctaccacgcccagccgacctaaagtctttctgtagtgatgtaaaatgtttcctgttggcactyacacgggcctgacttaagtcacccccaagtgatttcactgcaccctagttgcggcccaacaacacaactaggtaacctgataaatttcccaatatcctaagcacttttctggaacatgactagactaggaacccactgaaagctgactaatgatgttacatctagcagcttgataactaacaacccgaccttggatctatttgctatcatttttgacagcccagcctcttgctgccagtcgaaagagccatactctataaagcaataataacttgacacttagcagagttcccaaacgtt

SEQ ID NO: 63297 - DNA, 601 bp, Human
gagaccaacatggtgaaaccccatctctactaaaaatacaaaaattagccagccatggtggcgcacctgtaatcccagctacttaggaggctgaggcagaagaatcatttgaatcgggaggcagaggttacagtgagccgagatcacgccactgcactccagcctgggcaacaagagcaaaactccatctagaaaaaaaaaaaaaaaatcatggtatctaaggttaattggtacagagaataccagttctctatcgataattgttccacatgcacagattttagtcaagatgtaagagaawctaaaataagccaatacacacaacctttaaataaaaacaggtttcattacatattctacaaattttgcagtatgtctggatacttatagcagtatcacatgatatttaaactaggacaacgtatccaatgcctatattggaggcttagaatagaacttaaaggaaaaatctgtgctagacatttggcatcctagaaactgggtgttaagaatgtagtctggggccgggtgcaatggctcatgcctgtaatcccaacactttgggaggccaaggcaggtggatcacttgaggtcaggagtt

SEQ ID NO: 63298 - DNA, 601 bp, Human
aaaaaagaatgtagttcatgccagttgcagcagcttgcgccttgtaatcccagcactttgggaggctgaggcaggtggatcacttgaggtcaggagttcgacgccagcctggccagtgtggcaaaattgtctctactaaaaatgcaaaaattacctgggcatggcggtgcacatctgtaatcccagctccttgggaggctgaggaaagagaatcacttgaacccaggaggcggaggttgcagtgagctgagatcacgccactgcactccagcctgggtgacaaaacgacacaatgtttcaaaaaaaaaaaaaaaagattaaaaaaaatgtagtctagattaagatttaagaagtattcttttgtctctaaggcagatttaaagaaatttatatggtttgtaagagtcagacatacctttcaaatactttcagtaggtaaatcacaattccaaatattttcccacatagctaatgagaatgctaattcccattcaagaagccaaccaactgattgcaaattggtgcttttacctaccactctggtctgttgctgtttattgatttattttttaaaaataattttgtgaactttaatatttgg

SEQ ID NO: 63299 - DNA, 601 bp, Human; identical to SEQ ID NO: 22183

SEQ ID NO: 63300 - DNA, 601 bp, Human; identical to SEQ ID NO: 22184

SEQ ID NO: 63301 - DNA, 601 bp, Human
agatctttgaaactatagaatgcattcaaactgatttgttctttagttttcgttacttttaaataaactatattacaaaagtgtcaaatagcaaaatattttaattttctcaaattcagggaagatgctttatgacgtacctgcttttcgatttgttccaagacctttggcaaattactttagaactccataggtatcttgaggataactgaaccttttcctaacttaaatcatagactgccagacggaaaaaaaatgtcctcgatgtttttagtctcttactgcacaatgtcaagatatyagctgggttatacaatagttgccctctgcatactcacaaatgttaactccagtccttttttgtcttccctccccgcctaagaagctaccaggtcacatgctggcggatacgcagtggcggaaacctagcggtgacagggaaggacagccctctgcctactgatctgcaggtttctcctccagtttgctcttacaccggggtcctccgctcggaccttagcccattcatttgatgattctctcccagttcgttcttccactgggtcccttgctcagcactacccaaaataaccaccagctc

SEQ ID NO: 63302 - DNA, 601 bp, Human
tgctaacatttggtattatcagccttttggattttagctattctagtgggtgtatagtgcctcgttgtaattttaatctgcattttcctgagaataatgtttaacatttgtgctaaattttgattatacatatacatatttttcaattgtaacaatgtaataatctctggcaaatatctttattataacttttatttctgtatttctatattattttatgaggaatattatacaatttgaacactacaagccacagaaaatgatcagtttatggaactaagtccgacttccaggtaaaacrtaactatggtatggtatttacagtttgtgttgactaaaataagctcccggctgccagatggagctataaggttgccacctctactgccaccatctggtaacattaaaaacaaataaaaatatagaaactatacaattctgggttagccaaagtcaaatttccaacacaactctttctcacgcacagatctttgaaactatagaatgcattcaaactgatttgttctttagttttcgttacttttaaataaactatattacaaaagtgtcaaatagcaaaatattttaattttctcaaatt

SEQ ID NO: 63303 - DNA, 601 bp, Human
tgttctgttttgtttacttctttgtatctccagtgtctagagccgtgtatgggagaattagcatgctgacacaattctactttctacacttgtattctacttatggaatagtcatgacggtaattaagacagacagactcataatcctatcaaatcttcagatctactaattaccaatttacagtaaatcaggagggcagaagatgttaaaggacaacataaggatataaaattgcagggaaaagaaaaggagcggggcaggggaaacagattaaaagagacaaaaaacatttcaatcatytggaaggtatggacattattgagatcctgatttgaacacactataaaaaattaggacataggcccggcccggtggctcaggcctgtaatcccagcactttgggaggccaaggcgggtggatcacctgaggtcagaagttagagaccagccttgccaacatggtgaaactccgtctctactaaaaatacaaaaattagctgggtgtggtggcgtaggcctgtaatcccagctactcgggaggctgaggcaggagaatcacttgaaccggggaggctgaggctgcagtgagccgagatcgca

SEQ ID NO: 63304 - DNA, 601 bp, Human
aagaaaaaaattagccaggtgtggtggcacatgcctgcagtcccagttcttcaggaagcttaggtaggagggtcacttgagcctgggaggttgaggctgcagtaagacctgtttgagccactgcattctagcctgggcaacagagtgagatcctgaaaaaaaaaaaaaagaaaataaagtgttggactttgattgtaacccaagaagaaagcaaaatggagagggctgaaagtttaggaaaatatacactagaatataaaagtctataagggcaggagcttttgttctgttttgtttactgctttgtatctccagtgtctagagccgtgtatgggagaattagcatgctgacacaattctactttctacacttgtattctacttatggaatagtcatgacggtaattaagacagacagactcataatcctatcaaatcttcagatctactaattaccaatttacagtaaatcaggagggcagaagatgttaaaggacaacataaggatataaaattgcagggaaaagaaaaggagcggggcaggggaaacagattaaaagagacaaaaaacatttcaatcatttggaaggtatggacatta

SEQ ID NO: 63305 - DNA, 601 bp, Human
aaagagcaagactccgtctcaaaaaaaaaaaaaaaaaaaaaaaagaaaaagaaaaaaattagccaggtgtggtggcacatgcctgcagtcccagttcttcaggaagcttaggtaggagggtcacttgagcctgggaggttgaggctgcagtaagacctgtttgagccactgcattctagcctgggcaacagagtgagatcctgaaaaaaaaaaaaaagaaaataaagtgttggactttgattgtaacccaagaagaaagcaaaatggagagggctgaaagtttaggaaaatatacactagratataaaagtctataagggcaggagcttttgttctgttttgtttacttctttgtatctccagtgtctagagccgtgtatgggagaattagcatgctgacacaattctactttctacacttgtattctacttatggaatagtcatgacggtaattaagacagacagactcataatcctatcaaatcttcagatctactaattaccaatttacagtaaatcaggagggcagaagatgttaaaggacaacataaggatataaaattgcagggaaaagaaaaggagcggggcaggggaaacaga

SEQ ID NO: 63306 - DNA, 601 bp, Human
gtagttttggtaaaaatttcacacatgagagcctgaactataagaaagttcattaaaacatggaggtagtagttttatcacctttgctgagaaaaagatctattccagattcaaactgaacccctactccttgtcagctggcaaagatatacggcatgagaaaagcaggtaaggaggtttaatggcattactatttctgaaaaactatctgaaacatggtcaataagtacttgagtacttacaatgacatgatatattactgattatgagttagtagccatctcattgttaaatgtagcayagcaaaaaaaatttactgccaagggtagggcatgaaatttctcttgataaatttcttacctcgaagagtatcctcaaaggctgggtttgaatcagaagccatgattaatacttaaagccatcgtaaactaaatgcatttaagaatctagaagcaaacttgcagaacctatgacagttgcagcatctgtgacagttgctcagtagttatcaagcgtaaagggctcacagtaaaaagggaaatcagtgaatgtaccaccatgattaaaaaaaaaggatgccgggcacagtggctcacgcctg

SEQ ID NO: 63307 - DNA, 601 bp, Human
atgttgcttaggctggtcttgaactcctgggctcaagccatccacccacctcagcctcccaaagtgctgtgattataggcattggccaccatacccggctgctttaattaaaaaagttaattacatgatattgtctaaataatgaaaaaggttgctttttaaaagtacaaaaataattatgaaaaaatgttaaagaatattcttagattaagcaaatctaagaaacatttgtcaaagattagctgtttctcatatctgtagttttggtaaaaatttcacacatgagagcctgaactataaraaagttcattaaaacatggaggtagtagttttatcacctttgctgagaaaaagatctattccagattcaaactgaacccctactccttgtcagctggcaaagatatacggcatgagaaaagcaggtaaggaggtttaatggcattactatttctgaaaaactatctgaaacatggtcaataagtacttgagtacttacaatgacatgatatattactgattatgagttagtagccatctcattgttaaatgtagcatagcaaaaaaaatttactgccaagggtagggcatgaaatttctc

SEQ ID NO: 63308 - DNA, 601 bp, Human
ttaaacaagcacatggaacaattccaaagagcaagaatttaaatcaagccacaaacttcatgtgaatagaacctgtgttttcattagtaacagcacacagcaaggtactaatgaagatttagtgactgatctgagtatctgacatttttaatgcagtgtagctgtataacaaagccaacatgtcaagaaccattccgggatttctttctactgctgatataaggcagatgaagataagtagcagggtcaacaaaagcactttgcaaagaaaaagacacaaagcaaactcttacttttcctyatttagggtaccaatttgcagtttatctgtggaattctaggatttcatgtacattccagcagtattgtccctgaaggtcacaggttggagtggagaaagtgagtgatgtgtacccaaatgttactcagcaacattattaaagtcaaatataaagattttcggagagatttattttgtttagagagaaaccctctttcctgcttgaatgctctgcttgtgaatgatagaggagattcatctaagtatgaactagtatcttcgtgagcactgaaaatgggtgaaaatttatttatttattta

SEQ ID NO: 63309 - DNA, 601 bp, Human
agcagaaaactgtagtggctgagctaggctttgggaaccaggcttggttttaatcctagctctattacttaccgaatgtgtgatctgggaagaggaaatgaaataggcacataaaataaggcttgatgtacagttagtgttcacttagtgctggctattaacatgcataaatgtagatattaataatatctccccatttcagacgaagcacttaaacaagcacatggaacaattccaaagagcaagaatttaaatcaagccacaaacttcatgtgaatagaacctgtgttttcattagtarcagcacacagcaaggtactaatgaagatttagtgactgatctgagtatctgacatttttaatgcagtgtagctgtataacaaagccaacatgtcaagaaccattccgggatttctttctactgctgatataaggcagatgaagataagtagcagggtcaacaaaagcactttgcaaagaaaaagacacaaagcaaactcttacttttccttatttagggtaccaatttgcagtttatctgtggaattctaggatttcatgtacattccagcagtattgtccctgaaggtcacaggttgga

SEQ ID NO: 63310 - DNA, 601 bp, Human
tttctagtaggtgggtgagtcataacaatatagatatacagtatttagaagtgaatgaaaaagaactgacagtcgtaaacttcaagaaggcttgcaattttataaaactagactgcaggatgagctgccagaagctttataataactatgaccaagaaggctcacaaaagaatcacaaaaaaggcttgggtatctctgagcctactatggctcgggaggctgccgtccccccggccctgcctccccctcccaaaaaaagagtcacaggcttaatccagaaagctattaagcagaaaactgyagtggctgagctaggctttgggaaccaggcttggttttaatcctagctctattacttaccgaatgtgtgatctgggaagaggaaatgaaataggcacataaaataaggcttgatgtacagttagtgttcacttagtgctggctattaacatgcataaatgtagatattaataatatctccccatttcagacgaagcacttaaacaagcacatggaacaattccaaagagcaagaatttaaatcaagccacaaacttcatgtgaatagaacctgtgttttcattagtaacagcacacagca

SEQ ID NO: 63311 - DNA, 601 bp, Human
cttttctcttactggcatgtaagtacatataaatgagattttgaaccactattttggactgaagaacatgcaaactttctagtaggtgggtgagtcataacaatatagatatacagtatttagaagtgaatgaaaaagaactgacagtcgtaaacttcaagaaggcttgcaattttataaaactagactgcaggatgagctgccagaagctttataataactatgaccaagaaggctcacaaaagaatcacaaaaaaggcttgggtatctctgagcctactatggctcgggaggctgccgyccccccggccctgcctccccctcccaaaaaaagagtcacaggcttaatccagaaagctattaagcagaaaactgtagtggctgagctaggctttgggaaccaggcttggttttaatcctagctctattacttaccgaatgtgtgatctgggaagaggaaatgaaataggcacataaaataaggcttgatgtacagttagtgttcacttagtgctggctattaacatgcataaatgtagatattaataatatctccccatttcagacgaagcacttaaacaagcacatggaacaattccaa

SEQ ID NO: 63312 - DNA, 601 bp, Human
tcctttaagaccttcacagagcagctcttttctcttactggcatgtaagtacatataaatgagattttgaaccactattttggactgaagaacatgcaaactttctagtaggtgggtgagtcataacaatatagatatacagtatttagaagtgaatgaaaaagaactgacagtcgtaaacttcaagaaggcttgcaattttataaaactagactgcaggatgagctgccagaagctttataataactatgaccaagaaggctcacaaaagaatcacaaaaaaggcttgggtatctctgarcctactatggctcgggaggctgccgtccccccggccctgcctccccctcccaaaaaaagagtcacaggcttaatccagaaagctattaagcagaaaactgtagtggctgagctaggctttgggaaccaggcttggttttaatcctagctctattacttaccgaatgtgtgatctgggaagaggaaatgaaataggcacataaaataaggcttgatgtacagttagtgttcacttagtgctggctattaacatgcataaatgtagatattaataatatctccccatttcagacgaagcact

SEQ ID NO: 63313 - DNA, 601 bp, Human
aggggcatccaatccaacattgcatcgttctggtatgcaggccctttttcccaaaggttgatatatacataacatattacagcaaaatttggtaattgttatctcacctgcatatgaaatgctaagaagtttgcttctttcaagagggggagcccaagaagaccacatggcatgcatggctggaaatgtaacaccctgagagaagggaacatgatatttctgatgaaatgtaaggtagttttgttaatgctttaaagtaagttaagtattttgctacaaaagcattttctggataagaatmaaacgaatcaggttccatgaaatgagaaatttttacagtgttaagtgaaaatatcttataatgaagtactttcagaatttgaggctgggtgtggtggctcatgcctgtaatcccagcactttgggaggccaaggcaggaggattgcttgagcccaggagttcgagatcagcctgggtaacgtagtgagacaccatctcttaaaaaaaaaaagtaaaactccccaaagattcatggattttggaactggttttaagacaacaagataagggttacaataaatctaaaataattgtactgag

SEQ ID NO: 63314 - DNA, 601 bp, Human
gtaaacagaaaaagaaaaaaaatagcatctctataccaatatctgaaaacacaacatactttgaaatagatgatggcagatggggaaaatgacattagtcaattaagctgcattactataagttgttgagccaaagagaaaaattggtaataaagttatactaccgaaacttaatgttctccccaaaggggcatccaatccaacattgcatcgttctggtatgcaggccctttttcccaaaggttgatatatacataacatattacagcaaaatttggtaattgttatctcacctgcataygaaatgctaagaagtttgcttctttcaagagggggagcccaagaagaccacatggcatgcatggctggaaatgtaacaccctgagagaagggaacatgatatttctgatgaaatgtaaggtagttttgttaatgctttaaagtaagttaagtattttgctacaaaagcattttctggataagaatcaaacgaatcaggttccatgaaatgagaaatttttacagtgttaagtgaaaatatcttataatgaagtactttcagaatttgaggctgggtgtggtggctcatgcctgtaatccc

SEQ ID NO: 63315 - DNA, 601 bp, Human
actaaccagatccacaaaagaaaccaaaatattccaatagtaccttaaaatagaaaaataatagttagataaaattagaatgtaccaaataacaaacaaaacaaaacaaaaacacaaaattagaaagcaccaacaacaatttttacatgtcttgaaaaaattatgtaactataaattcaatgtaaaactgacttcagtttggattcaatttcaagtttctctcaattctttaatgggataattgctataactgtattattgcttatacattttgaagaaaacaacttttttttttttttttgagatagagtcttgctctgtctcacaggctggagtgcagtgacgtgatctcggctcactgcaacctccgcctgctgggttcaagcaactctactgtctcagcctcctgagtagctgggactacaggcacgtgccaccacgcctggctaatttttgtattttgagtagagatggggttccaccatgttggccaggctggtcttgaactcctgacctcgtgatccacccgcctcggcctcccaaagtgctgggattacaggtgtgagccactgcacccagccagaagaaaacaacttttaac

SEQ ID NO: 63316 - DNA, 601 bp, Human
gaggccaaggtgggaggatcgcttgaggccaggagttcgagaccagcctggccaataaggtgaaatcccgtctctactaaaaatacaaaaaattagctgggagtggtggcatgcacctgtaatcccagcaactcaggaggctgaggcaggagaattgcttgaaccagggagatagaggttgcagtgagctgagattgtgccactacactccagcctgggtgagagagcgaaactccgtctaaaaaaaaaaataaataaaataaaataaaatatcaatcatgacaatttaataggaaaagtyttaaatattttatgttcttaaactaataaagtgactttgaagccaacaagaatgctgaaaacaaactgtgtatattttaatctttcctaatgtttttatgttcttcttttattctactcaaaaggcaaacattttgtttccatggtttgagaatttagtatattgaattattatagatttttatttgtgatttgcctttgtgctcgattaagtgattgaaatctggttttaataagatataaacttttttctaaagacctactctagaagagcaaacagatgtatatcatattataatat

SEQ ID NO: 63317 - DNA, 601 bp, Human
agcctgggcaaaaagagcaaaactctgtctcaaaagaaaaaaaaaaaaaaagaaaaaaagcagtcctgggctgcggtaagctaaactgtcctggttctaacatctaggcctggggttgtcctgttgaaccgaaaccaggccactctatgagcatgctggagcaagacaaaaataagaccactttacagtgagctgagatcaccccactgcatgacagtccgggagacagagcgagaccctgtctctaaaaagaagaagaaaaagaaaaaaaaccactccacagtcatgtctgagcacagayaaaaacacaaatgccataaactacaaaaaatgcgaaacatcttcctctcccagctaatatgagtgactgctgtgcccttactaatcacagctttaccccaccttctagataaaaattcatcatagaattatcaaatccagagcaaaatattgattctttaaacccttcccaaagtcacctactgcaagtctaaactgcaacaagttcctctcaactctgcactaagatgccccatggttcttcatggtgtgctttcttcctcactgcaacgaaccaagaaacccaacttgttcaactaca

SEQ ID NO: 63318 - DNA, 601 bp, Human
ttaatttctgtcttaatttgacaactaaatattcaaaccaaggtccccatttgatttgcttcgcaatgctgcaaaattgtatactcttcctaaaaggcataaaggagaagtaaaacagttacaaaacatgctatcttcaggctgggcatggtggctcatgcctgtaatcccagcactttggaggctgaggcaggcagatcacttgagttcacaagttcaagaccagcctgggcaacatggcaaaaccctgtctctacaaaaaatacaaaaattagccaggctttgtggtacacacctgtcrtcccaactacttggtaggctgaggtgggaggatggcttgaacccgggaggcagagggaggctgcagtgagccaagatcatgctactgcactccagcctaggcaacagaaccagactttgtgtcaaaaaacaaaacaacacacaaacaaaaacaaaaaacaaacccagaaccaaccaaacaagaaaaccccatgatatccttggaattaagaaaagaagaagaagccgggtgtggtggctcacgcttgtaatcccagcactttgggaggccgaagctggtagatcacctgaggttgggagt

SEQ ID NO: 63319 - DNA, 601 bp, Human
tgagatagtgccactgctctccagcttggggaacagagggagactctgtcctccccacccccaccccccaaaaaggaaaatacatacaggcaaaaaaatttaaaattgctcagatcatttgctcagccaacattttgaaagcaaatatactttggagatttaaatgataatggaatttgtgaaggaaaaatcaatgagatcctgaatcttgtattcagaatgtatcatcgaatttctaataatagctcaatcaactttttttccatataagttgaaacagaaaaggacaaactataaaaaytatttgtcatgaaatgtgtgaaatatagagggtaagatcactcgacaaatacttgaatatattctaatatgccatttaaaaaaaatttttcttgtcaaatgcaagtaacagcaaattgatttagcaaagttacatgtaaaaaatgctcttaatttctgtcttaatttgacaactaaatattcaaaccaaggtccccatttgatttgcttcgcaatgctgcaaaattgtatactcttcctaaaaggcataaaggagaagtaaaacagttacaaaacatgctatcttcaggctgggcatggt

SEQ ID NO: 63320 - DNA, 601 bp, Human
tcggctcactacaacctccgcctcctgggttcaagtgattctcccacctcagcctcccgagtagctgggattataagcactcactgtcatgcctggctaatttttgtattttggtagagatgggggtttcactaagttgaccaggctggtcttgaactcgtgacctcaggtgatccactcactttggcctcccaaagtgctgggattacaggcgtgagccaccacgcctggccagaactaatttttttttttttcttgagacggagtctcgctctgtcgccaggctggagtgcagtgtcgwgatctcggctcactgcaacctccacctcccaggttcaagtgattctcttgcctcagcttcctgagtagctgggactacaggcgcgtgccactatgcctggctaatttttgtatttttagtagagatgggatttcaccatgttggccaggatggtctcgatctgttgacctcgtgatctgcgtgcctcagcctcccaaagtactgggattacaggtgtgagcgaccgtgcctggccaaaactaaatttttaattaaattagttaaattaaaaatataacagccacgtggagctagtggcta

SEQ ID NO: 63321 - DNA, 601 bp, Human
gagctgtatgtctaacacataagcccttcacatggcaggttctcaatagctgcttatcaaacgaatacaaggctcacagggttagaggcttagaaagaagaatgtgaaatgtatgtattccagcttagtgttcatttgtaatctaggtacaacacaacagttttctgttctcccaatatgaattgtaagatcaacttatagtatttccacattacaagttatatttcagggggaaagtcttcatttataaaaactttcaagttaaagatgaattttcaaatgttactaggagaaactatcygcgtatctagcagacatttataaaaaaatccttcaagagtttaaggtagtgctgtccagtagaactttccatgatgatggaaatgttttatatgcacattgtccacagggtaaccagtagttacatgtggttattaaatcttgtccttctaacaggttgatgaaagaaaatgaagtgaaacaaaacccttgtcatatgtgtgacatatgtgtgactgaataactaaatttttttatttttagatggagtcttgctctgttgcccaggctggagttcagtggagcgatctcggctcactac

SEQ ID NO: 63322 - DNA, 601 bp, Human
tggccaggctggtggtgaactcttgacctcaggtgatccgctagcctcggtctcccaaagtgctgggattacaagcgtgagccagtgagccattgcgcttggttgtattttttaatatgatcaaagatgtacagatatagggaaagagaaggagagagaacattgattcttttacagcagtggttttcaactccagctatactttacaattataggggcctgtgttctactctctgcctattgaataaacaaaacaaaaacaagtaaggcaaaaaaactctgagtgtagggccaaggaatmtaagttttaaaaggcttcactggtgattctatagagcagtgggttcccaaactttgctgcatataagaatcacccaggggagccttaaaaacactgagaccaaggtcacaccacagaccaattgaataggttgtgggtgggtgggaggtaagtatccctagtttttgaagatccctgggtgatttcaatgtgcagcaagtttgggacccactgctgtagagatcagattttaaaaagtctgcccttatccttcttgattgaaaagctcagggcagagaggattttagagtttgaaggaat

SEQ ID NO: 63323 - DNA, 601 bp, Human
cgaggcgggcagataactggaggccaacagttcgagaccaacctgggcaacatggtgaaaccctgtctctactaaaaatacaaaaattagccgggtgtggtggtgcgcagcagtaattccagctggttaagagtctgaggcatgagaattgcttgaacccgggaggtggaggttgcagagagctgagatcacgctactgcactcccgcctgggcgacagagcgagactctgtctcaaaaaataaaaacaacaaattatttgtaatttttaagttatagcaaagaagtttttttctattaaratgtaaattttatgtatattctgtttatttcatctatcaatcctttaaaaagtctatttctgtatatattttatgatatacataagtatcatagtacatatagataacttaagaataaatatacggccaggcgtggtggctcatgccagtaatcccagcactttgggaggccgaggcaggcggatcatgaggtcaagagatcaagaccatcctggccaacatggtgaaaccccgtctctactaaaaatacaaaaattagctggatgtggtggcgcgacctgtagtcccagctacttggga

SEQ ID NO: 63324 - DNA, 601 bp, Human
tagcatattgcagtttaagtactattttattttattttaagagagtcttgctctgtcacccaggctggagtgcagtggcatgatctcggctcactgcaacttctgcctccccacttcaagtcggattctcctgcctcagcctcacgagtagctgggactatgggcatgcaccaccatgcctgactaatttttgtattttcagtagagacaaggtttcactatgttgcccaggctggtctcgaactcctgacctcaggtgatccacctgccttggcctcccaaagtgttgggattacaggcrtgagccactgcacctggcctatgtatttttttttgagatggagtcttgctctattgcccaggctggagtgcagtggtgcaatctcagctcactgcaacctctgcctcccgggttcaagcaatctccggcctcagccccccaagtagctgggattacaggtgtgcaccaccacatctggctaatttttgtattttagtaaaggcggggtttcatcatgttggccaggctggtttcgaactcctgacctgaagtgatctgcctgcctcagcctcccaaagttctgggattacaggtgtgagc

SEQ ID NO: 63325 - DNA, 601 bp, Human
tgagttcaagtgattctcctgcctcagcctcccaagtagctgggattataggcatactccaccaggcctggctaatttttgcatttttagtagaaacggggtttcaccatgttggttaggctggtcttgaactcctgactgcaagtgatccgacccaaagtgctgggattacaggcgtgagccaccgtgcccggcctgaattctctatttctaaaatatagtttcacggtcagattcagaggttgacataaggataaaggaaagagattggaaggtcctgttagaattcatgtttaattayccaatctttattcaattgaaatgatttataaaaattaggcaatacaaggtttctgtatgcagccatatgcagtagtggtctttaaagcagggtaaaagcaccataggggtatgcaagatgatctgttggggtgaggaaagacatatttctatttatttccatttttactcatttttattataaaaataaaaaaacacactctattaatatttaataaatatgttggccctggagtatgtcaggtgattacaaatcgtatgagtcccccaattcagagaggttaataatggcatcctcact

SEQ ID NO: 63326 - DNA, 601 bp, Human
gtcaccacaatttccgcttcccgggttcaagcaattctcctgcctcaacctctcgagtagctgggattacaggcatgcactaccacgcctggttaattttgtatttttagtagagatgaggtttctccatatttgtcaggctggtctcaaactcctgacctcaggtgatccgcctgccttggcctcccaaagtgctgggattataggcgtgagcgaccgcgcctggccttttttgtatttttaacagagacagggtttcaccatgttgcccggtctggtctcaaatgcctggcctcaagtratccacctgcctcgacctcccaaagtggtaggattgcaggcgtgagccactacacccggcctgatgtcgggcatccttacatgtgcttattggccatctgtgtatctttggagaaatgtgtattcgtattcaagtcctttgcccattttaaaaactgagttgtctttttattattgaattgtaagaattcttaatatgtctggatactagacccttattagatgtttgatttataaatgctttctcccattcagtgggttgtttttcattttcttaatagtcctttgatgtataagaatc

SEQ ID NO: 63327 - DNA, 601 bp, Human
ttctcctgcttcagcctctcgagtagctaggactacaagtgcctgctaccatgcctggctaatttttatatttttagtagagatggggtttcacatgttggccaggctggccttgaactcctgacctcaagtgatccacccacctcggcctcccaaagtgctggtattacaggtgtgaaccactgggcccggctggatttgctatttttaatcttcctgtggatctcagttttaccccaaatgataattaccaaattaacctttcaatgcacagttgaatgcaattaatcactgtagtagkatattatttatttctttcttttttaaaaatcagccccactttatagttgaaatgtagtagtagattataatcaggctctgttaacagagaacttgggaaaaataagattgctcacaatgaatccatcccattatgttgccaaagcctagtttcaatttaacttctgtcagtgcaatttgtggaaatatttctatatagtgatcttgtttttcagaagtagacagaggagttcttcacagcttagctgcctgaagttttaaggtttggtccacatagccaggccaatgtttatggtatact

SEQ ID NO: 63328 - DNA, 601 bp, Human
aaagtacacaacattaattactggccagctattgatattttatttcttccatatatagttcttcctggaaaatctcaaatagaaacatcagtgtagtaatctttaaatatactttataagtaaaataagatattttgttaatatgattttgagaatttgtttttttttttttttttttgagatggagtcttgctctgttgcccaggctggagtgcaatggcatggcctcagctcactgcaacctctgcctcctgggttccagtgattctcctgcttcagcctctcgagtagctaggactayaagtgcctgctaccatgcctggctaatttttatatttttagtagagatggggtttcacatgttggccaggctggccttgaactcctgacctcaagtgatccacccacctcggcctcccaaagtgctggtattacaggtgtgaaccactgggcccggctggatttgctatttttaatcttcctgtggatctcagttttaccccaaatgataattaccaaattaacctttcaatgcacagttgaatgcaattaatcactgtagtagtatattatttatttctttcttttttaaaaatcagcc

SEQ ID NO: 63329 - DNA, 601 bp, Human
aataatgggaaaccccatctctactatttaaaaaaaacaaaaacaaaaacacctaggccatttcatgaatgtaacacattgattttcaagaaaaaaaatcaattaaaaaataggctatataattatagaattattttcaaactctattcacatttctttttattttacagaatgaaagaaggtcctatattcacatttcttttaattttaattaagataaacctttttgtctatgaaaatgcaagataaaagatccttgttttaaagtacacaacattaattactggccagctattgataktttatttcttccatatatagttcttcctggaaaatctcaaatagaaacatcagtgtagtaatctttaaatatactttataagtaaaataagatattttgttaatatgattttgagaatttgtttttttttttttttttttgagatggagtcttgctctgttgcccaggctggagtgcaatggcatggcctcagctcactgcaacctctgcctcctgggttccagtgattctcctgcttcagcctctcgagtagctaggactacaagtgcctgctaccatgcctggctaatttttatattt

SEQ ID NO: 63330 - DNA, 601 bp, Human
gcctattctacttcccttaaacaaacaaacaaaaaaagcttggctgggcacagtggctcatgcatgtaatcccagcactttgggaggccgcggaggaagaatcacttgaggacggggctcaagaccagcctggtcaacatggcaaaaccctgtatctactaaaaatacaaaaaattagctgggcatcatgatacatgactgtaatcccagttacttgggaggctgaggcagaagaatcgcttgaacctgggaggtggaggttgcagtgaaccaagattgctctggtgcagtcagtccagcrtgggtgacagagcaagactctgtctcagaaagaaaaaaaacaaaaaaaagaaaaaaaaacacaattccatttagacttctgcacggtgggatcacatctatcattatttgtggcaaaatcctgtataagaataaatggtttcaaaatattagtaggaaagtaaaaaagaataagctgtagtaaatcagataagtgaattttctgatcttgattttgtttcctggtgggataaggttgataattcctcacagttagtaatattgccacttcaagttgcaatgctaaaaactgccggctagg

SEQ ID NO: 63331 - DNA, 601 bp, Human
ataactcaaaagtgcattacatgtttatttactacacacacacacacacacacacacacacacacacacacacacacagcttatttttaacagaactggagagtcttttttttttttttcttttgagacagagtcttgctctgttgcctaggctggagtgcagtggcgtgatctcggctcattgcaacctccaccttctgggttccagcaattctcctgcctcagcctcctgagtagctacgattgcaggcgtgtgtcaccacgcccggctaatttgtatttttagtagagacggagtttygccatgttggccaggctaatctcgaactcctgacttcaagtgatctggccgcctcagcctcccaaagtgctgggattacagggatgagccaccgcgcctggcctctgagagtctttcctgatggtttcttttccctcatatttcgcgtccaatcatcaagcattgcctattctacttcccttaaacaaacaaacaaaaaaagcttggctgggcacagtggctcatgcatgtaatcccagcactttgggaggccgcggaggaagaatcacttgaggacggggctcaagaccagcctggtca

SEQ ID NO: 63332 - DNA, 601 bp, Human
tagtcttggccattaaaatttttttgatttgccttttatgtctctttaaatctgtaagttcccttccattcatttttttcttacaatttatgtatttcttaaaatttatcggtgcccagtaaaaccataactcaaaagtgcattacatgtttatttactacacacacacacacacacacacacacacacacacacacacacacagcttatttttaacagaactggagagtcttttttttttttttcttttgagacagagtcttgctctgttgcctaggctggagtgcagtggcgtgatctyggctcattgcaacctccaccttctgggttccagcaattctcctgcctcagcctcctgagtagctacgattgcaggcgtgtgtcaccacgcccggctaatttgtatttttagtagagacggagttttgccatgttggccaggctaatctcgaactcctgacttcaagtgatctggccgcctcagcctcccaaagtgctgggattacagggatgagccaccgcgcctggcctctgagagtctttcctgatggtttcttttccctcatatttcgcgtccaatcatcaagcattgcctattcta

SEQ ID NO: 63333 - DNA, 601 bp, Human
ttcctccccccttaaataagcattaacctcgttttggtgtatagtaatcatgtactcacttttatttatagttacatcacccaaatgtacatccctagacacttcgatttagtcttggccattaaaatttttttgatttgccttttatgtctctttaaatctgtaagttcccttccattcatttttttcttacaatttatgtatttcttaaaatttatcggtgcccagtaaaaccataactcaaaagtgcattacatgtttatttactacacacacacacacacacacacacacacacacrcacacacacacagcttatttttaacagaactggagagtcttttttttttttttcttttgagacagagtcttgctctgttgcctaggctggagtgcagtggcgtgatctcggctcattgcaacctccaccttctgggttccagcaattctcctgcctcagcctcctgagtagctacgattgcaggcgtgtgtcaccacgcccggctaatttgtatttttagtagagacggagttttgccatgttggccaggctaatctcgaactcctgacttcaagtgatctggccgcctcagcctcccaa

SEQ ID NO: 63334 - DNA, 601 bp, Human
cttcctccccccttaaataagcattaacctcgttttggtgtatagtaatcatgtactcacttttatttatagttacatcacccaaatgtacatccctagacacttcgatttagtcttggccattaaaatttttttgatttgccttttatgtctctttaaatctgtaagttcccttccattcatttttttcttacaatttatgtatttcttaaaatttatcggtgcccagtaaaaccataactcaaaagtgcattacatgtttatttactacacacacacacacacacacacacacacacacacacacacacacagcttatttttaacagaactggagagtcttttttttttttttcttttgagacagagtcttgctctgttgcctaggctggagtgcagtggcgtgatctcggctcattgcaacctccaccttctgggttccagcaattctcctgcctcagcctcctgagtagctacgattgcaggcgtgtgtcaccacgcccggctaatttgtatttttagtagagacggagttttgccatgttggccaggctaatctcgaactcctgacttcaagtgatctggccgcctcagcctccca

SEQ ID NO: 63335 - DNA, 601 bp, Human
gcagcttgaccagacaggatcatacataaccaagagcctaaataaggcaatgaagataaaaacccattctggaaggaataagaagatacaggattaattacggtgagagaaaaaaacaaaacatacacattcatcacagccaatgaccaccactcgaaagcaaaggaaatgcatagcaatatgttgttaattttttaatataattacagtaaataagtctggctgtcagaaggattatagggttcagtccaaggcagtccctaagagtctgtctcagagggaaataagccttgccctagtyctgtctgcttcgggtaatcttgactgtttctctgggatctgggttgtgagagaagacaaaccttcctgttagcctatggattctccctactgaacattttcatcttccattctcactcatttatttaaaaaaaattttttttactataaaataaaatgcagatgcagaaaaccacataaacatagcttaatgaatcattctttttttttttttttttttttttgagatggagtcttactctgtcactcaggctggagtacaggggtgtgatctcgactcactgcaacctctgcctcctgg

SEQ ID NO: 63336 - DNA, 601 bp, Human
cataaaataaagtgtttctctgagttctctgagatgctctagcagattaactgaacctgacaagacagtcatgggaaccctgatttatagccggtcagtcagaagcagaggtcacaagctgggacttgtgattggtatccgaagtaggggggcgatcttgtggaactgagccctcaacctataggatctgatgctaccgccagctggacagtgtcagaactgaattacaggatacctagctggtgtccgctgcagaactggttatgtgtaggcagaaatccccacaaacattttggtgatyagagcgaggtgttctgtgttgagtattgtgttaactgtgtgtaaaagtgggaaacacactttgttttcctatctcctataactgtaaacatggtaaataactgtaaaccaaaacaaaacctgattgcttcacttacctataaggctaaaaattctgcgaacacataaagttgaaaaattccattttgcccttaaattgtcagcagcttgaccagacaggatcatacataaccaagagcctaaataaggcaatgaagataaaaacccattctggaaggaataagaagatacaggattaatt

SEQ ID NO: 63337 - DNA, 601 bp, Human
tctgctcacctcagcctcccaaagtgctaggattacaggcataagccactgcgcccagtgaatattataaatcttaatcctcaaaatgtatgattcaaaaagaaacatattgtaaagaaatgcacttaaatgcatcatagtgttttgttatgtgaacaaaataaaagactaatattatcatttttattttgtcttgaactgttgtgatattgtgattttaaaaaatatggctgggggctgggtgtggtggctcacacctgtaatcctagcactttgggaggctgaagcagcagaattgctkaaggccaggagttcaaggccaatgtgggcaataaagcgagaccttgtcccattaaagaaagaaattaaacaaaatggctggggctgggtgtggtgcctcactcctgtagtcccagcactttgggaggccaaggcgggcagatgacttgagttcaggagttaaagaccagcctggacaacgtggtgaaaccccgtcttcagtaaaaattaaaaaattagctgggtatggtggtgtgtgcctgtagtcctagctactcaggaggctgaggtgggaggatcacctgaggctgaggaggttgag

SEQ ID NO: 63338 - DNA, 601 bp, Human
ttaaaagttacctttctaggccaggcacagtggctcatgcctgtaattccagcactttgaaaggctgaggtgggaggatcgcttgagcccaggaatttgtgactaacctgagcaacatggtaaaaccatgtctctacaaaaaatcaaaaataattagctgggtgctgtggcgtgacctgtagtcccagctgctcaggagactgaggtgggagaattacttgagcctagaaggttgaggctgcagtgagccatggttgtccatcttggccaacggagcaagaccctgtctcaaaaaaaaaaattacctttctgaaagcagagtctgaaacacatgattatttatgggttctttgagttctttgatttatagctccttatttgatataataatgctagtaaatatttttggattgaaacttaaaatgcattcacttagaaaagggatggaggcttaaaaatactttgattacatcttgtctaaagttgatataaaaatcttcattgcaaagtctgagctgaaagcacagtgatatataaaattgtgagggatgatgtttggcacagcaagccattttaaaaataattataagccatggtggag

SEQ ID NO: 63339 - DNA, 601 bp, Human
cagatacataccatcatgcctaactgattagatagttttaaaagttacctttctaggccaggcacagtggctcatgcctgtaattccagcactttgaaaggctgaggtgggaggatcgcttgagcccaggaatttgtgactaacctgagcaacatggtaaaaccatgtctctacaaaaaatcaaaaataattagctgggtgctgtggcgtgacctgtagtcccagctgctcaggagactgaggtgggagaattacttgagcctagaaggttgaggctgcagtgagccatggttgtccatcytggccaacggagcaagaccctgtctcaaaaaaaaaaattacctttctgaaagcagagtctgaaacacatgattatttatgggttctttgagttctttgatttatagctccttatttgatataataatgctagtaaatatttttggattgaaacttaaaatgcattcacttagaaaagggatggaggcttaaaaatactttgattacatcttgtctaaagttgatataaaaatcttcattgcaaagtctgagctgaaagcacagtgatatataaaattgtgagggatgatgtttggcacag

SEQ ID NO: 63340 - DNA, 601 bp, Human
caagagattttctcaccttagcctctggagtagctgggactacagatacataccatcatgcctaactgattagatagttttaaaagttacctttctaggccaggcacagtggctcatgcctgtaattccagcactttgaaaggctgaggtgggaggatcgcttgagcccaggaatttgtgactaacctgagcaacatggtaaaaccatgtctctacaaaaaatcaaaaataattagctgggtgctgtggcgtgacctgtagtcccagctgctcaggagactgaggtgggagaattacttgwgcctagaaggttgaggctgcagtgagccatggttgtccatcttggccaacggagcaagaccctgtctcaaaaaaaaaaattacctttctgaaagcagagtctgaaacacatgattatttatgggttctttgagttctttgatttatagctccttatttgatataataatgctagtaaatatttttggattgaaacttaaaatgcattcacttagaaaagggatggaggcttaaaaatactttgattacatcttgtctaaagttgatataaaaatcttcattgcaaagtctgagctgaaag

SEQ ID NO: 63341 - DNA, 601 bp, Human
atagtcactgagacttccagggtctctactggagacttttaaaaagttaaatgattgtcttagacagttttatttttatgtacatttttttctaactatttttagagatagggtattgctctgttgcctaggttggagtgcagtgttgtgatcatagctctctgcagcctcaaacaactaggctcaagagattttctcaccttagcctctggagtagctgggactacagatacataccatcatgcctaactgattagatagttttaaaagttacctttctaggccaggcacagtggctcaygcctgtaattccagcactttgaaaggctgaggtgggaggatcgcttgagcccaggaatttgtgactaacctgagcaacatggtaaaaccatgtctctacaaaaaatcaaaaataattagctgggtgctgtggcgtgacctgtagtcccagctgctcaggagactgaggtgggagaattacttgagcctagaaggttgaggctgcagtgagccatggttgtccatcttggccaacggagcaagaccctgtctcaaaaaaaaaaattacctttctgaaagcagagtctgaaacacatgatta

SEQ ID NO: 63342 - DNA, 601 bp, Human
attctcctgcctcggcctcctgaatagctgggacagccacacaccaccacgccaagctaatctttgtattagagatggggtttcaccatgttggccagcctggttttgagctcctgacctcaagtatctgcctgcctccgcctctgcctcccaaagtgctgggattacaggcaacagccactgagcccagccagggtctttttataatgtaattactgaagtatagtcactgagacttccagggtctctactggagacttttaaaaagttaaatgattgtcttagacagttttatttttaygtacatttttttctaactatttttagagatagggtattgctctgttgcctaggttggagtgcagtgttgtgatcatagctctctgcagcctcaaacaactaggctcaagagattttctcaccttagcctctggagtagctgggactacagatacataccatcatgcctaactgattagatagttttaaaagttacctttctaggccaggcacagtggctcatgcctgtaattccagcactttgaaaggctgaggtgggaggatcgcttgagcccaggaatttgtgactaacctgagcaac

SEQ ID NO: 63343 - DNA, 601 bp, Human
gcaattctcctgcctcggcctcctgaatagctgggacagccacacaccaccacgccaagctaatctttgtattagagatggggtttcaccatgttggccagcctggttttgagctcctgacctcaagtatctgcctgcctccgcctctgcctcccaaagtgctgggattacaggcaacagccactgagcccagccagggtctttttataatgtaattactgaagtatagtcactgagacttccagggtctctactggagacttttaaaaagttaaatgattgtcttagacagttttatttytatgtacatttttttctaactatttttagagatagggtattgctctgttgcctaggttggagtgcagtgttgtgatcatagctctctgcagcctcaaacaactaggctcaagagattttctcaccttagcctctggagtagctgggactacagatacataccatcatgcctaactgattagatagttttaaaagttacctttctaggccaggcacagtggctcatgcctgtaattccagcactttgaaaggctgaggtgggaggatcgcttgagcccaggaatttgtgactaacctgagc

SEQ ID NO: 63344 - DNA, 601 bp, Human
ttcaaggttacagtgagctatgatggcaccactgcactccagcctgggttgtcagagcaagaccttgtttcttaaaaagattttttaaaatctctgtcttcattctctctctcttttttttgagctggagtctcactctgtcacccaggctggagtgcagtggcgtgatctgggctcactgccacctctgcctcctaggttcaagtgattctcctgcctcagcctcctgaatagctggaattacaggcctgggccaccatacccagctaatttttgtatttttagtagagatggggtttcrccatgttggccaggccgttctcgaactcctgacctcaagcgatccacccaccttgcctcccaaagtgctgggattacaggtgtgagccaccatgcccggccttggttttttttttttctgccccacctaatatgcaggaatcctccctattattaacaactgataagaatacacattggtcattacaggcagttaagcgtaaaatatgagaagagacttaatgagtgggctgtcagtttttctgtgtctacagcagtgctatccaatagctctctgtgatgatggaaatgttgtatttgt

SEQ ID NO: 63345 - DNA, 601 bp, Human
ggctacacaaatatatttgcacataggtaatatagttagacaaatcaattgggtctactctttcacattcattcatctgacaaaatgcctactacatgccaagtgccatggagagccctgaggacaataagggagtttctgccttcacagagttcctagtctagttgggtgaacagacacagtaatgagttattgcaatgttctaatgagagcactgtggacagaggtgatgatagttaaaagtttaaatttaaaaacaacttcctgctttaattattgtgtaaattaaaatcctgttaaraatttaaagtcattcctatagtagtcaaatccatagaggcagaaagtagaatgttggttgccagggcctgggaggaaggagaaatgggagattgtgtttaacgggtacagtttctgttgagaagatgaaattgctctagagattgttggtggtgctagttatgaaacaatgtgaatacttaatgccacagaactgcatacttaaaatggtaagttttatatcatatctattttatcaggtttttttttttttagatggagtcttgctcttgttgcccaggctgaagtgcaatgatgcgat

SEQ ID NO: 63346 - DNA, 601 bp, Human
caatcatttcattgtgtgattttataagcagacccagtcttaggacaaaactactactgtaaaagacagagagtgagaaagaaacaatctgtggtgatattagtaggcagctggatatcaactcttgcctgaagcctattatttctggatacaattaagtgaatcaatagattatgctgtttagcccagtttaaattagaatttctatacttcaactaaaaacatcctaagcgataacatagcctagaactatttcttgccaaaactctcaattcccatatccctttgactattcgtcaaycctaggcttgacaaaacctcaagtcttggccaggtgctgtggcccacgcctgtaatcctagcacttcggggggctgaggcgggaagattacttgatgccaggagactgagaccaccctgggcaagatagggagaccccatctctacaaaatattttttgaaaaattaaccaggcatggtgatgtatgcctgcagtcccagcgactcaggaggctgagcaggaaggattacttgatcccaggagttcaaggccacagtgaactacagtggcgtcactgcactctagcctgggtgacagagt

SEQ ID NO: 63347 - DNA, 601 bp, Human
gacctcaggtgatctgcccaccttggtctcccaaagtgccgggattacaggcatgagccattacacccggccgaccatagctccaatttttatccgatgatccaattttctttcattgctagttcaagagagcagggggggccctcatcagattccagagattctaataagacttcaggaacctgatgaatcctaagctacctttcagatttattaaatggtgtgggtgacttaccaccttctggctggatggctgctgaaccaattttatgttccttataatttttttttttttttttttgagatggagtctcactttgtcacccaggctggagcacagtggcacaatcttggctcacagcaacctctgcctcccgggttcaagcgattctcctgcctcagcctcctgagaagctgagactacaggtgtgtgccatcacaccctgctaatttttgtatttttagtagagatggggtttcaccatgttggccaggctgatctcgaactcctgacctcaggtgatccacccgcctcagcctcccaaagtgttgggattacaggcgtgaactaccgtgcccggctcaaaatgactcatgttta

SEQ ID NO: 63348 - DNA, 601 bp, Human
atggtggctctttagtggtcagcattttcctttctgaaagcacaccaatcatcactttaatattttacttggattgatctgtgaccctggtcaccacacctgactcaaagttagccagaaaataattacatctattgcattatatgcaaatacctttattgcattatgagcaaagtgttctgtgcgtgttctatttaatcttcacaacgatcttataaggtaggtaccatggatatttggttttctttttcttcagcatctattttcatcttttgacaatagcactattttttttttttttgagatggagtttcactcttgtcacccaggctagagtgcaattgctcactgcaacctccacctcccaggttcaagtgattttctgcctcatccttccaagtagctgggattacaggtcctaccaccccacctggctaattttatatttttagtagagacagagtttcaccatgttggccaggctggtcttgaactcctgacctcaggtgatctgcccaccttggtctcccaaagtgccgggattacaggcatgagccattacacccggccgaccatagctccaatttttatccgatgatcc

SEQ ID NO: 63349 - DNA, 601 bp, Human
aacaaaattaccatagaaaaatctctattttggggccgggtgtggtggtgcatgcctgtaatcccagcattttgggaggctgaggtgggagaattgcttgagcccaggagtttgagactagcctgggcaacatggtgaaaccctctctctacaaaaactaaaaaaacacacaaaattagctgggtgtgttggctcaggctgtagacccgctcgctactcaggaggctgaggtggaggattgcaggaggattgcttgcgactgcagtgagccgtggtcttgctgctgtactccagcctgggygacagggtgtgactctgcctcaaaagataataaatacattgataacataaaatctctatttcagtctatagaagtaaaggcctataaaatccaagtacacatttatatgttaataggaatattatttattggaaaaccttgtatctgtttactgactatgtattggaaaacctgatatcagacatgtttataagggttttatatatcatattatatcattttaattataaaatcaaccccatgaggaaggattatcttcattttatttttaaaattttaaaattttgttaagttttttag

SEQ ID NO: 63350 - DNA, 601 bp, Human
cgaatgccatgaaattctaaatgtcagcaacaagaagctcattcaagtacttatatttcacttggccaggacaggccatgaaagattgatgaccacttggaagaaaacaagttgtatggactcagtctggattctgtgctgttggagtactattggaattaatagctgaaaatctatctaattcccatgaattcgggcaacaaaattaccatagaaaaatctctattttggggccgggtgtggtggtgcatgcctgtaatcccagcattttgggaggctgaggtgggagaattgcttgagyccaggagtttgagactagcctgggcaacatggtgaaaccctctctctacaaaaactaaaaaaacacacaaaattagctgggtgtgttggctcaggctgtagacccgctcgctactcaggaggctgaggtggaggattgcaggaggattgcttgcgactgcagtgagccgtggtcttgctgctgtactccagcctgggcgacagggtgtgactctgcctcaaaagataataaatacattgataacataaaatctctatttcagtctatagaagtaaaggcctataaaatccaagtacacat

SEQ ID NO: 63351 - DNA, 601 bp, Human
caaactcctgacctcaggtgatccacctgccccagcctcccatagtgctgggattacaggagcgagccactgcgcctggcctaaaattgctgtccctttactaggatgtttgtcctgtatatattcatgaattctggactttgaagattgtatctcttaggtatcatttcacataatcttatacctcctgtatttcctgtacactgatagtttctagactctagatcctagggggttcattagatttaggtttaatgtttttggtaaaaaacaaaaacaaaaacaaaaaacaaaaaaaaaacacttaaaggagaaggaggagttcagttaaaaaaagtgctgcttaactaattcagttatgtataaagatcacaaagttttatgttcaaaacttgtgcatacacacagcactataacaaaaccatgaagtacagatctttttggctcatcccctttaggggtgtatctaaattaaccaagcttggcagagcctctcttttttttttttctttttaaaccattaacaccttggcagtaagaggagtcaactgcaatgttgccagcctttccagtgacagatattaagtgcagacgaatgcca

SEQ ID NO: 63352 - DNA, 601 bp, Human
gacagagtttcactcttgttgcccagactggagtgcaatggtgtgatcttggctcattacaacttccacctccccagttcaagtgattctccttcctcagcctcctgagtagctgggattacaggcatgcaccaccatacctgggtaattttgtatttttagtagaaacggggtttcaccacgttggttaggctggtctcaaactcctgacctcaggtgatccacctgccccagcctcccatagtgctgggattacaggagcgagccactgcgcctggcctaaaattgctgtccctttacyaggatgtttgtcctgtatatattcatgaattctggactttgaagattgtatctcttaggtatcatttcacataatcttatacctcctgtatttcctgtacactgatagtttctagactctagatcctagggggttcattagatttaggtttaatgtttttggtaaaaaacaaaaacaaaaacaaaaaacaaaaaaaaaacacttaaaggagaaggaggagttcagttaaaaaaagtgctgcttaactaattcagttatgtataaagatcacaaagttttatgttcaaaacttgtgcatac

SEQ ID NO: 63353 - DNA, 601 bp, Human
accctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaacgccgcagggtcctctgcctaggaaaaccagagacctttgttcacttgtttatctgccgaccttccctccactattgtcctatgaccctgccaaatccccctctgtgagaaacacccaagaatgatcaataaaaaaaawaaaaattaacaacaacaacaacaacaaaaaaaacattaacattagaggaaggctgggcgcggtggctcacgcttgtaatcccagcactttgggaggccgaggcgggtggatcacgaggtcaggagatcgagaccatgctggctaacatggtgaaaccccgtctctaccaaaaatacaaaaaaattagccggccgtgatggcaggcgcctctagtcccagctactcgggaggctgaggcaggagaatggcgtgaacctgggaggcggagcttgcagtgagcagagatcgcgccactgcact

SEQ ID NO: 63354 - DNA, 601 bp, Human
catgggagacttttcattttgttctgtactaagatacattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaacgccgcagggtcctctgcctaggaaaaccagagacctttgttcacttgtttatctgcygaccttccctccactattgtcctatgaccctgccaaatccccctctgtgagaaacacccaagaatgatcaataaaaaaaataaaaattaacaacaacaacaacaacaaaaaaaacattaacattagaggaaggctgggcgcggtggctcacgcttgtaatcccagcactttgggaggccgaggcgggtggatcacgaggtcaggagatcgagaccatgctggctaacatggtgaaaccccgtctctaccaaaaatacaaaaaaattagccggccgtgatggcaggcgcctctagtcccag

SEQ ID NO: 63355 - DNA, 601 bp, Human
ggtggggaaaagattgagaaatcggatggttgccgtgtctgtgtagaaagaagtagacatgggagacttttcattttgttctgtactaagatacattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaasgccgcagggtcctctgcctaggaaaaccagagacctttgttcacttgtttatctgccgaccttccctccactattgtcctatgaccctgccaaatccccctctgtgagaaacacccaagaatgatcaataaaaaaaataaaaattaacaacaacaacaacaacaaaaaaaacattaacattagaggaaggctgggcgcggtggctcacgcttgtaatcccagcactttgggaggccgaggcgggtggatcacgaggtcaggagatcgagaccatgctggctaacatggtgaaaccccgtc

SEQ ID NO: 63356 - DNA, 601 bp, Human
gagcccctctgcccggccaccaccccgtctgggaggtgtacccaacagctcattgagaacgggctgggatgacaatggcggttttgtggaatagaaaggggggaaaggtggggaaaagattgagaaatcggatggttgccgtgtctgtgtagaaagaagtagacatgggagacttttcattttgttctgtactaagatacattcttctgccttgggatcctgttgatcggtgaccttacccccaaccctgtgctctctgaaacatgtgctgtgtccactcagggttaaatggattaagggmggtgcaagatgtgctttgttaaacagatgcttgaaggcagcatgctcgttaagaatcatcaccactccctaatctcaagtacccagggacacaaacactgcggaacgccgcagggtcctctgcctaggaaaaccagagacctttgttcacttgtttatctgccgaccttccctccactattgtcctatgaccctgccaaatccccctctgtgagaaacacccaagaatgatcaataaaaaaaataaaaattaacaacaacaacaacaacaaaaaaaacattaacattagaggaaggctgg

SEQ ID NO: 63357 - DNA, 601 bp, Human
gtatgtcctgaaattctttttttttttttgagacggagtcttgctctgttgccagactggagtgcagtggtgatgttggcttactgcaacctccgcctcctgggtttgagcgattcttgtgcctcagcctcctgagtagctgggactacaggcacctgccaccacaccggctaatttttgtatttttagtagagacggggtttcaccatgttggtgaggctggtattgaactcctgacctcgtgatccacctgcctcggcctcccaaagtgctgggattacaggcatgagccactgcaccyggccaatatcacaacttttaactacttgtgtggtttcagctacagtgtcttcatttgacttagttcaattgttttgtctaaaatccaaaaactgttctttgaaaatatactttcccatccattaaggcatttagctttttgttgctaaaaagaatttcataagaacatttagaattttaaacttaattaaaatacactgaactttgacacagatgtgcagctccaaaacctttccagtttacaagtaaattatctacttacatcaggggtcagacttttagcaatgacgggcccaaccat

SEQ ID NO: 63358 - DNA, 601 bp, Human
aatgaacacatggtagtgagctgacttaggttctggtgttgccaccctgctccatgaggacaaggttaaacattttggacatgtccatattgagacacagaactttagaaaaagcatttctacaacattcctttttattaagtgagaggaaatagtaacaggtaccgtgtcacttaaggaattagaaatggtagatgtggagaagaagtaggaacactatctgtcggatatatgtctgaaatcagtatatttggtaataagaaagtctgtaagtatgtcctgaaattctttttttttttttgagacggagtcttgctctgttgccagactggagtgcagtggtgatgttggcttactgcaacctccgcctcctgggtttgagcgattcttgtgcctcagcctcctgagtagctgggactacaggcacctgccaccacaccggctaatttttgtatttttagtagagacggggtttcaccatgttggtgaggctggtattgaactcctgacctcgtgatccacctgcctcggcctcccaaagtgctgggattacaggcatgagccactgcacccggccaatatcacaacttttaactacttg

SEQ ID NO: 63359 - DNA, 601 bp, Human
aagtttttgaggcagtgctcaaagtaagaaattacaggctgggcgcggtggctcatgcctgatatcccagcactttgggaggctgaggcgggtggatcatttgaggtcagaagttcgagaccagcctggccaacatggtgaaaccccatctgtactaaaaattcaaaaattagccgggtgtggtggcacgtgcctgtagtcctagctacttgggaggctgaggcaggagaattgtttgaacctgggaggcggaggttgcagtgagctgagatcacgccactgccctccaacctgggggacragtgagacttcatctcaaaaagaagaaagaaattacaattgtgaaggtaagtgtgtgcttttcctttttaaaaataatatactttagagttttatttggccgggtgcagtggctcactcctgtaatcccagcactttgggaggccgagatgggcggatcacctgagttccaaaccagcctgaccaacatggagaagctccgtctctattaaaaatacaaaattagctgggcgtggtggcacatgcctgtaatcccagctattcgggaggctgaggcaggaaaatcgccggaacccgggag

SEQ ID NO: 63360 - DNA, 601 bp, Human
agcttcttaggattactaagacaaagctgccctgtgtggtctctgggacaaaataatacttcagtgttatctgaaggcaatgagtgaacttaaaatcaatcgttgtactacaagtctcacacagctcctagtttgttttttaacaaaaattccaccagtttttagagaatactgttttgtttataacaacattgaacctcagacacactttgaattttaattattgcattatttatttatatgctgactcattccacaaagtttttgaggcagtgctcaaagtaagaaattacaggctgggcgcggtggctcatgcctgatatcccagcactttgggaggctgaggcgggtggatcatttgaggtcagaagttcgagaccagcctggccaacatggtgaaaccccatctgtactaaaaattcaaaaattagccgggtgtggtggcacgtgcctgtagtcctagctacttgggaggctgaggcaggagaattgtttgaacctgggaggcggaggttgcagtgagctgagatcacgccactgccctccaacctgggggacaagtgagacttcatctcaaaaagaagaaagaaattacaattgt

SEQ ID NO: 63361 - DNA, 601 bp, Human
tttatttgggaaaaaaggagaaacatgaagaaagaaacaccctgtggtggctatacttgtctgagatgagtgcagtttagtgaaaaaaaatcttagatactcatcttaaattctgctgaggaatcagtcaataattacatcttataccagaaagaaatgtttgaaacagcttcttaggattactaagacaaagctgccctgtgtggtctctgggacaaaataatacttcagtgttatctgaaggcaatgagtgaacttaaaatcaatcgttgtactacaagtctcacacagctcctagttkgttttttaacaaaaattccaccagtttttagagaatactgttttgtttataacaacattgaacctcagacacactttgaattttaattattgcattatttatttatatgctgactcattccacaaagtttttgaggcagtgctcaaagtaagaaattacaggctgggcgcggtggctcatgcctgatatcccagcactttgggaggctgaggcgggtggatcatttgaggtcagaagttcgagaccagcctggccaacatggtgaaaccccatctgtactaaaaattcaaaaattagccg

SEQ ID NO: 63362 - DNA, 601 bp, Human
agtatgaggtcatttatttgggaaaaaaggagaaacatgaagaaagaaacaccctgtggtggctatacttgtctgagatgagtgcagtttagtgaaaaaaaatcttagatactcatcttaaattctgctgaggaatcagtcaataattacatcttataccagaaagaaatgtttgaaacagcttcttaggattactaagacaaagctgccctgtgtggtctctgggacaaaataatacttcagtgttatctgaaggcaatgagtgaacttaaaatcaatcgttgtactacaagtctcacayagctcctagtttgttttttaacaaaaattccaccagtttttagagaatactgttttgtttataacaacattgaacctcagacacactttgaattttaattattgcattatttatttatatgctgactcattccacaaagtttttgaggcagtgctcaaagtaagaaattacaggctgggcgcggtggctcatgcctgatatcccagcactttgggaggctgaggcgggtggatcatttgaggtcagaagttcgagaccagcctggccaacatggtgaaaccccatctgtactaaaaattc

SEQ ID NO: 63363 - DNA, 601 bp, Human
cccagctacttggggggctgaggtaggaagatcacctgagcctggggaggttgaggctgcagtgagccatgattgcaccactgcactctagcctgggcgatggagaccctgtctcaaaaaacaaagaaacaaacaaacaaacaaaaaacccaaacaaacaagcagtagaactagcaatgaggaagtgaaagagaaggcactgggaagccagtatgaggtcatttatttgggaaaaaaggagaaacatgaagaaagaaacaccctgtggtggctatacttgtctgagatgagtgcagtttartgaaaaaaaatcttagatactcatcttaaattctgctgaggaatcagtcaataattacatcttataccagaaagaaatgtttgaaacagcttcttaggattactaagacaaagctgccctgtgtggtctctgggacaaaataatacttcagtgttatctgaaggcaatgagtgaacttaaaatcaatcgttgtactacaagtctcacacagctcctagtttgttttttaacaaaaattccaccagtttttagagaatactgttttgtttataacaacattgaacctcagacacactttga

SEQ ID NO: 63364 - DNA, 601 bp, Human
gtagtcccagctacttggggggctgaggtaggaagatcacctgagcctggggaggttgaggctgcagtgagccatgattgcaccactgcactctagcctgggcgatggagaccctgtctcaaaaaacaaagaaacaaacaaacaaacaaaaaacccaaacaaacaagcagtagaactagcaatgaggaagtgaaagagaaggcactgggaagccagtatgaggtcatttatttgggaaaaaaggagaaacatgaagaaagaaacaccctgtggtggctatacttgtctgagatgagtgcaktttagtgaaaaaaaatcttagatactcatcttaaattctgctgaggaatcagtcaataattacatcttataccagaaagaaatgtttgaaacagcttcttaggattactaagacaaagctgccctgtgtggtctctgggacaaaataatacttcagtgttatctgaaggcaatgagtgaacttaaaatcaatcgttgtactacaagtctcacacagctcctagtttgttttttaacaaaaattccaccagtttttagagaatactgttttgtttataacaacattgaacctcagacacac

SEQ ID NO: 63365 - DNA, 601 bp, Human
gcgtggtggcttacgcctgtaatcctagcactttgggaggccatggtgggcggatcacgaggtcaggagatggagactgtcctggctaacaaggtgaaaccccgtctctactaaaaagacaaaaaattagccaggcgtggtggtgggcacctgtaatcccagctacttgggaggctgaggcaggagaatggcgtgaacccgggaggcggagtttgcagtgagccaagatcgtgccactgcactccagcctgggcaacagagtgagactccgtctcaaaaacaaaacaaaacaaaacaaaamaaaccaagcaggccaggcatggcggctcatgcctgtaatcccagcactttgggaggccgaggtaggtggctaccttgagccctggagtttgagaccagcctgggcaaggtggtgaaaccccatctttacaagaagtaggaaaattagctggacatggtagtgtacatctgtagtcccagctacttggggggctgaggtaggaagatcacctgagcctggggaggttgaggctgcagtgagccatgattgcaccactgcactctagcctgggcgatggagaccctgtctcaaaaaacaaag

SEQ ID NO: 63366 - DNA, 601 bp, Human
agaagccagacaaaaaaggtacatactaaattattccatttatataaagcccaaagtcagaccatactaatctatggggttaaaagttgggagagtggttccacttggtgagggtgaaggaaaaataggaggaaatggtacctggggtcttactgagggaggtaatattctgtttcttgattgggtgctggttacacagatgtattaactttgtggaaattcatctagctgcacactttagattagtgcatttatttatttttgtttttatttttgagacagagtctcactctgtcactcrggctggagtgcagtggcgcaatctcggctcactgcagcctccactttctgggctgaggcaatcctcccaactcagccttccaaggagctgggattagaggtgcatgctaccatgcctggctaattttctttgtgtgtgtatatatatgtatatatatacgtatatatatacatatacatatatatatatatttttggtagagatggggtttcgccatgtttcccaggctggtcttgaactcctgggctcaagtgatccactcgcctcagcctcccgcagtgatggtactacaggtgtgag

SEQ ID NO: 63367 - DNA, 601 bp, Human
aaagaagccagacaaaaaaggtacatactaaattattccatttatataaagcccaaagtcagaccatactaatctatggggttaaaagttgggagagtggttccacttggtgagggtgaaggaaaaataggaggaaatggtacctggggtcttactgagggaggtaatattctgtttcttgattgggtgctggttacacagatgtattaactttgtggaaattcatctagctgcacactttagattagtgcatttatttatttttgtttttatttttgagacagagtctcactctgtcacycaggctggagtgcagtggcgcaatctcggctcactgcagcctccactttctgggctgaggcaatcctcccaactcagccttccaaggagctgggattagaggtgcatgctaccatgcctggctaattttctttgtgtgtgtatatatatgtatatatatacgtatatatatacatatacatatatatatatatttttggtagagatggggtttcgccatgtttcccaggctggtcttgaactcctgggctcaagtgatccactcgcctcagcctcccgcagtgatggtactacaggtgtg

SEQ ID NO: 63368 - DNA, 601 bp, Human
ttgtgtgtagttcacttcattaaaaagatagtgtcacaagagtgttaaaacagccacattattcataaaagcctcatccttgaaacaacccaaatgtccaccagcagtaggatagtggtatatttgttcaacgtaatacaatacagcaatgagaatgggctacaacatcataaatacagctcacaaacaaaatatgaagcaaaagaagccagacaaaaaaggtacatactaaattattccatttatataaagcccaaagtcagaccatactaatctatggggttaaaagttgggagagtgkttccacttggtgagggtgaaggaaaaataggaggaaatggtacctggggtcttactgagggaggtaatattctgtttcttgattgggtgctggttacacagatgtattaactttgtggaaattcatctagctgcacactttagattagtgcatttatttatttttgtttttatttttgagacagagtctcactctgtcactcaggctggagtgcagtggcgcaatctcggctcactgcagcctccactttctgggctgaggcaatcctcccaactcagccttccaaggagctgggattag

SEQ ID NO: 63369 - DNA, 601 bp, Human; identical to SEQ ID NO: 26357

SEQ ID NO: 63370 - DNA, 601 bp, Human; identical to SEQ ID NO: 26358

SEQ ID NO: 63371 - DNA, 601 bp, Human; identical to SEQ ID NO: 20571

SEQ ID NO: 63372 - DNA, 601 bp, Human; identical to SEQ ID NO: 20570

SEQ ID NO: 63373 - DNA, 601 bp, Human; identical to SEQ ID NO: 17614

SEQ ID NO: 63374 - DNA, 601 bp, Human; identical to SEQ ID NO: 17615

SEQ ID NO: 63375 - DNA, 601 bp, Human; identical to SEQ ID NO: 17616

SEQ ID NO: 63376 - DNA, 601 bp, Human; identical to SEQ ID NO: 17617

SEQ ID NO: 63377 - DNA, 601 bp, Human; identical to SEQ ID NO: 17618

SEQ ID NO: 63378 - DNA, 601 bp, Human; identical to SEQ ID NO: 17619

SEQ ID NO: 63379 - DNA, 601 bp, Human; identical to SEQ ID NO: 17620

SEQ ID NO: 63380 - DNA, 601 bp, Human; identical to SEQ ID NO: 17621

SEQ ID NO: 63381 - DNA, 601 bp, Human; identical to SEQ ID NO: 17622

SEQ ID NO: 63382 - DNA, 601 bp, Human
gaggtttcaccatcttggccaggctggtcttaaactcctgaccttgtgatccacccaccttggcctcccagtgttgggattacaggcgtgagccaccgtgtccagccacttgtctttcagtctgtgtactctatgtatagcattatgaatgaaaagggtcaggttattcttggaatccacaattaaataattgtttagccatttcatgtgtggtattagaaaatatacaatgatctgcccaagggttccaagatggctgaataggaacaactccagtctacaggtcccagcgtgagtgacrcagaagacgggtgatttctgcatttccagctgaggtaccgggttcatctcactgggatttgtcgtacagtgggcgcagcccacagagcatgagccgaagcagggcaggtcatcacctcacccaggaagcgcaaggggtcggggaattccctttcctagctaagggaaactgtgacagatggtacctggaaaactaggacactcccaccctaatactgcgcttttccaacagtcttagcaaacaacacaccaggagattatatcctgcgcctggcttggagggtcccacacccatggaacc

SEQ ID NO: 63383 - DNA, 601 bp, Human
gcgggagggtcgttgaggctgcagtgatctgagatcatgccattgcattccagcctggaaaacaaagtgagaccctgtctcaaaaaaaaaaaaaaaaaaaaaaaaaaaaaaaaaaaatcaggcaaactgaaattgaaggacattttacataaaataaccaatcaacattcttcagaagtgcaaagacgtaaaagataaggaaggattgaggaattataatagcctgggaaagaataagaagaaataactaaattcaacgtataatggtggaaaaagaacattagtagaaaacttgaccagrtttgagtaaggcttatagtttagttgttaatactataccagtgttaatgtcctgttctcgatcatggcactatggtttggtaatatgttaacattagaggaagctgggtgtaacttctataaacctaaaattcgttaatgaaaagtttaaaaaataaaaaggtcaggcacagtggctcacgcctgtaatctcagcactttgagaggcctaagtaggaggattgcttgaggccaggagttgcagaccagcctgggcaacatagcaagaccccgtcactataaaaatgaaaaagccccagga

SEQ ID NO: 63384 - DNA, 601 bp, Human
catgccattgcattccagcctggaaaacaaagtgagaccctgtctcaaaaaaaaaaaaaaaaaaaaaaaaaaaaaaaaaaaatcaggcaaactgaaattgaaggacattttacataaaataaccaatcaacattcttcagaagtgcaaagacgtaaaagataaggaaggattgaggaattataatagcctgggaaagaataagaagaaataactaaattcaacgtataatggtggaaaaagaacattagtagaaaacttgaccagatttgagtaaggcttatagtttagttgttaatactrtaccagtgttaatgtcctgttctcgatcatggcactatggtttggtaatatgttaacattagaggaagctgggtgtaacttctataaacctaaaattcgttaatgaaaagtttaaaaaataaaaaggtcaggcacagtggctcacgcctgtaatctcagcactttgagaggcctaagtaggaggattgcttgaggccaggagttgcagaccagcctgggcaacatagcaagaccccgtcactataaaaatgaaaaagccccaggaaaaaacttttaagttttctcaataaatatccttta

SEQ ID NO: 63385 - DNA, 601 bp, Human; identical to SEQ ID NO: 17623

SEQ ID NO: 63386 - DNA, 601 bp, Human
ggtggcgcgagcctgtaatcccagctacttgggaagctgaggcaggagaatcgcttgaacccaggaggcagaggtttcagtgagctgagatcatgccattgcactccagcctgggcaacagagtgagactccatctcaaaaaaaagaaatctggtcttaagagatgtcagagtggagcccttaggggtgacagcctggtttagagatctggaaagctgagaaagaagctctagggatcctgggtgccaagtttggggatcactgaactgggagtcctagacttaaagggcaagaggcagaraatccctcctaaggttggggtggtagatggggtcaccataccggatcagtgtggccccggaaggctccacattcagcagaggcagcagcagcagcaggggttgcagcagcggtggtggagacatcgctggggacctgggtgtgaacccaggtgtcctggggcctcattttctttcccctgtgactccaccctgttcatgccccacctccaggtttagaaggagaccaggacatgaaatctgtccgcaggtgacgcagtgggacaaggatgttttttgaagatttgtgcagagtatttttg

SEQ ID NO: 63387 - DNA, 601 bp, Human
ggggctcgaagatgggaggagtgtgtcacaggtctggaaaccacagtacctaatcatcagagctcatagtagggtctgcagagacctctcaaaaacatgtcctggccaggcgcagtggctcacgcctgtaatcccagcactttgggaggctgaggcaggcagatcacgaagtcaggagttcaagaccagcttggccaacatggtgaaacctcatctctactaaagatacaaaaaaaattagccgggcatggtgactcacgcctgtaatcccagcactttcagaggcaggagaatggtgtcrgcctgggaggtggaggttgcagtgagctgagatcgcgccattgcactccagcctgggcgacagggcaagactccgtctcaaaaaaaaaaaaaaaaaaaggccaggcgcggtggcttacgcctgtaatcccagcactttgcgaggctgaggtgggtggatcacgaggtcaggagatcgagaccatcctggctaacactgtgaaaccccatctctactaaaaatacaaaaaattagccgggcgtggtggcgggtgcctgtagtcccagctgcttgggaggctgaggcaggagaatgatgtga

SEQ ID NO: 63388 - DNA, 601 bp, Human
ttttattttattttatttattaattttttttttagacaaggtgtcaccctgttgcccagcctggagtgcagtagcaggatcatagcccactgccccctcgaactactgggctcaagcaatcctccttcctcaccctcctgaactagctgggaccatgggtgtgcaccaccacactgagctaatttttgtattttttgtagaggtggagtctggccatgttgcccaggctggtctcaaaactcttggcctcaaacaagcttcccaccttggacttccaaagtgctgggttacaggtgtgagycatgtctctggccaaaaacatgacttcttcaggccagtttgatgggcgtgatgtgggggagtctcagtttaaatgtcacatatctggggctcgaagatgggaggagtgtgtcacaggtctggaaaccacagtacctaatcatcagagctcatagtagggtctgcagagacctctcaaaaacatgtcctggccaggcgcagtggctcacgcctgtaatcccagcactttgggaggctgaggcaggcagatcacgaagtcaggagttcaagaccagcttggccaacatggtgaaacctcatc

SEQ ID NO: 63389 - DNA, 601 bp, Human
aggtagtgggaagacttcttgcatagggtccccaagattggatttctttttcttcttttaaactttttatttgaaacagggtctccctctgtcacccaggctggagtgcagtagtgcagtcagggctcactgcagccttgatctccagggctcaagtgattctcccacctcagcctctggagtagctgagactatgggcacaccaccacacctggctttttattttattttattttatttattaattttttttttagacaaggtgtcaccctgttgcccagcctggagtgcagtagcaggwtcatagcccactgccccctcgaactactgggctcaagcaatcctccttcctcaccctcctgaactagctgggaccatgggtgtgcaccaccacactgagctaatttttgtattttttgtagaggtggagtctggccatgttgcccaggctggtctcaaaactcttggcctcaaacaagcttcccaccttggacttccaaagtgctgggttacaggtgtgagccatgtctctggccaaaaacatgacttcttcaggccagtttgatgggcgtgatgtgggggagtctcagtttaaatgtca

SEQ ID NO: 63390 - DNA, 601 bp, Human
cagttacttttgggaggacaataaccacatgtcctgaggtctcccaaaccaaggcatgaatcctaggtctggggacttctggatgcaagccccaacttcctaggaaactatgcctcttgagaagccccaccccttcacccaggaacccctttcttctccttgagaagccccacctcttcacccaggaagctcctcccctgcttgagaagccccacctcttcacccaggaagctcctcctccctgcttgagaagccccacctcttaaccttggaagctcctcccccctgcttgagaagcccyacctcttcacccaggaagcccctccccctccttgtgacgcaccatcccttcactctgaaaggcaggccctcctccccacttgaaaagccccatccattggcttgggaagctcctcctcgagcctcttcctaagccagatgatcttagacaatggggttctcccaggctcaagacttctgagagtcaaaggccactcacagtcagcttgtcctcgctcaggattccatctacccgcccagttccatattgaatggcaaacttggtcccattggcctggaaggagctagaggctttgggatc

SEQ ID NO: 63391 - DNA, 601 bp, Human
gccttcccagcccgtacccaccagactgggacctcacctccccagccagcaaggggattcccccaatggctgcatgcagggcccggatctcctcagtgggtcctgtgatgagggacgtgcccgtatccaggatggcagcacagcccttggcacagagagtcagccctgggcccaccttcacactgagggggaaggaggcagtcatcagaggcagggtcctaggagtccaggcccccagcctccagctccagagccaggagaccaagtccctcaccgctccatgtggatctgccagtaggcrgggaccgtgactggcacgaaggtgaggggtgggatgtagtgtgccgggtccgagccccccaggaccagctctcctccatcaggctcttcagggtccctgcaggggcagagtgtagagagtgtagatgtcagtgtcactggccctccctcagccctaggtattgccaggaatggcacttcccaccaactgggttgtttctggagttcctacggggtaatgggatgcaggaagggcctagatgttgggactggaagccgggcaagaaaagcatgatgcttttcttggtggaagctagaactt

SEQ ID NO: 63392 - DNA, 601 bp, Human; identical to SEQ ID NO: 26296

SEQ ID NO: 63393 - DNA, 601 bp, Human; identical to SEQ ID NO: 26297

SEQ ID NO: 63394 - DNA, 601 bp, Human; identical to SEQ ID NO: 26298

SEQ ID NO: 63395 - DNA, 601 bp, Human
tttactaaagagcaagttcctgggcatctctgtgtttctctttatggggttcaaaacctttcaaggacctctctccatgccactggttccttggaccctatcactgggctgcctcctgagcccctcagtcctaccacagtctactgacttttcccattcagctgtgagcattcaaccctgtcccctggaccttgacacctggctccccaaccctgtcccaggaaacccagattccaccagacacttccttcttccccccgaggctatctggcctgagacaacaaatgctgcctcccacccygagtctggcactgggactttcagaactcctccttccctgactctttgccccagacccgtcattcaatggctagctttttccatgggaaaaacacgagcacccccaaccacaacggccagttctctgattccctaaatccgcacccttttcaaaacctcaaaaacaaaacaaaacaaaacaaaacaaagcaagaaacaactcaggcagaactgtttgcttaaccttggacatggtaaaccatccaaaaccttcctctcccagcaactaaacctctccactgggcacttatccttggtttct

SEQ ID NO: 63396 - DNA, 601 bp, Human
tgagcattcaaccctgtcccctggaccttgacacctggctccccaaccctgtcccaggaaacccagattccaccagacacttccttcttccccccgaggctatctggcctgagacaacaaatgctgcctcccaccctgagtctggcactgggactttcagaactcctccttccctgactctttgccccagacccgtcattcaatggctagctttttccatgggaaaaacacgagcacccccaaccacaacggccagttctctgattccctaaatccgcacccttttcaaaacctcaaaaacaaaacaaaacaaaacaaaacaaagcaagaaacaactcaggcagaactgtttgcttaaccttggacatggtaaaccatccaaaaccttcctctcccagcaactaaacctctccactgggcacttatccttggtttctggaacctcttattctcttagaacccacagctgccaccacagtgtcccttctcccagtgtaagaccccaaatcactccaaatgacccaacccccaacccgatgcctgcttcagatgtttcccatgtcccctactctgatctctggggtcagctccgttctcagag

SEQ ID NO: 63397 - DNA, 601 bp, Human
gactatatctccccgacccctgtgcttttctcactgtttctttttcttccctttggagtctcccttatcctcccctgccccatctacctttccccattttctctctcctcatgcatccacccccttcctccccaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctycgcctgtcagagcctgccaagatcacagatgttgtgaaggtcctgggcctgcccacccaggagccagcactggggaccacctgctacgcctcaggctggggcagcatcgaaccagaggagtgtacgcctgggccagatggtgtagctgggagcccagatgcctgggtctgagggaagtggggccaaagaaccaggtggggtccggccacagcccagtttttctctgacccatagtcttgcgccccaggagtcttcagtgtgtgagcctccatctcctgtccaatgacatgtgtgctagag

SEQ ID NO: 63398 - DNA, 601 bp, Human
ccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagtgtacgcctgggccagatggtgtagctgggagcccagatgcctgggtctgagggaagtggggccaaagaaccaggtggggtccggccacagcccagwttttctctgacccatagtcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggtgagtgaagaccctaattctgggctgcaatctgaaagctaaccagacatctgcctcccctgctccccagctatagccacgccccctccccatgcctcatctgccgccc

SEQ ID NO: 63399 - DNA, 601 bp, Human
tttctttttgagacaaaagtgtcactctgtctcccaggttggagtgagtggcacgatctcagctcactgcaacctccacctcctgggtttaagtgattcttgtgtctcggcctcctgagcagctgagattacaggcgcccgccaccatgccaggctaatttttgtatttttttttagagacagagtttcgccatgttggccaggctagtctcaaactcctgaccaaaggtgatctgcctgcctcagcctcccaaagtgctgggattacaggtgtgagccactgcgcccagccttttttacytgttttaatgtggctactaaaaaactggaaatgacataagcagctcagcattatttctactaaacaccactactctagggtatgagctctgtgagaacaggggtcctgactgtcttggcaattgctggattctcagaatttggcaacgctccatgttaccgagttggcactcagtgtgtatctgctgaataaagagaggtgtcctcacctggcaggagtctctacctgctttgtcaccggcgcagaacatggtgtcatctatctgtctcgggtaagcatcctcgcaccttttctgactta

SEQ ID NO: 63400 - DNA, 601 bp, Human
ttttttacttgtttttttttttctttttgagacaaaagtgtcactctgtctcccaggttggagtgagtggcacgatctcagctcactgcaacctccacctcctgggtttaagtgattcttgtgtctcggcctcctgagcagctgagattacaggcgcccgccaccatgccaggctaatttttgtatttttttttagagacagagtttcgccatgttggccaggctagtctcaaactcctgaccaaaggtgatctgcctgcctcagcctcccaaagtgctgggattacaggtgtgagccacygcgcccagccttttttacctgttttaatgtggctactaaaaaactggaaatgacataagcagctcagcattatttctactaaacaccactactctagggtatgagctctgtgagaacaggggtcctgactgtcttggcaattgctggattctcagaatttggcaacgctccatgttaccgagttggcactcagtgtgtatctgctgaataaagagaggtgtcctcacctggcaggagtctctacctgctttgtcaccggcgcagaacatggtgtcatctatctgtctcgggtaagcatcc

SEQ ID NO: 63401 - DNA, 601 bp, Human
gttttatattaattacactttgaaatgattgtatttgggatacattgggttattaaagttaacttcacctgtttcttttttacttgtttttttttttctttttgagacaaaagtgtcactctgtctcccaggttggagtgagtggcacgatctcagctcactgcaacctccacctcctgggtttaagtgattcttgtgtctcggcctcctgagcagctgagattacaggcgcccgccaccatgccaggctaatttttgtatttttttttagagacagagtttcgccatgttggccaggctrgtctcaaactcctgaccaaaggtgatctgcctgcctcagcctcccaaagtgctgggattacaggtgtgagccactgcgcccagccttttttacctgttttaatgtggctactaaaaaactggaaatgacataagcagctcagcattatttctactaaacaccactactctagggtatgagctctgtgagaacaggggtcctgactgtcttggcaattgctggattctcagaatttggcaacgctccatgttaccgagttggcactcagtgtgtatctgctgaataaagagaggtgtcctc

SEQ ID NO: 63402 - DNA, 601 bp, Human
cagtgcacaacctgcccaaccatacaaaacagccctgatctttccctctagatccgtgccatccaatacagtaactgctagccacatgtggctactgagcacctgaaatgtagctagtccaaattgagatgtgctgtcagcataacatatatactcactttcaaagacttaatatgaaaacaagaaaagaatgtaaagtatctcattcataattgttttatattaattacactttgaaatgattgtatttgggatacattgggttattaaagttaacttcacctgtttcttttttacttgtttttttttttctttttgagacaaaagtgtcactctgtctcccaggttggagtgagtggcacgatctcagctcactgcaacctccacctcctgggtttaagtgattcttgtgtctcggcctcctgagcagctgagattacaggcgcccgccaccatgccaggctaatttttgtatttttttttagagacagagtttcgccatgttggccaggctagtctcaaactcctgaccaaaggtgatctgcctgcctcagcctcccaaagtgctgggattacaggtgtgagccactgcgcccagcct

SEQ ID NO: 63403 - DNA, 601 bp, Human
tgaaattgccctatttatgcagattcttgaccacagagttttttattttttaactttgttcctccagcccttccagcagctttgcaattaatcccctgtattaaatattctcttgtaaaaatacctaccagatttctcttttccttcctcaagatattttaccagcacttgctagaaaactgtcatattacagattttgttgaaacaagacacttaactaccacacgcctgaaaactgccaaaactgacatctgtaacacggagtgcccctattagatatggtatctttatgcagtgcacmacctgcccaaccatacaaaacagccctgatctttccctctagatccgtgccatccaatacagtaactgctagccacatgtggctactgagcacctgaaatgtagctagtccaaattgagatgtgctgtcagcataacatatatactcactttcaaagacttaatatgaaaacaagaaaagaatgtaaagtatctcattcataattgttttatattaattacactttgaaatgattgtatttgggatacattgggttattaaagttaacttcacctgtttcttttttacttgttttttttt

SEQ ID NO: 63404 - DNA, 601 bp, Human
tcctaaaaccatgttttattttggggttaacctttaccactctctgaaattgccctatttatgcagattcttgaccacagagttttttattttttaactttgttcctccagcccttccagcagctttgcaattaatcccctgtattaaatattctcttgtaaaaatacctaccagatttctcttttccttcctcaagatattttaccagcacttgctagaaaactgtcatattacagattttgttgaaacaagacacttaactaccacacgcctgaaaactgccaaaactgacatctgtarcacggagtgcccctattagatatggtatctttatgcagtgcacaacctgcccaaccatacaaaacagccctgatctttccctctagatccgtgccatccaatacagtaactgctagccacatgtggctactgagcacctgaaatgtagctagtccaaattgagatgtgctgtcagcataacatatatactcactttcaaagacttaatatgaaaacaagaaaagaatgtaaagtatctcattcataattgttttatattaattacactttgaaatgattgtatttgggatacattgggtt

SEQ ID NO: 63405 - DNA, 601 bp, Human
tggggggagcttttcatagccatgggactggagtactcctgaatccccagcttcctaactactgttgaaacacacaccctgctaatgagagcttgttaacttacgtccttctagatcccttgggagcctgaatacagagaagggtgctggttgatgtaacagtttgattttaaattctgtcttcctcaacagatacagcttccattagaacatagggaagctctgtgttggtgaccaagaaatacttgcagagcattcgcccctgcctacacctccagcgtcactttctactgttgccccyacttttgttctccagttgcattggtttcctcttcttctttgaatcagccaaattccttactgcctcagggcctttgcacgtgccttttctttccccttaaacttcacgagtttagcttctttgtgtcatccattctctgctcagatgccacctctccaaggaggctcccctgaccacctttttgaatattggcccttattgtttactatcctaaaaccatgttttattttggggttaacctttaccactctctgaaattgccctatttatgcagattcttgaccacagagttttttattt

SEQ ID NO: 63406 - DNA, 601 bp, Human
ttagtggccacacccagaccacacaccggtatgaaaaaacaaacaaaaaaacaccttgaggtctggaaaaacaagatactaaccttgcctacagaaaggctaaatagttttaaatgccaccacttgaatgagatgtgatttcttttcttttctttttttttttttgagacggagtctcactgtgttgcccaggctggagtgcagtggtgcaacctcggctcactgcaagttccgcctcccgggttcaggccattctcctgcctcagcctcccgagtagctgggactacaggcgcctgccamcacgcccggctaattttttgtgtttttagtagagacagggtttcaccgtgtcagccaggatggtctccatctcctgacctagtgatccacccgcctcggcctcccaaagtgttgggattacaggtgtgagccaccacgcccggccgagatgtgctttcttctgttaaaagttttccccctcgcaacccacccccccacacccagggcacagagaagaaatggggagagctggggaggtgttgcatttgtcaggtttgtacaatttggggggagcttttcatagccatgggactggagtac

SEQ ID NO: 63407 - DNA, 601 bp, Human
agcttttagtggccacacccagaccacacaccggtatgaaaaaacaaacaaaaaaacaccttgaggtctggaaaaacaagatactaaccttgcctacagaaaggctaaatagttttaaatgccaccacttgaatgagatgtgatttcttttcttttctttttttttttttgagacggagtctcactgtgttgcccaggctggagtgcagtggtgcaacctcggctcactgcaagttccgcctcccgggttcaggccattctcctgcctcagcctcccgagtagctgggactacaggcgccygccaccacgcccggctaattttttgtgtttttagtagagacagggtttcaccgtgtcagccaggatggtctccatctcctgacctagtgatccacccgcctcggcctcccaaagtgttgggattacaggtgtgagccaccacgcccggccgagatgtgctttcttctgttaaaagttttccccctcgcaacccacccccccacacccagggcacagagaagaaatggggagagctggggaggtgttgcatttgtcaggtttgtacaatttggggggagcttttcatagccatgggactgg

SEQ ID NO: 63408 - DNA, 601 bp, Human
atactattggtattagtattgttgtagttgttattatttcttgcttgtagcttttagtggccacacccagaccacacaccggtatgaaaaaacaaacaaaaaaacaccttgaggtctggaaaaacaagatactaaccttgcctacagaaaggctaaatagttttaaatgccaccacttgaatgagatgtgatttcttttcttttctttttttttttttgagacggagtctcactgtgttgcccaggctggagtgcagtggtgcaacctcggctcactgcaagttccgcctcccgggttcasgccattctcctgcctcagcctcccgagtagctgggactacaggcgcctgccaccacgcccggctaattttttgtgtttttagtagagacagggtttcaccgtgtcagccaggatggtctccatctcctgacctagtgatccacccgcctcggcctcccaaagtgttgggattacaggtgtgagccaccacgcccggccgagatgtgctttcttctgttaaaagttttccccctcgcaacccacccccccacacccagggcacagagaagaaatggggagagctggggaggtgttgcattt

SEQ ID NO: 63409 - DNA, 601 bp, Human
gatgctattatttttatactattggtattagtattgttgtagttgttattatttcttgcttgtagcttttagtggccacacccagaccacacaccggtatgaaaaaacaaacaaaaaaacaccttgaggtctggaaaaacaagatactaaccttgcctacagaaaggctaaatagttttaaatgccaccacttgaatgagatgtgatttcttttcttttctttttttttttttgagacggagtctcactgtgttgcccaggctggagtgcagtggtgcaacctcggctcactgcaagttcygcctcccgggttcaggccattctcctgcctcagcctcccgagtagctgggactacaggcgcctgccaccacgcccggctaattttttgtgtttttagtagagacagggtttcaccgtgtcagccaggatggtctccatctcctgacctagtgatccacccgcctcggcctcccaaagtgttgggattacaggtgtgagccaccacgcccggccgagatgtgctttcttctgttaaaagttttccccctcgcaacccacccccccacacccagggcacagagaagaaatggggagagctgg

SEQ ID NO: 63410 - DNA, 601 bp, Human
ggccaataataacaggtaaatgagttaatgagctgaggcatgcaaaccacttaaaacagtgtccagcaattagccagatgctattatttttatactattggtattagtattgttgtagttgttattatttcttgcttgtagcttttagtggccacacccagaccacacaccggtatgaaaaaacaaacaaaaaaacaccttgaggtctggaaaaacaagatactaaccttgcctacagaaaggctaaatagttttaaatgccaccacttgaatgagatgtgatttcttttcttttcttttgttttttttgagacggagtctcactgtgttgcccaggctggagtgcagtggtgcaacctcggctcactgcaagttccgcctcccgggttcaggccattctcctgcctcagcctcccgagtagctgggactacaggcgcctgccaccacgcccggctaattttttgtgtttttagtagagacagggtttcaccgtgtcagccaggatggtctccatctcctgacctagtgatccacccgcctcggcctcccaaagtgttgggattacaggtgtgagccaccacgcccggccgagatgtgctt

SEQ ID NO: 63411 - DNA, 601 bp, Human
ctccttgtttgtaaaatagggccaataataacaggtaaatgagttaatgagctgaggcatgcaaaccacttaaaacagtgtccagcaattagccagatgctattatttttatactattggtattagtattgttgtagttgttattatttcttgcttgtagcttttagtggccacacccagaccacacaccggtatgaaaaaacaaacaaaaaaacaccttgaggtctggaaaaacaagatactaaccttgcctacagaaaggctaaatagttttaaatgccaccacttgaatgagatgtgmtttcttttcttttctttttttttttttgagacggagtctcactgtgttgcccaggctggagtgcagtggtgcaacctcggctcactgcaagttccgcctcccgggttcaggccattctcctgcctcagcctcccgagtagctgggactacaggcgcctgccaccacgcccggctaattttttgtgtttttagtagagacagggtttcaccgtgtcagccaggatggtctccatctcctgacctagtgatccacccgcctcggcctcccaaagtgttgggattacaggtgtgagccaccac

SEQ ID NO: 63412 - DNA, 601 bp, Human
tgtttcaaagcaaacaagcttagctgcctgtacctctaaatttcaactttcttgtggtttaatttctctcattattttttaaatttaatatctctgcagagtttcttttgagaggctgttagttaactgctctgagccttggctccttgtttgtaaaatagggccaataataacaggtaaatgagttaatgagctgaggcatgcaaaccacttaaaacagtgtccagcaattagccagatgctattatttttatactattggtattagtattgttgtagttgttattatttcttgcttgtrgcttttagtggccacacccagaccacacaccggtatgaaaaaacaaacaaaaaaacaccttgaggtctggaaaaacaagatactaaccttgcctacagaaaggctaaatagttttaaatgccaccacttgaatgagatgtgatttcttttcttttctttttttttttttgagacggagtctcactgtgttgcccaggctggagtgcagtggtgcaacctcggctcactgcaagttccgcctcccgggttcaggccattctcctgcctcagcctcccgagtagctgggactacaggcgcct

SEQ ID NO: 63413 - DNA, 601 bp, Human
gtccacgcggcaggaagtttttggtctgttttgcctgatgccatatccacagcacctggaaccattcctggtgcaaaatagccactcggctaatatttatgaagaaaatgaaaagtagcttgagtggacctctgtttgaggtagagagaaatgtctatctcccacctgggcacggtggctcacacctgtaataccagcaatttgggaggccgaggcaggcagatcactggaggtcaggagttcaagaccagcctggccaacatggtggaaccccatctctacggaaaaaaaaaaatagccrggcatggtggtgggtgcctgttatcccagctacttgggaggctgaggtggaagaaatgcttgaacccaggaggcgcatgctgcagtgagctgatatggtgccattgcactccagcctgggtgacagagcgagactccgtctcaaaaaagaaaagaaaagaaaagaaaagaaataaatatgtacatactacaataatgatgtaagtggtatgaataaaatctactaaaataaaaacaattagtatttttatttttttaatttttagttgcccaggctggtcttgaactcctgagctcaagt

SEQ ID NO: 63414 - DNA, 601 bp, Human
cgatctgggcactgtgggcatctgaagctggataatggtttgttgtggaggcctgccgtgtgcatcatagcatgttgaacagcacacttggcatctatccattagttgccagtaatgcccctccatatagttgtgacaaccaaaaatgtctcctggtattgccagtgtcttctaggggcagaatcactcccaatagaaatccattcgcttggactaatttgtgtttcctgtcttcaattccccatacctccctataattaccctcctataataatactcactgctcttcaacagtcatttytttccctcttttccttctttccttccttcctctctcttttctttcttctttctttctttctttttctttctttctctttcttcctttctttctccttccttccttcctttctttctccttccttcctttctttctccttccttccttcctttctctctccttcctcccttcgtctcttttttttttctttctgacaaaaacgtcttgctttgtcacccaggctgctgtctggagtgcagcagtgcagtcatggcttaccgcagcctcaaacgtttgggctcaagcaattctcccacctca

SEQ ID NO: 63415 - DNA, 601 bp, Human
gtgacccttcctctccacatctcgaatcttcgtctctactttctgttccagcctgtctccctcatcgtgtatctctccgcctccctttctctctcactctcccctccagcctgtgcaggccttatttctcttactggacacacaccttccttccccattctccaccaacccatccttatacctcccttctgcaaaaatacggttctcagcccctggatgagggttcctcgatctgggcactgtgggcatctgaagctggataatggtttgttgtggaggcctgccgtgtgcatcatagcaygttgaacagcacacttggcatctatccattagttgccagtaatgcccctccatatagttgtgacaaccaaaaatgtctcctggtattgccagtgtcttctaggggcagaatcactcccaatagaaatccattcgcttggactaatttgtgtttcctgtcttcaattccccatacctccctataattaccctcctataataatactcactgctcttcaacagtcatttttttccctcttttccttctttccttccttcctctctcttttctttcttctttctttctttctttttctttctt

SEQ ID NO: 63416 - DNA, 601 bp, Human
gaaaggggggcacgagagaggcagagatgtggcaaagtgggcagaaggagacatgagagacccagagatgcccatagatggagaagcagatgggaacagacacacagagatggaaagtacagagatgaagaaatgcagaaaaagacagagatggagacacaggcaaaaggagagagagggagaatgttattaatatttcactccaaatccagcttttttttttttgagatggagtcttactctgttgcccaggttggagcgcagtggcctgacctcagctcactgcagcctccatctcccrggttcaagcaattctcctgcctcagcctcccaagtagctgtgactacaggtgtccatcaccacacccggctaattttttgtattttttttgtagagacggggtttcaccatgttggccaggctggtctcgaactcctggcctcaagtgattcgcccacctcagcctccaaagtgttgggattacaggcgtgagccaccatgcctggcctccaagttcaacctttagaccccatttgtcactctccactccatcttcctcttccagattcctgttgtccacacatcatttcgggggggtct

SEQ ID NO: 63417 - DNA, 601 bp, Human
agggggccctagcgttcttcctctgtatgggagttttcctcggagcctggctctgtgcgcaatggccacccaccccgcccacccggcaggttctgtgatgtctgtgatctcacctgctgcaggcctccgggcctccggggattcttgagtcgggggaaggaacagctttgagacgaggaggcagaaagagttagaaatgcggggagccgtgaggagagaagacactcagatgcagtggcagagccaagcggaggacgcaggggccgcagagcccagggctgcagggactgccagacacacmcccccagctcccaggcctccctggaagaggctggttctgtccccagatgcttctggaacgtccttttaacccctgtctctcaggtccctgagccaggagactggctacacccttttcctccttacccaggcctcccacacacattcctcccgcccccacgctctgctcttggtgacccctgaccaggcctccagggaagggagcactggtccctgagtgcagtgagggcctggactcctgggtctgagggaggaggggcttgggggcctggactcctgagtctgagggaggaggggctgg

SEQ ID NO: 63418 - DNA, 601 bp, Human
gagagcctggatggatgacaatggaggaaacccaagttaaagtattcgggagggagtcccctttccccagctagtgtctccctcctccagagcctggtcgtttctgagcaggactcgtgggggctctgtttgaggaaggacagtcccctcacaccatctgcttccttactacttctctttggttctttttgtttttagacagagtctggctctgtccccaggctggagtgcagtggcgtgatctcagctcactgcagcctctgcctcctgggtttaagcaattctccagcctcagcctccygagtagctgggactacaggtgtgtcccaccatgcttgcgtaatttttgttttttggtttttttttgagacggaatcttgctctgttgccaggctggagtgcagtagcatgatctcgactcactgcaacaacctccgcctccaggttcaagtgattctcctgccacagcctcctgagtagctgggactacaggcgcctgccaccacgcccagctaatttttgtatttttagtagagatgaggtttccccatatcggccaggctggtctcaatctcttgacctggttattcacccacctcgg

SEQ ID NO: 63419 - DNA, 601 bp, Human
ttagggcacggctgagacgggacacatgtcctgggagggggccgggggtgatggactcaggagaggagctggaccagagcctgagcttccccaggaccgcaccttggatgcccctcctgatcctgcaggcccctcccctcaccagccctgacccacaggcctgacatcctcatcctgcctctgacgctggcattgtggcatgtggggccttatgactccttgttttggggcctgtcctaggcatggccggggtttagcaccatcccaggcctctccccaccagatgccagaagcacccacyccacccatgcagtgagacaataacaattatctccacacattgttaaacgtcctggggggttaagtcctccccagttgagagccttaggtctacacaaccccgtgactctctcaggccaggccagggaggaagcacttcctggcgcaaaccaagggcagcagaggcacctgagcctggacagggagactcagcacacggcccctccatctctcatgccctgaggtcctcggagatccacatttagatgctcaaaagacaggagggacctccacgatggtccagaggccgggagggcaggac

SEQ ID NO: 63420 - DNA, 601 bp, Human
cccctcagactcttgcacacacaccctcctcagccctgcagccaggacagggggaaatacatatagcaggagcagcctttgggcctcttatcttccatctcctgaatatgccacctaactcgtctttttattttacccaatagttttgagctacgttcttttggatacatgctataatcacgtgggcaaaaattttaaattcacagtaaaatgtgtccccagaatcaaccagggtctgtccaggctgtcctgagccttggtttgtgcacctggaagatctcagaggtggtttgatgtcagyagtgagactgtttgcaccctcttctagggatgtgtgtgattccactgtctgaatagtctctgattttgtggcatctcctaatggaagatcatggcactaattttatcctacggcacgaacactgcaatgaataatgttgtatctactcccacaaggaatatctaagtgtataggataaattcctaaaagcacattttaccagtgtcatatgttctttctgattttgaaagatatggtgaagttgtcctcaaataaaggtgggcaagtttacattcccaacagtgagcggtgaacataagt

SEQ ID NO: 63421 - DNA, 601 bp, Human
gagatttctataaaatgaacgtgggatagaggcaggaactcatgaagtttaattctatacagagcaatatatccgaaccaaccaaccgatcaaacaacttgtgactctccctgccttatcctatttccactgctctgctctgactctcttctctctctccattcagggtaacctgactgagtcctgggcagatgataacccccgacaccatggcctggctgcccactcctcaggggaggaaagagagatccagtatgcacccctcagctttcataagggggagcctcaggacctatcaggwcaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactacttta

SEQ ID NO: 63422 - DNA, 601 bp, Human; identical to SEQ ID NO: 63419

SEQ ID NO: 63423 - DNA, 601 bp, Human; identical to SEQ ID NO: 63420

SEQ ID NO: 63424 - DNA, 601 bp, Human; identical to SEQ ID NO: 63421

SEQ ID NO: 63425 - DNA, 601 bp, Human
cagaaggagcccactcagaaacccaggaggcgcatctcatctggggaaccacagagagaccctgagcacaggaggcagggcctggaggggacagagaccccctgagtcagcagaagcaggaagagcgggggcttcagccgacagtctggtcctcccaggatggaagctgtttgaggagggaagggttctgactcagggactccttggagagggtcagtgggggccctgaggtgaggtcagacttcccagtccagctttcaccttcttctcctgcagtttccaaggctaaggatagcagtargatctgcaggggcaggagaagggatcttgccatggtgccctgctgagccgctcaggggctgccaggcgaggaagggcctctcctgctggagctgagaaggagaaagcattcaggcccagcccctccccactcagacccaggggtccaggccccagcccctccccccacagacccaggagtaccggccccagcccctcctccctcagacccaggggtccaggccccagcccctcctccctcagacctaggggtccagaaccccagcccctcctccctcagacccagaaattcctttctctg

SEQ ID NO: 63426 - DNA, 601 bp, Human
ccagagagaggaggacagagacccagagagaggagaatagagccgtaggcacagaaagactgcccttccacccccatagcgagctggagacgctggtgcacctccagcagagacttgggcggcacctacttcatcttgcagtgggcggcagtgagcacccagcgctcattgaccaggacgcctccgcagtggagctgattgccactgagcagggccacctgccatgggtgggagcctcttgcacatggggcgccatcaataatcttgtcaccctgggctggatggagacatggaggagcaygtgggtagctagcattaggggaaggctgaggctgcacctcagggattcccagagtcagagatggacagagacagatgaaaatgtgtggagaaatacagagaaagcaagagatagggatagagacagacagaaggagcccactcagaaacccaggaggcgcatctcatctggggaaccacagagagaccctgagcacaggaggcagggcctggaggggacagagaccccctgagtcagcagaagcaggaagagcgggggcttcagccgacagtctggtcctcccaggatggaagctgtttg

SEQ ID NO: 63427 - DNA, 601 bp, Human
agagagggacagagacccagagagagaggagggggaacagagacctagagagaatgggggacagagacacagagagaggggaacagagatccagagagagggggacagagacccagagagagggagacagagagccagggagagagggggacagagccccagggagagggggtacagaggcccagagagaggaggacagagacccagagagaggagaatagagccgtaggcacagaaagactgcccttccacccccatagcgagctggagacgctggtgcacctccagcagagacttgggyggcacctacttcatcttgcagtgggcggcagtgagcacccagcgctcattgaccaggacgcctccgcagtggagctgattgccactgagcagggccacctgccatgggtgggagcctcttgcacatggggcgccatcaataatcttgtcaccctgggctggatggagacatggaggagcacgtgggtagctagcattaggggaaggctgaggctgcacctcagggattcccagagtcagagatggacagagacagatgaaaatgtgtggagaaatacagagaaagcaagagatagggata

SEQ ID NO: 63428 - DNA, 601 bp, Human
agagagggggacagagaccagagagagagggacagagacccagagagagaggagggggaacagagacctagagagaatgggggacagagacacagagagaggggaacagagatccagagagagggggacagagacccagagagagggagacagagagccagggagagagggggacagagccccagggagagggggtacagaggcccagagagaggaggacagagacccagagagaggagaatagagccgtaggcacagaaagactgcccttccacccccatagcgagctggagacgctggygcacctccagcagagacttgggcggcacctacttcatcttgcagtgggcggcagtgagcacccagcgctcattgaccaggacgcctccgcagtggagctgattgccactgagcagggccacctgccatgggtgggagcctcttgcacatggggcgccatcaataatcttgtcaccctgggctggatggagacatggaggagcacgtgggtagctagcattaggggaaggctgaggctgcacctcagggattcccagagtcagagatggacagagacagatgaaaatgtgtggagaaatac

SEQ ID NO: 63429 - DNA, 601 bp, Human
ccagagagagagggggacagagaccagagagagagggacagagacccagagagagaggagggggaacagagacctagagagaatgggggacagagacacagagagaggggaacagagatccagagagagggggacagagacccagagagagggagacagagagccagggagagagggggacagagccccagggagagggggtacagaggcccagagagaggaggacagagacccagagagaggagaatagagccgtaggcacagaaagactgcccttccacccccatagcgagctggagaygctggtgcacctccagcagagacttgggcggcacctacttcatcttgcagtgggcggcagtgagcacccagcgctcattgaccaggacgcctccgcagtggagctgattgccactgagcagggccacctgccatgggtgggagcctcttgcacatggggcgccatcaataatcttgtcaccctgggctggatggagacatggaggagcacgtgggtagctagcattaggggaaggctgaggctgcacctcagggattcccagagtcagagatggacagagacagatgaaaatgtgtggag

SEQ ID NO: 63430 - DNA, 601 bp, Human
tttaaatgaagacagtgccagtacagcgctgtgctgagccacgctagtacttacggcaagggaaaattcagtaagatccacctgctctttatttaaaatgtgacattttgtccatcatggacttctgcatgagtttttatttttatttttaaatattgcattatgatttatctcaatcactgaggtttttggtgcccccttaaggtttgggcctgaggccagcacctcagtctccttccctggtcccacccccactttctcacccctattaaactctctgtctcatccccagggccacatyggcccctaagtaaactcccacccctgacctaggcagagaatgaggtggaaaaagctgaggaggccaggcctggggggagggcaaggccgggcttggtacccagtcactcgggtcaagctctgtccctggggcatgcagacagggtacccaggactggggaggaattgggggggagggtctcacattgcaggcgtttttcttggagtcggggatgccagcgcacagcatggaattttccagtaagtccttgtaaaccttcgtgcagtcctggggggagatgagcttgacatccacgcacat

SEQ ID NO: 63431 - DNA, 601 bp, Human
tgggcatggtatccacattttaaatgaagacagtgccagtacagcgctgtgctgagccacgctagtacttacggcaagggaaaattcagtaagatccacctgctctttatttaaaatgtgacattttgtccatcatggacttctgcatgagtttttatttttatttttaaatattgcattatgatttatctcaatcactgaggtttttggtgcccccttaaggtttgggcctgaggccagcacctcagtctccttccctggtcccacccccactttctcacccctattaaactctctgtcycatccccagggccacattggcccctaagtaaactcccacccctgacctaggcagagaatgaggtggaaaaagctgaggaggccaggcctggggggagggcaaggccgggcttggtacccagtcactcgggtcaagctctgtccctggggcatgcagacagggtacccaggactggggaggaattgggggggagggtctcacattgcaggcgtttttcttggagtcggggatgccagcgcacagcatggaattttccagtaagtccttgtaaaccttcgtgcagtcctggggggagatgag

SEQ ID NO: 63432 - DNA, 601 bp, Human
acaaaatctcagtaactgcaatacacaatacttcaatgcagtacttaacgaaatcaaatgtaatacataaaactgcatgatgggcatggtatccacattttaaatgaagacagtgccagtacagcgctgtgctgagccacgctagtacttacggcaagggaaaattcagtaagatccacctgctctttatttaaaatgtgacattttgtccatcatggacttctgcatgagtttttatttttatttttaaatattgcattatgatttatctcaatcactgaggtttttggtgcccccttarggtttgggcctgaggccagcacctcagtctccttccctggtcccacccccactttctcacccctattaaactctctgtctcatccccagggccacattggcccctaagtaaactcccacccctgacctaggcagagaatgaggtggaaaaagctgaggaggccaggcctggggggagggcaaggccgggcttggtacccagtcactcgggtcaagctctgtccctggggcatgcagacagggtacccaggactggggaggaattgggggggagggtctcacattgcaggcgtttttcttg

SEQ ID NO: 63433 - DNA, 601 bp, Human
aatatatctttgaggaaaggtaaagtcaaatttgacttcataggtcatcggcgtcctcactcctgtgcattttctgttggaagcacacagttaattaactcagtgtggcgttagcgatgctttttcatggtgtcatttatccacttggtgaacttgcacacttgagtgtagactcctgggtcattgggttggccgcaagggaaagttccccaggacaccagaccttgcagggtacctctgcacaccaacggtccccctgagtcaccctagagggaatagagccggagattaactttggctkcagatcaaagcccaactcattctcatacattcctcagttatcggtctttgtcttgcagattatggacttccaccatagccaatgagaagagactcattgtctctggggactaatgggagagctagtgctagggacacactaggtcctttgaagacactggtttgacccttggccaatgagaccaattgcagagaaggggtggggcttccaggatcagagcactctttattttccaatgttaaggaccctgctccaagctagtgggagaaggaacatcatctccaaggggtggatgcgtgc

SEQ ID NO: 63434 - DNA, 601 bp, Human
cacccactgtaaaggaggagggtccggagccgtggcccgggggtccggaccctgatgtcccaggcactgatgaggccagctcagcctgcagcacagactggggtgagacagggccctggagttgatgtgggggcttggggaggggtttaggaagggagaaagaaatagaaatgggaatgggaggccctgatctttgctttttgttcttgctttctccttaacatatacatctttctaaattgcaatttccctgaatgtgagcagcaactcctctctccctccatcctctggctctttgccyggggatctcctgtgggcccatctctctggttcctgtttctccttgtggctttctcatggcctctacctacccaccccagtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggac

SEQ ID NO: 63435 - DNA, 601 bp, Human
gtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgtgagtgcagcgggagggggcggtgccggcctggccccccgcctagccctggggttctgctgaggcctgcatccccctacaggcgtcctttctgaagaacagatccggaagaagaagattcggaaacarcagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacggtactgccccctccacaaccttgagtgtgacggtcccaatggggtagagccagctgggccatcacccag

SEQ ID NO: 63436 - DNA, 601 bp, Human
agggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacggtactgccccctccacaaccttgagtgtgacggtcccaatggggtagagccagctgggccatcacccagggtgtgggagaatgaggctccagagggcaggggctttgggaagaggrtcccccagggtgcaggcttggcctcaaggtggccacccagacttaggctcacaaagacctgggagtgaccctggtctcctgtgtcccagccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgaggtaatggtccatctgcccacaaggaacccca

SEQ ID NO: 63437 - DNA, 601 bp, Human
ttcacggagctggccatcatctcagtccaggagatcgtggacttcgctaagcaagtgcctggtttcctgcagctgggccgggaggaccagatcgccctcctgaaggcatccactatcgaggtaatggtccatctgcccacaaggaaccccagagatagctccaggacagatgctgggagcagagttaaggaagaccagtgcttgccgttgtaggatgacattccacggcgaatagagtcttctatgagccaaggagagaaaggaaaaagggtctgaggctgagaaaattgaggatcaggcyagaggcgctattgcagagaaaagttgccaaaaaggcttttcagaggagttagcatttgaatcaaagtagggataacatataagtattgagcacgtgctgtatgccaggctctattccaagtgttggcatatggggcaaagaacaaagcagatcaaaccccgtgccccaaaccttgtgctcacctggggaaagagtatcctaaggagatggggatgcagcatgtgcggaagcctgaagtggagaaagagctcgggctgtctcacgtgatggctgcacgctggtgtggctgagagaacaggg

SEQ ID NO: 63438 - DNA, 601 bp, Human
ctagaggcgctattgcagagaaaagttgccaaaaaggcttttcagaggagttagcatttgaatcaaagtagggataacatataagtattgagcacgtgctgtatgccaggctctattccaagtgttggcatatggggcaaagaacaaagcagatcaaaccccgtgccccaaaccttgtgctcacctggggaaagagtatcctaaggagatggggatgcagcatgtgcggaagcctgaagtggagaaagagctcgggctgtctcacgtgatggctgcacgctggtgtggctgagagaacagsggggaaggggacaagggataatcctggtgagattagacccccatttgggccaggaggggagggactagcagctgaagggtcacagggctcaagctccccctcccgctgccgcccttagatcatgctgctagagacagccaggcgctacaaccacgagacagagtgtatcaccttcttgaaggacttcacctacagcaaggacgacttccaccgtgcaggtagggcccaggggaggcttcggggaggcttggcgcccctgctggctggaagacctggggccaactcatccctgttggagtc

SEQ ID NO: 63439 - DNA, 601 bp, Human
cccagagcgcagccttccctgcccgccttgtgtaaaatagaaccatggctcagcagggcccttcacacttctctgcactgcctggttccattgaactcacagccctctgacaggctgggcctcttcctaatgtgtttgtctatgaccggtcccctaggctctcaaatgtaagtgctggagcctggcacgtggcaggtactcagtgacatttgatgactgaatgaacaagtcagttttgggaatgagtttgggctttaccttgagcagtggaagccagcgctgggaccagcacgatgtgacmtaggttttaaaagcttccctttgcctttgtgaaggggacaagaatagggactcgggaagctgcagccaccgcccaggtgggaagggagggtggtgataggatagtagaaaatactgaagaaacatgcaccctcattcattccttcactgggcagcatgtgtggcacacctactacatgccagcactcatgggcacggggcacaggtggacagaaatgacaagaacgctgtaattactgctgtgttcccagccccagagactgtgggcagcgccagggtccaggatgtggggcacggtttc

SEQ ID NO: 63440 - DNA, 601 bp, Human
caggaaaatgttctggctcacaaaagaataaattgcctaatgcttttggaggaaaaaatatgaaacttctttcagctaaaatcaagtctgataatacatttaaggttactcagctccagatgcccttagaatttctagaaaggtgtggtcagcatgaggttagcctttggtgatgtttatggacaacaggactggcttccaatgcaggaaaaggtcagaggtgttctacccttcctaaaggttttgcagagagaattggagggtaaatctatgacagaaactgcatagggattagtcgacygttccggttacctagtgcaaatcctgagcaccattaggatcaagggattaacctggcaactgttatgtaactctttctgaggaggcttctttcatataatgcatcatactcagacatgaacactttctaagcctagaggtgtaacttcaaaattatgtaaaaatgcaaaagaaacttgcaagaaaaaaggggatgtatcattggggaatatggatgtcacgtgtgatttttaaattcttcggggttgctgttggggtgtcaaaggaattcaaggaaagcttcttaagacagaattttaag

SEQ ID NO: 63441 - DNA, 601 bp, Human
gttatagaatatgaggtttcaggaatatgcagtgtggccagtaaagagagtcattgttagcacgagccaaagactgtcagggaggtttgcagttaacagtattagcataggctggtgtgatgggtcatgcctgtaaacctagcacttcgggaggctgaggcgggagggtcacttgagcccaggagtttgaggctgtagtgagctatgattgcaattgcaccactgcactacagcctggctgatggagcaagaacttgtctctcttaaaaaaaaagaaaaaagaatattagcataaatctgyaatgggtgaaataaggaatcttatggagacaaagcccccacacactagattttatagaggagactgtctcagggtaagaggcaaaagcaatttggagttctctggggcttttcaggatcttccttccaagagcaagttttgttaactcttacgaaagaaaggaagaaagaaaataacgtcatccaaaatgacacattaattgcttaaatttatctttttcaataattttctttgatttgtatttgaagaatggcaatgtgcatttctgtagccaaattaaagtctgagaacaccatattg

SEQ ID NO: 63442 - DNA, 601 bp, Human
agaatatgtaaagcttaaagaaattgcagatgctgtaaaagactatagatatcactgagtccattttcctctcttcgtaactgacagaactggtagtcacagagaagtacagcatcataataaattcacgtagaatgcttgtggcaaatctattttatttatttatttttaaattttaatttgttatacctaatgtgaagctttaatttaatttatttatttaaaaattgttttcagtggcagatccatgggaacagcatagctacctagatttctgagttttaaaatctatcaattgtcygtttacacaactgatagattgtgtaagtaatgtagcagaaggtaagtttccattccattccattaagtgcctgcattgatttatactctgttttcttaaagatcccttttaaagatgataacttctccccttttgtgtcaacacaaaatactgagctttcttgttgaagtacttttcttctccagcctgaaataaagatctaataaccaatggtccccatgacttgaaagatcttcttttttttatctttcactgtctaaggaggctgaaagggaaacatcagccgcccggggggagtta

SEQ ID NO: 63443 - DNA, 601 bp, Human
tgataaacagtagcacttgtagtaatcagtgtccttcccaggcaatcctcagtgtctctttctgcaggcaaataccaatcctgggatcttgaatgaattttccagccatgttataaagcaaattttctattcttttagatcaactgcttccgtattttggcaaggtgcatacaagaccagcaaatttgctttgggatctggaagatatgcttgactctgacagtgtatttggaataatgtaaagaggtttatagggagtgaaggtctgaggtctttgacctggctctagtctcagctctayaactatgtggtttttgctaattatttcatctttctgtgtgtcagcaagcttctttgtaactcagggataataacatcttattgtctaaaacaagaagctggattaaaagatgctttgtgatcgtttctcaatatgtgattggatataggcaattcaaaatgtaaaggaatagaagaacaattagagaagaaaccgatctagattggtagggaagactatggatacctagaccagggagattcaaagtgctcctctttttcattttaacccttggcctgactagaattccacttctgcctc

SEQ ID NO: 63444 - DNA, 601 bp, Human
atcttattgtctaaaacaagaagctggattaaaagatgctttgtgatcgtttctcaatatgtgattggatataggcaattcaaaatgtaaaggaatagaagaacaattagagaagaaaccgatctagattggtagggaagactatggatacctagaccagggagattcaaagtgctcctctttttcattttaacccttggcctgactagaattccacttctgcctcctccttagtggttgtggtttggggagactctgtgtaatcagtgggctgtaccccacagggaaccccccagtcaamagctgtggatcacctccccaaagaggaagcagaatgaaaccaacagagatgcctggtgcaacaattaagcaattggtctgatccttcctgggccacagggccacgctagggaacttcccagtcaggggacaatgagcaggagagaggagtgaagtgtctctgcctgaagggtgtctttctgtgaagaagctctcttggggtgaggttggcttacgtgctcttcttccatctcttgcagatatcacagtgatttgtccatgggaggcattcagccacctggaattgcatgagctcgctcag

SEQ ID NO: 63445 - DNA, 601 bp, Human
cttgggcaaatcacttaacctctgagagtttcagtcaccgtcatttgtaaaaacgggaacagtaatcctgttttgcagtgttgctgtgagaattgaaaaaaatagagttaaatgatcaagtgtttagtgcaatgcctgttacataacctttcaaagaatggtagctgcaattttcacagtgtctaaaggcagagagactaggagactattattccagggagaaatgctgggattctgaactaaggcatattattgggagtaggcaacttaattgagaaaatgctaggaggtaaattttccrtaacttggttactgagtggtggggaggggaggaataaaggatttcatctcgtctcctggcttcaattgaggttatattattaatagctgtcattaggtttaaaattttctaaatggtttcatgtacatttatgtgttctcatttgtatgcatatatgtgattgtacattttatgtagattcacactcttagaaccaagtaaggagggcaggttttccttatggttagatttaatggcttggtttacagcattcagagaaaaaatagtaacgtttgtaaggcacaccaagatgatggttga

SEQ ID NO: 63446 - DNA, 601 bp, Human
ttttcatgttttaaataggggtaatgacacctacatcacaggattaaagtgagaaggaaataaggtaatgattgtaaagcccttagctttatagtgttatgcaatactgtcattgttgcagtaaactacatagaaaggagtaataagaatagagtgctaaaatagtttctatattagaccgtttttgcattgctataaagaaatacccgagactggataatttataaagaggtttaattaattcacggttctgcaggctgttcagaaaacataactctggcatcagcttctgggaagacckcaggaagcttacaatcatggcagaagatgaagtgggagcaggcacttcacatagcaaaagcaggagcaagagttgaggttgggtgtgggagggggaagtgccacacatttctaaatgaccagatctcatgagaacccactgttgtaaagacagcaccaaaccttgagggatctgcccccatgacccaaacacttcccaccaggccctacctccagccccggggactgcaatttaacatgatatttgggcagggacaaatattcaaactatattggtttctgaagatggaagcacagcaag

SEQ ID NO: 63447 - DNA, 601 bp, Human
tgtccaaactacaggactcctttaagagagtgaaaggataaatcacagagtaagagaaaatgtctaatatgtgtatctttcattttataaatatataaagatttcttacatgtaattgagaaaacaataacccaggaggaaaatgagcaaaagacttgaactggctttcaaaatggaggatatccaaatggacaatagttataggaatagatgctcaatttcataagtactcagtaaaattcaaattaaaattgtaatgagatgccaatggaatgtctcagattcaattatagaatttctrttgtgttcttttttatagttttttatttctctgctaagattttttttctaatattcaccaggagtacattttccattttgtccattggcgtagcaacaatagctgctttaaaacccttgtgtgctacttccagtatcttgggtcattttggggtcagtcatcattaattgtcctttttcttgaatatgagtcatactttccagtttgttcttgtctagtaatattggagtgtgttttggacattgtacatgatatgatgtaggagctgtggattctgttatattcctctgaagagacctt

SEQ ID NO: 63448 - DNA, 601 bp, Human
atgccccttttcaggtgactacattttaagctttgtagatgtttcacagtatccagctcataaaatacggtcagctctctatatccactggtttcgtatccacaaattcaaccaaatgcagctcaaaaatatttggaaaaaaaaataacaataccacaaggaaaataatacaaaaaatatagtagaacaacaatttacatagtatttacattgtattattcataaatattctaaaatgatttaaagcatgtgagaggatgtgcataggttttatataaatactgtgctgttttatgtaagrgacttgagtactatggattttggtatcctcgaaggtcctagaaccagttctatggggatactgatggatgtctgtatacaaatattattttacaagcctcgtggaaatgaagtcttcaactctaccgtgattttagtccatttacttagatgatttcgtttttgctattctgtttccttaggagattttgcatttttctgaaaataatttttcctgtatagaattaaataggctgattgaaattgttctaccaagtagtggtaagacctgtcatgttttatgtgcacactgctttttgta

SEQ ID NO: 63449 - DNA, 601 bp, Human
tcattttcttggttacttaatgctgggtggatttgaatgtagttcatctcgtctaaaacatttaagtcctgtgcagatctggaaagaagtaaccttaaaataattattatgtaggcatggtgaattgtatggataaagtaaacatgggcttatttttcaatttttaggatgggagagggacattccttaaattcagagaaataaattaaaataaacaagtgtttctacattaacagaggagctcattattcacttcagaaggtggtccaagctgcagaagatatattttggtaacatttakctatattcatgaataaaagagcaggtacaataaactaagatgttaggcataaattctattctttgacagtaacatcaaagagggaaagtataataaactatgtttcttagtgatgtggtagagatcagttgtttggctgatgaccagtagtattgcttagatgtttttcatggtaaccaatgacagacctttgtcaagatatctcaccagtttactcagtttattccttttctgatcagcatactcttctatgaaaaaacaaaactatatttgtaataagaaaaataatcttaaattcat

SEQ ID NO: 63450 - DNA, 601 bp, Human
aactactgatcttcttttgatctctatagatttgcctgttctggaaattacacagacttggaattatataatatgtaatcttatgactggcttctttcacttaccacattttaaagattcaacagttgtgtgtatcagtacctcattcctttttttataactgaataatattccaccgcatgcatattctacattttgttactccattcattactgagattgtttccacattttggctgttatgaattgtgctgcattaaacatttatgtacaaacttttgtgtgacatatttttattttkgggggtttatagcctaggagtggagttgctggccatataagtcataaccctatgtttcaccatttgaagaatagccagactgttttctagcatggctgcaccattttacattcccacaagcagtaaatgacggtcccattttctctaagttatgtaatttattgctatacagttgttcatagtgttcctttataatcctttttatttttgtaagattactagtaatatcccctattttatttccacttctagtgatttgtgtcctgtctctttttttctcggtcactttagctaaagatt

SEQ ID NO: 63451 - DNA, 601 bp, Human
ttatgtgtcttaagttatttttgggtaagatattttatgattaattgaagtgatatttaatttaaattgagacatttattgaaattaaaagtaatggctaaatatcaaagaccccaaaatttaaatataggtaattcaacttcatcaattcatagaatgtgctgctactaggctatactttgtttcataatattatctaagctatagcttaaattaaggaatatactatgtgtaataagctaaaaagaatttttattttctcccctccttaaaaaatatattattaagattttttttaagacaagataatgctaagtaattttatttatgtatttagttctgtcagtatggaaatttctacgtctctctcggcatttggtttattgtttaaactacaactgtctatgaataattcttaattcaacttttcccagcagggaggaagtcaagggaatgtactctagcctctctttttttttctttcttcaaactcctgaaattttaatacttctattagctatacccaagtagaatcttgaggacaagggagtttttgatgtgacccatataggtcagcttcctgatatccagagcagtgtgg

SEQ ID NO: 63452 - DNA, 601 bp, Human
aggcgcccgccaccacgccctgctaattttgtttttgtatttttagtagagacagggtttcaccgtgttagccaggattgtctcgatttcctgaccttgtgatccacctgcctcagcctcccaaagtgctgggatttgaacttttaaattaatcaattttgttgtgtgccttatttgaggtagtgtgctcttagcttgataaccaacataatgcaatggatagtatgcagttatatgtggttcctcacttctagtgaggatgttgcatattatgataattttttgtgcccaaatttttgtrtagcacatggagtttagtattgaagcatttgcttctgatacaacatgagattgatagtctatttccaaggtagtctctaggctcaagaatttgggctgttccagagtctacataggatgtggatttaccctttgaggaaacaaatgttttcaatcaagtataattcattccttagccatggaccagagttacatggctgccattcaatgcttatacttttatagtttatccttatgacattacgttagcagaaacccctcagacatgtgaaatatatgttaatgttgaatttattttgct

SEQ ID NO: 63453 - DNA, 601 bp, Human
gtgttttgacatttaccatagaacttaaggtaatatgttatcattatttttaaagcatgcttaagttgtttaatataattcaacatgagagtgattaggttcaccagatggcccttttatataaaaagattgtctctcattcctctttcattagtctttccagtccttcctcatgagacagctttaaatttgtttaaaaaccttgaattgatgtttgaaatttgtggggacagcaggaagtaggggatcgatgttgctactttaacataaagcagtttgaatctacatgcagtcattttgragtgattacaaaagtcacaatttagaagcatttgatttttaagccctactattctttaatatattgtattttaaggtaattctggctagaatattgacagttctgaaagctaaaaagagaaaagtttcaaaaagttcagtcataagtctatgatttccttgtaaagcccagactgactctacttctttgggcttatgaatttagaaaggacatccaatttcttcctgctttgaattagaaaatgcatgtttctctgtggtttgtctccctggatcctaatgtgaacagatctgtttcctc

SEQ ID NO: 63454 - DNA, 601 bp, Human
cagaggcaagcctattaaatgtttatacctgttacttctcatcagatacatacttggcattctcttttctcaaatattcccaacacaggtgccttgcaccttttcctactcctcactctcttttcctttccttccaccactaggttcaggatggatgaactgtttctgtttcctagacctgtggtgctttttctctcttggactcagagtctgactctattttatatctacttgagctatgggctaagctgttttcctttaagcacttgccacagcagttttctgacttgttttccttttsttttgaaactttatttggctttctacctccaacctcacatccaactcagaattgtgttttatctcttcttctcactttcagctgcttgaccaaagttttatcttctttgctcattaacattctaatacaaacagtccccttcattttttttattataccccattctcaagtagttctagactagagctgcttatatcaaatctttgccacttcttttggataacaccatctacctatagtggcaagtcaggaaattttgatttagcccatttagcttgaaattatcttacagtatttgta

SEQ ID NO: 63455 - DNA, 601 bp, Human
ggctcactgcaacctctgcctcccgggttcaagcgattctcctgtctcagcctcctgagtagctgggattacttacaggcgtgcaccaccatgcctggctaattttttgtatttttagtagagacagggtttcaccagttggccaggctggtctcaaactcctgacctcaagtgatccacccaccttggcctcccaaagtgctgggattacaagcgtgagctaccgcacacagccgagggttcttatagattactttgcagtgggatgtggtccgtctgtcccacctgggccctctcctaycctggcctaactcctgatagtttatacatacacaactgagtaattttgagaggcccaaggtactatagatattttacctcgtagccattatatattcacgaatcattaggaactgaaggcaattccagtttctgtcatccttttttacagtgctctttagtcattctatattttgttacaagtgtttatcttttcctacctgtgtcctctataaggagcttggttaggaccttacatattagggtaaaacgaggtttttcttttcactcttaggtatccataagactgacaagtaattta

SEQ ID NO: 63456 - DNA, 601 bp, Human
ttacttacaggcgtgcaccaccatgcctggctaattttttgtatttttagtagagacagggtttcaccagttggccaggctggtctcaaactcctgacctcaagtgatccacccaccttggcctcccaaagtgctgggattacaagcgtgagctaccgcacacagccgagggttcttatagattactttgcagtgggatgtggtccgtctgtcccacctgggccctctcctaccctggcctaactcctgatagtttatacatacacaactgagtaattttgagaggcccaaggtactatasatattttacctcgtagccattatatattcacgaatcattaggaactgaaggcaattccagtttctgtcatccttttttacagtgctctttagtcattctatattttgttacaagtgtttatcttttcctacctgtgtcctctataaggagcttggttaggaccttacatattagggtaaaacgaggtttttcttttcactcttaggtatccataagactgacaagtaatttatcccaagtcattgacctaagaagtgttctccataaaggcatttatggttgatttctaataggtttaat

SEQ ID NO: 63457 - DNA, 601 bp, Human
ctcaggaggctgaggtaggaggattgcttgaccctgggaggttgaggttgcagtgagccatgatcacatcattgcactccagcctgggtgacagagcaagtccctgtctcaatcaatcaataaaaggaaaataaatattatacattactatttttattttaaaatataaaatctgtttctttagtgaattaaaattttaatttcctcatcatagatatttttattgttttctcagttctttcccataagtcaattttactttctggttgcttttatacttcctgattgtaggttcctaacrtgtcagcagtatcaggtaatagaacaaatggcggtcatatcatgttacattaaagctatgtgtataagttatgtgcatttttcaggttctaggtttataggccttcttttattgaagactcccaatttggtgaaataatttattttttaggaattattgggttgaagttgaatctagcaacgtttgatggcatattaatttatttagaggttttgcctcatttaaatagaaatcttttatgtctatcctatttcttgtatttttattttctatgtggtcaaaatatgaccgcatggaaac

SEQ ID NO: 63458 - DNA, 601 bp, Human
ataacagttgctttcactatctggcaacaggctggtttgtctgcctacaatcatgctgtgataaatggagctatgttaactctggttttgtgtatcagagaaaacagatgtagtctggaactggaggctataggaaatataaagcctacttaacttaatcttcatagtgcttgtttttgtaactgatgagctggtcagtttcaatagcaaagtttatgtcagccatgtatttaatttcaatttatgacttaagtttttaagttgttcatttgctaaaatcatacctaagtccttgtcaggragttaaaaaccttgattaagtataaccagccttagtttaaatattgattttttttacctaaccaaaattactccctattataattatagggcagctgctgttacctttttttggtagtcttaccagaatctaatagtattagaaactttaaaagtaaaaggaaactactcaaagaagctgaacaaaaaaatcagtttagggccatttgttaatttgtagtgtgaaacaaaaggcatatagattggaaaggaggaagtataactatccctatttgtaggtgccattattgactatatagaa

SEQ ID NO: 63459 - DNA, 601 bp, Human
gaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggmttctttagaaacttccttggagaaaattaatgattcaagattgagaaaacatttatacaacctcaggccacactcttctctctcttgttattaaccattgcaccactgctatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaa

SEQ ID NO: 63460 - DNA, 601 bp, Human
atgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacwtccttggagaaaattaatgattcaagattgagaaaacatttatacaacctcaggccacactcttctctctcttgttattaaccattgcaccactgctatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacattt

SEQ ID NO: 63461 - DNA, 601 bp, Human
aattaatgattcaagattgagaaaacatttatacaacctcaggccacactcttctctctcttgttattaaccattgcaccactgctatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatayatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtcta

SEQ ID NO: 63462 - DNA, 601 bp, Human
caatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatmtgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggt

SEQ ID NO: 63463 - DNA, 601 bp, Human
aaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcracactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagtt

SEQ ID NO: 63464 - DNA, 601 bp, Human
tttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataatttaaaacgataaaaagcaacataattttatatgttgtaccttgtacttccttataaggtacaacactrcaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttcc

SEQ ID NO: 63465 - DNA, 601 bp, Human
agatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagyagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaa

SEQ ID NO: 63466 - DNA, 601 bp, Human
gggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatayaatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctga

SEQ ID NO: 63467 - DNA, 601 bp, Human
ttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtamcactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagc

SEQ ID NO: 63468 - DNA, 601 bp, Human
taatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcrgtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctca

SEQ ID NO: 63469 - DNA, 601 bp, Human
ctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggrtgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggc

SEQ ID NO: 63470 - DNA, 601 bp, Human
atggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaaaaaaaaaataaataaaaaaaaawaaaataaaataaaataaaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattat

SEQ ID NO: 63471 - DNA, 601 bp, Human
ctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacrtttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtctagtaattttacttcaaaaataaaagagaattttctttaccatcaaacaacgttgctgtaatgagtggtgatatatttagtcctagaggaccaaagagaaataaaatggctttgattatgctggtttaagaaaatatatccg

SEQ ID NO: 63472 - DNA, 601 bp, Human
gtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacgtttccatggtaagtattctttaagaaaaaataaaccaagatttcatcagagacagaaattactgcaaactgtacttacyagtttctggtgatttgtataactgagctttcaatttcaaaaattaaaaagttctctttagtgtaacatatttttgtgtctagtaattttacttcaaaaataaaagagaattttctttaccatcaaacaacgttgctgtaatgagtggtgatatatttagtcctagaggaccaaagagaaataaaatggctttgattatgctggtttaagaaaatatatccgattaaacagaggttaatatttgtgatgtttgatttagtaaaattataagactaccaaagaaaactagaagagcaaaata

SEQ ID NO: 63473 - DNA, 601 bp, Human
tcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacgtttccatggtaagtattctttaagaaaaaataaaccaagatttcatcagagacagaaattactgcaaactgtacttaccagtttctggtgatttgtataactgagctttcratttcaaaaattaaaaagttctctttagtgtaacatatttttgtgtctagtaattttacttcaaaaataaaagagaattttctttaccatcaaacaacgttgctgtaatgagtggtgatatatttagtcctagaggaccaaagagaaataaaatggctttgattatgctggtttaagaaaatatatccgattaaacagaggttaatatttgtgatgtttgatttagtaaaattataagactaccaaagaaaactagaagagcaaaataaccaaaatttatataaagaattcaatgttgat

SEQ ID NO: 63474 - DNA, 601 bp, Human
gtttattcctagttcagtaacagcgcaatgagatcctaaattatgaggtactttttgtttatcttattgtctcattggcaaccagcaactcctgttgcatttttgacatgggaatctatcagggtgtggttaataaagtacgtttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtcyagtaattttacttcaaaaataaaagagaattttctttaccatcaaacaacgttgctgtaatgagtggtgatatatttagtcctagaggaccaaagagaaataaaatggctttgattatgctggtttaagaaaatatatccgattaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctg

SEQ ID NO: 63475 - DNA, 601 bp, Human
aagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtctagtaattttacttcaaaaataaaagagaattttctttaccatcaaacaacgttgctgtaatgagtggtgatatatttagtcctagaggaccaaagagaaataaaatggctttgattatgctggtttaagaaaatatatccgattaaacagargttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttccattttactaaaaaataataacacagttcgttatgataaatcagtatagatctttaggctcaacacaaccctgctaccttttaaacttttttattatacaacaaacacatatgcatta

SEQ ID NO: 63476 - DNA, 601 bp, Human
ggtgatttgtataactgagctttcaatttcaaaaattaaaaagttctctttagtgtaacatatttttgtgtctagtaattttacttcaaaaataaaagagaattttctttaccatcaaacaacgttgctgtaatgagtggtgatatatttagtcctagaggaccaaagagaaataaaatggctttgattatgctggtttaagaaaatatatccgattaaacagaggttaatatttgtgatgtttgatttagtaaaattataagactaccaaagaaaactagaagagcaaaataaccaaaayttatataaagaattcaatgttgataattcaaaggtttagaattttttccacctttcaaatactaagttgctgttatagatttactaccattattacccagattttccattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgt

SEQ ID NO: 63477 - DNA, 601 bp, Human
aaaagataatatactgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagaytagcctggccaacatggtgaaatgccgtctctactaaaaatacaaaaaattagccatcatagtggtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaaca

SEQ ID NO: 63478 - DNA, 601 bp, Human
tgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagactagcctggccaacrtggtgaaatgccgtctctactaaaaatacaaaaaattagccatcatagtggtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtg

SEQ ID NO: 63479 - DNA, 601 bp, Human
tcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagactagcctggccaacatggtgaaatgccgtctctactaaaaatacaraaaattagccatcatagtggtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcac

SEQ ID NO: 63480 - DNA, 601 bp, Human
acttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagactagcctggccaacatggtgaaatgccgtctctactaaaaatacaaaaaattagccrtcatagtggtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttcca

SEQ ID NO: 63481 - DNA, 601 bp, Human
ttttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagactagcctggccaacatggtgaaatgccgtctctactaaaaatacaaaaaattagccatcatagtggtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctg

SEQ ID NO: 63482 - DNA, 601 bp, Human
tgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggaga

SEQ ID NO: 63483 - DNA, 601 bp, Human
tggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccragcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtc

SEQ ID NO: 63484 - DNA, 601 bp, Human
ttctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagyatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaattta

SEQ ID NO: 63485 - DNA, 601 bp, Human
tgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgtkccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattg

SEQ ID NO: 63486 - DNA, 601 bp, Human; identical to SEQ ID NO: 17695

SEQ ID NO: 63487 - DNA, 601 bp, Human; identical to SEQ ID NO: 17696

SEQ ID NO: 63488 - DNA, 601 bp, Human; identical to SEQ ID NO: 17697

SEQ ID NO: 63489 - DNA, 601 bp, Human; identical to SEQ ID NO: 17698

SEQ ID NO: 63490 - DNA, 601 bp, Human; identical to SEQ ID NO: 17699

SEQ ID NO: 63491 - DNA, 601 bp, Human; identical to SEQ ID NO: 17700

SEQ ID NO: 63492 - DNA, 601 bp, Human; identical to SEQ ID NO: 17701

SEQ ID NO: 63493 - DNA, 601 bp, Human; identical to SEQ ID NO: 17702

SEQ ID NO: 63494 - DNA, 601 bp, Human; identical to SEQ ID NO: 17703

SEQ ID NO: 63495 - DNA, 601 bp, Human; identical to SEQ ID NO: 17704

SEQ ID NO: 63496 - DNA, 601 bp, Human; identical to SEQ ID NO: 17705

SEQ ID NO: 63497 - DNA, 601 bp, Human; identical to SEQ ID NO: 17706

SEQ ID NO: 63498 - DNA, 601 bp, Human; identical to SEQ ID NO: 17707

SEQ ID NO: 63499 - DNA, 601 bp, Human; identical to SEQ ID NO: 17708

SEQ ID NO: 63500 - DNA, 601 bp, Human; identical to SEQ ID NO: 17709

SEQ ID NO: 63501 - DNA, 601 bp, Human; identical to SEQ ID NO: 17710

SEQ ID NO: 63502 - DNA, 601 bp, Human; identical to SEQ ID NO: 17711

SEQ ID NO: 63503 - DNA, 601 bp, Human; identical to SEQ ID NO: 17712

SEQ ID NO: 63504 - DNA, 601 bp, Human
ctactatggacccataaaatagcggcttgtgcagaatatctccactgcataaagatcaatgaattcagacagactgcattcattgggagaggtttctattatttattctcatgaatatatcccaagcagagaggcataaacatcaatcagatagcctcaatgcacaaactacatttctgatgtgaagaagaatttctgaggtgaaattactgagtttttaccatgtgatgccaccaatactttgtttacacataatgtgtaaaattaccatgcggctgtccaaatatattttgttgacagstaatattatgtaaaattgcatttggtatcgatgcttgctttcatctaacatcagccctgtatggttaagtgacctggacttttattttagtttctttccaaacagtagctttggtatacatcaggataatgtataagcatttctgatggtgatgaaatgatttgatgatgatgatgatgatgataatgactatatttagacaaaaaggacatgaaaaaggggcagactttgtatctgatagatgcccatcagataatctgtctacattatatgtgaaattggcatttactcctggacctt

SEQ ID NO: 63505 - DNA, 601 bp, Human
catctacaaataaccacttgaggcttgatttctaatggataagttcataccaatcaactgttaagacatttgcctaaattagtcagctgcatttaaaaaaaatcattaaggtgaagttcttaaaaaattattgttactagattttaaattgcactgcagtgactattttagaactacaaaacagccatggctactatggacccataaaatagcggcttgtgcagaatatctccactgcataaagatcaatgaattcagacagactgcattcattgggagaggtttctattatttattctcmtgaatatatcccaagcagagaggcataaacatcaatcagatagcctcaatgcacaaactacatttctgatgtgaagaagaatttctgaggtgaaattactgagtttttaccatgtgatgccaccaatactttgtttacacataatgtgtaaaattaccatgcggctgtccaaatatattttgttgacaggtaatattatgtaaaattgcatttggtatcgatgcttgctttcatctaacatcagccctgtatggttaagtgacctggacttttattttagtttctttccaaacagtagct

SEQ ID NO: 63506 - DNA, 601 bp, Human
agggcaacagagttgacgtgagcaacagatgattaattccctgcagtggcaaagggctactcttctcatctacagaactatcatcctttaattagttaataaaacctaataggcaaggacatttttttccttttctttagagacagagtcttgctctgttgcccaggctggagtgcaacagctgatggtatgatcagctcactgcagcttcgaactcctgggctcgaatgatgctaccacctcagcctcctgagtagctgggactacagttgcatgccaccacacactgttaattaaacctttttttttttttttttttcagtagaaacagggttttgctatgttgctcaggctggtctcaaactcctggcctcaagtgatccagtgctgagattacaggtgtgagtcactgtgccctgcaggatttttttcttcttttttttgagataggatctcactctgtcacctaggctggagtaggatcttggcccactgcagcctccatatcccaggctcaagtgatcctcccacctcaatctttcaagtagctgggactgaggtgtgtgccaccatgcctggctaatttcatttattttttgta

SEQ ID NO: 63507 - DNA, 601 bp, Human
agacgcatgatggcatggggcaaggcatagccctcatagatggggacattgtgggtgacaccatctccagagtccagcacgatgcctgggagacaattgggcgtgataagtcaccatggcagctggcatgtggttacttgctggacaagtagagggaagccttgggggagagggaatttccgagcctcttatttaaaaagagaaaacagggcatgtgataggagaggtgaggtgggacagggctcggggaagatgaaaaaaagtaaagaacaggaagaggaaaacagtagaaaaaagttctgctagaaatatgagatcaagggcttattttgaacactagaagaagatcttttagggctgggttcagccgtgtccattctaactcaactccagtccgtcacccccacgtgttaacgaccattcaatcccatctctggcagtgcgctccaaccagcttgctgtcccgcccagccacctaccagttgtgcgtccagaggcatagagagacagcaccgcctggatagccacatacatggctgggacattgaaagtctcaaacataatctgcaaagcaatccaaagagctgagttagtgaaggtg

SEQ ID NO: 63508 - DNA, 601 bp, Human
gtatcaaagagtaaatttatgtaattctatcatcacatgttgctgctattactacttctattagtttgctagagcttccatagcacagtaacacatactgagtgggttgaataataaagtaattgtctatccatcctggaggctagaaatccaagatcaggatgtcagcatggttggtttcttctgatgcttccctctttggcttgtaaatggctgtcttctcccttgctcttcatagggccttttctctgtgtgtctgtgtccaaattttctcttcttataaggacaccagtcatattgrattagggcccatcctgatgatctcattttaacttaattgcctctttaaaaaccctgtctccaaatacagtattattctaagatactagaggttaggacttgaacagatgatttgggtggtggaaggacacaatttaacccagaacattactttagtgtatattttttgttattgttattattatactttaagttctggggtacatgtgcacaatgtgcaggtttcatacataggtatacatgtgccgtgttggtgtgctgcacccattaactcatcatttacgttaggtatttctcctaa

SEQ ID NO: 63509 - DNA, 601 bp, Human
ctccagttttcctttgcataatgactcttcctccattcttaacccatgcagttgttgtgggtctgactccactctatggatcctagggtagacatgtgattcaatttggccaacccaagcattttctcctctgtctagagggatgaactcttgatccaaatcaacccagtgagcttcagtcctgaagctattgcttcagaaaagggtatctttctttctgttgcagtttctaagcttatagaatctaagcccaaagttagagccatctctgcccccagagagtaagaatctgagaacacasacaacagagagggaagcagagatcagtgatggagaaactgagtcccagagtcccagtggaattgatggaacaccttgaacccactgtgcctaaaaccaagatacctctggatattttagttgtctttttcctacctcagcaatgagaagtctttgggttgcaatgagagaggaggcaggaaggtgcctcagttcatgactacataggctactctggaagctttcacaaaaagagactgcctcagagctctgtttctgctcagtctcatgaaagagttgtggtttttttttgtttgttttg

SEQ ID NO: 63510 - DNA, 601 bp, Human
actgtggctatcatttacccttttgagcaatcttgattttggtcatttataattagtacatgagaaaaagtgacagtgaatacaagtgagtactaaccgaattcctcggctggtactagaaaataatcttttcgttaagaatgtggaatattggcccccattctcttctggcttgtagagcttctgctgagagatccactgttaatctgatgggcttccctttgtgggtaacccgacctttctctctggctgcccttaacattttttccttcatttcaaccttggtgaatctgacaattaygtgtcttggagttgcccttctcaaggagtatctttgtggtgttctctgtatttcctgaatttgaatgttagcctgcattgctaggttggggaaggtctcctgggtgatatcctgaagagtgttttccaacttggttccattctcctcatcactttcaggtataccaatcaaatgtagatttggtcttttcacatagtcccatatttcttggatgctttgttcatttctttttactctttttttctctaaacttctcttctcacttcatttcatacatttgatcttcaatcactgatatcc

SEQ ID NO: 63511 - DNA, 601 bp, Human
ttacaaaatactaaaatataaagtttaagaaatggtttatattttcaaaatataaaatatgagaaaaattcaaagatgaatccagaatattaggtccacaatccaagaaaatgggaaacaagattgggcacagtggctcacacctgtaatcccagcacaagcccctgaagtccggggtttatgcccagcctgggaaacatagaggagcttgtccgtacaaaaaaaattaaaatatcagccaggcgtgggggcacacacctgtattcccagccactcaggaggccgagaggaagatcacttragcccaggagttcgaggctgcagtgatttatgatcgtgccactgccctccagcctgggctgcagagtgagacccaaaagactgtctctaaaaaataaaagagagagagagagagaaaagaaaaatgggaaacaaggagagaaaggaagaaacaaaacaaacaaaatcccattattttcctgagtataaagaaaacagaaatcttcagtttcaaatgttgttgatttattcattgaattcattgattacttggttctcttatacttccattgtattaataacagggccacaacgatgtttc

SEQ ID NO: 63512 - DNA, 601 bp, Human
tgcacttggtttgatactctgctgtcactaccttgaaattcttaataattgtgaacaagacaccccacatttttattttgcaccagatcctggaaattatgaacccggtcccatttgtattaattaaaaactctttgaagtacgaattttcatgatacaagcaagagaagtcaggttaaaagaatggtaagaggaagagcaaagtagctttcaggaaaactagatccaacaaaagctggagtttctagaaacttctggcagttatgaaagatttgctgcagagagagtgggaggaaagccrtggtatcaggacgttctgtactacttctgaaatgtacatatgcagaggagcaggcacagatgggatggctaagacagcaagtttgacttggagccagcagggaaagttcaagtgacccaggaaattagaagcaaaaagaatgagccacttgaactagctgttctgcattaggcaaacaaacagattctgttcctgattgttcctgatgatatccagcatttaccaaacatttactctgtacctggaactgttaaaaagggacttatagtcatctcatttaatctgacaacaaccctttaa

SEQ ID NO: 63513 - DNA, 601 bp, Human
ttaacaactaaagcagcatgaggtcaagacaggagtttggcaggcttggttttacaaggtacaggtcagaaagaaccctctgataaaacaagatgcagtaaaaaaagctggccaaaacccaccaaaaccaagatggtggcaaaagtgacctctggtcatcctcactgcttatctgctaattatagtatattaccatgctaaaagacactcccaccagcaccatgacagtgtataaatgccatgggaatgttcagaagctactctgtatggtctaaagaggggaggaaccctcagttcctgraattccccacccctttcccagaaaactcatgaaaatccaccccttgtttagcatatgttcaaaaataaccataaaaatagccaaccagcagccctcagggctactctgcctatggagtagccattcttttattcctttactttcctttactttcttaataaacttgttttcactttactctgtccacttgcccttggctcttgaattccttccttcatgaagccaataaccccaatggactcccaggctgaaccccaattctggagttaaccctgtgacatcatttctggtaacacaaag

SEQ ID NO: 63514 - DNA, 601 bp, Human
aggacttgtcactaaggtgccttttaagcaattggagcaaattcaaatgagaaacaagtttagctaggtactgaaggaacatacctcaaaataatgagacatctatgacaaacccacagccaacattatactgaatgggtaaaagctggaagcattcaccttgaaaacctgtacaagacaaggataccttctctcaccacttctatttgacacagtattggaagtcttggccagagcaatcaggcaagagagagaaataaagggcatccaaataggaagagaggaagtcaaactatccctstttgcagatgacatgatcctatacctagaaaaccacataatctcagcccaaaagcttcttgagctgataaacaacttcaggaaagacacaggttaccaaatcaatgtgcaaaaatcactagcattcctatactccaacaactgtcaaaccaaaagccaaatcaggaatgtaatcccattcccaactgccacacacacacatactacacacacagtacctaggaatacagctaaccaggaaggtgaaagatttctacaaggagacctacaagatactgctcagagaaatcagaggtcacac

SEQ ID NO: 63515 - DNA, 601 bp, Human
ggctaggcatggtggctcatgcctgtaatcccagtgagaggtgacagcatgctggcagtcctcagagccctcacttgctctcggcgcctcctctgcctgggttcccactttggcagcacttgaggagcccttcagcccactgctgcaccgtgggagcccctttctgggctggccaaggccagagccggctccctcagtttgcagggaggtgtggagggagaggcgcgagcaggaactggggctgcgcgcagcgcttgtgggccagctggagttctgggtgggcgtgggcttggtggtcctrtagtcagagcggtcggccggccctgccggccctgggcagtgaggggcttagcacccgggccagcagctgcagagggtgtactggatccccaagcagtgccagcccaccggtgctgcgctcgatttctcaccgggccttagctgccttcccatggggcaggcctcgggactgcagcccgccatgcctgggccttcctctgcctccgtgggttcctgtgcagcccgagactccctgacgaatgccgctccctgctccacggtgcccagtcccatcggccacccaaggcctgaggagtgtgag

SEQ ID NO: 63516 - DNA, 601 bp, Human
gctaggcatggtggctcatgcctgtaatcccagtgagaggtgacagcatgctggcagtcctcagagccctcacttgctctcggcgcctcctctgcctgggttcccactttggcagcacttgaggagcccttcagcccactgctgcaccgtgggagcccctttctgggctggccaaggccagagccggctccctcagtttgcagggaggtgtggagggagaggcgcgagcaggaactggggctgcgcgcagcgcttgtgggccagctggagttctgggtgggcgtgggcttggtggtcctayagtcagagcggtcggccggccctgccggccctgggcagtgaggggcttagcacccgggccagcagctgcagagggtgtactggatccccaagcagtgccagcccaccggtgctgcgctcgatttctcaccgggccttagctgccttcccatggggcaggcctcgggactgcagcccgccatgcctgggccttcctctgcctccgtgggttcctgtgcagcccgagactccctgacgaatgccgctccctgctccacggtgcccagtcccatcggccacccaaggcctgaggagtgtgagc

SEQ ID NO: 63517 - DNA, 601 bp, Human
cttcagcccactgctgcaccgtgggagcccctttctgggctggccaaggccagagccggctccctcagtttgcagggaggtgtggagggagaggcgcgagcaggaactggggctgcgcgcagcgcttgtgggccagctggagttctgggtgggcgtgggcttggtggtcctatagtcagagcggtcggccggccctgccggccctgggcagtgaggggcttagcacccgggccagcagctgcagagggtgtactggatccccaagcagtgccagcccaccggtgctgcgctcgatttctcrccgggccttagctgccttcccatggggcaggcctcgggactgcagcccgccatgcctgggccttcctctgcctccgtgggttcctgtgcagcccgagactccctgacgaatgccgctccctgctccacggtgcccagtcccatcggccacccaaggcctgaggagtgtgagcgcatggcgcgggactggcaggcagctccatctgcagccccggtgtgggatccactgggtgaagccagctgggctcctgagtctggtggggatgcggagagtctttatatctagctcagggattgtaaa

SEQ ID NO: 63518 - DNA, 601 bp, Human
ctccctcagtttgcagggaggtgtggagggagaggcgcgagcaggaactggggctgcgcgcagcgcttgtgggccagctggagttctgggtgggcgtgggcttggtggtcctatagtcagagcggtcggccggccctgccggccctgggcagtgaggggcttagcacccgggccagcagctgcagagggtgtactggatccccaagcagtgccagcccaccggtgctgcgctcgatttctcaccgggccttagctgccttcccatggggcaggcctcgggactgcagcccgccatgcctgrgccttcctctgcctccgtgggttcctgtgcagcccgagactccctgacgaatgccgctccctgctccacggtgcccagtcccatcggccacccaaggcctgaggagtgtgagcgcatggcgcgggactggcaggcagctccatctgcagccccggtgtgggatccactgggtgaagccagctgggctcctgagtctggtggggatgcggagagtctttatatctagctcagggattgtaaacacaccaatcagcaccctgtgtttagctcaagatttgtgaatgcgccagtcaacactct

SEQ ID NO: 63519 - DNA, 601 bp, Human
ttgacttttgggggtatcagaaattactttgcattatgagacaacttttagccttggtgtgtaatagctaggtagaacatatactttcagggatggctaatagcagttgcttacagtgagtcattattaccacaggccaatatttctttcttcttttatttaaatttttaaaaaggtgctattgggcacctaaaagacagaaaatggagatgggctgattatagaatgagctgattggctttgggttggccactagtcttggaggaacattcttgcaatgaaaaatctgatggctactggsttttcttctgcctgtctgtgtagttagatatccgttgtgtgtgtgatgtctataacaaggagctctaattaatggacttaaagaagaataagtgcttggatcaaatattttttaaagggaagataaaagctgtggtaccctttaagttcatgtaactttaatctttgagaaataaaaacagccttaaagattattggcaatgtagatgttgtcaaaatgtaaatatttacctagggctaaagggttgttttgaattagaaaagataatgctgaaagttcaaacaagttgtgaaaatattg

SEQ ID NO: 63520 - DNA, 601 bp, Human
aaaatgtttttgcttttttaaaatttctgagtcatcattttggcaaagtaaataatttaaggaaatccggaattctatctaataacatcaagtgttttaaacctccaacttttttatttttttattataatactttaagttctaggttacatgtacacaacatgcaggtttgctacataggtatctatcccatgttgatttgctgcacccatcaactcatcatttacattaggtagttctcctaacgctatccctcccccagccccctacccctcaacaggccctgatgtgtgatgttccmctccctgtgtccatgtgttctcattgttcaactcccagttatgagtgagaacatgtggtgtttggttttctgtccatgtgatattttgctgagaatgatggtttcctgcttcatccatgtccctgcaaaggacatgaatgcatctttttttatggctgcatagtattccatgtaaacctccaacatttaacaggcttcccagaatcaaacttcagtttcaaaattagctttactgacacctagctttttaatgctacagagggcccctagagcattcagaagagaggtaaacaggattac

SEQ ID NO: 63521 - DNA, 601 bp, Human
ggggcatatttgtctctctctgcctggcttctccagaatttggaaactacttgcaagtattcttaacttatggcaatataattgtttgcatcagtgcaacaagaatccactttcttgcaaagctgataaaagccccttgggaaaattggcctcataccttgtttacaccatccttgtccagggttcctgacctgtggtaagtgaaaaatgtcactttctgacaggtccaggagctccaggtttatcttgggaccttaagaggagaggattacccagctcataggtatttgatggcaaaaacccatggatgggctcagctttaaaaagtcctatctgagattccttgtgaaacagagttccatcaaagtcaatctaaaaggcttatgtaaaaataattattcttgctgcactgtacacaaataatcaggccaagtataagacttataagcctaaagtctattttgcaaacaactccgtcctatcatgatttgtttttagcagaaatgaggactggagagagagaaattatgtttccaaacttatcatacatttgtcattaaattccagactcattagttgttttaaagtttttgcctacatc

SEQ ID NO: 63522 - DNA, 601 bp, Human
tatttgctaggaagagaagggaaccagggagacctgctcccttctttctagatgagtagctattcaccttcagactttacccctttcggatgcatcctgaacccctgggactcctttgaaaaaacctccttttttccttcttcctcctctgtcctcacttcactgataggtaatcatgtctccatactatgcgacactcccctcagatgcatcctccaaactgggaaaactcaatttcccaaaccttaaactggttggcttaggattgggcctggggaatggaacccagaagactgacatsctggcaaaagggtaaaagtccttttttaccagtcaggattttggcctccctctccctgtgcaaactggtaaaaggcctcaggattcttgagctgactttatccaccccccttgttttattttgatatatgtttcctaataacctggtttgtctattctcacctttagactatcaaactccaaacagtcatgcaactggagccacagatgatggccctgtttgccagggacccttagatagccctctgagggagctctgacttctgccttcccaaaacagcgccccctgtcagcaggaagc

SEQ ID NO: 63523 - DNA, 601 bp, Human
gaaaaaacctccttttttccttcttcctcctctgtcctcacttcactgataggtaatcatgtctccatactatgcgacactcccctcagatgcatcctccaaactgggaaaactcaatttcccaaaccttaaactggttggcttaggattgggcctggggaatggaacccagaagactgacatgctggcaaaagggtaaaagtccttttttaccagtcaggattttggcctccctctccctgtgcaaactggtaaaaggcctcaggattcttgagctgactttatccaccccccttgtttkattttgatatatgtttcctaataacctggtttgtctattctcacctttagactatcaaactccaaacagtcatgcaactggagccacagatgatggccctgtttgccagggacccttagatagccctctgagggagctctgacttctgccttcccaaaacagcgccccctgtcagcaggaagcagttaagatcagccttcattcttatccttatctttgttctaatagcagttaagtgtacttctttaggcagggaatgatagatgcaggaggcagataaggggaagggtccctggagaa

SEQ ID NO: 63524 - DNA, 601 bp, Human
tgttagcaggacaccctctcactgtactgagagtttttcttttttctttttctctcctaataagttcaaccctacccacccttcaatgtgtccatgtgcctaatctttcctggttgtgtgacaagaacccagttttagctgaactaaggagcaaaaattctgcaacagcattcttattctctggtctctgcagcataatcacacccccaaattttacctggtatagaatcatgtagaataaagctgatggtttccaacctctcctgcaactgaatatggcttgataactacatctggccartaagatgtaagcagaagtgtcgcatagcagtttctgagaccgaaggtgcattttgaacttccttcatcatcttttctttgatcctgccccagcaaatgagaacttgaggctggaactccagccactgcaagggctacactctgaggatggcagagcagtgaggccatagggccttgagtgcctggattgtggagaagagctgccatcagctgtggatggtctccaaactgacatttgttgggaaatgccccactgtctcactgaaggcacccacattttggccctcagctactcatccaa

SEQ ID NO: 63525 - DNA, 601 bp, Human
cttttctggtctttcttatcataaaaattgtcagccaattaaacaatcttctgttgaatccgctgctttctgaagtcagctgtctcatctcttgcattcatttcaagcataatctatgttcactggcatttctttgcctcctactcgttgaactggttgcaattttggtttctattactctactgaaactcttctattaaagttcactaaaggagagtagtgagtcatcaaatccagtgcccttttcctcagttctcactttcctcaatgctttgccttttttcggcctggaaaacatagaaaaaaatggaaagaaaaaaaacatcattctattctcctaatataaaaatttaaaaagtcggtggaaagtggattttctcttgtttttcccagacagagctcttctgatcttttgtagatctccctcaaggatgaataccccctccctctatacattggagctgacccactcattcaataaagctgggccctgtggacaaacaaagcctctgtcctcatggagtctatagtctggtggcatattggatgaatatataattactaactgggcagcactccaagagagacagtatgattctta

SEQ ID NO: 63526 - DNA, 601 bp, Human
cttatcataaaaattgtcagccaattaaacaatcttctgttgaatccgctgctttctgaagtcagctgtctcatctcttgcattcatttcaagcataatctatgttcactggcatttctttgcctcctactcgttgaactggttgcaattttggtttctattactctactgaaactcttctattaaagttcactaaaggagagtagtgagtcatcaaatccagtgcccttttcctcagttctcactttcctcaatgctttgccttttttcggcctggaaaacatagaaaaaaatggaaagaaaaaaaacatcattctattctcctaatataaaaatttaaaaagtcggtggaaagtggattttctcttgtttttcccagacagagctcttctgatcttttgtagatctccctcaaggatgaataccccctccctctatacattggagctgacccactcattcaataaagctgggccctgtggacaaacaaagcctctgtcctcatggagtctatagtctggtggcatattggatgaatatataattactaactgggcagcactccaagagagacagtatgattcttaagagaccatgcaat

SEQ ID NO: 63527 - DNA, 601 bp, Human
cgctgctttctgaagtcagctgtctcatctcttgcattcatttcaagcataatctatgttcactggcatttctttgcctcctactcgttgaactggttgcaattttggtttctattactctactgaaactcttctattaaagttcactaaaggagagtagtgagtcatcaaatccagtgcccttttcctcagttctcactttcctcaatgctttgccttttttcggcctggaaaacatagaaaaaaatggaaagaaaaaaaacatcattctattctcctaatataaaaatttaaaaagtckgtggaaagtggattttctcttgtttttcccagacagagctcttctgatcttttgtagatctccctcaaggatgaataccccctccctctatacattggagctgacccactcattcaataaagctgggccctgtggacaaacaaagcctctgtcctcatggagtctatagtctggtggcatattggatgaatatataattactaactgggcagcactccaagagagacagtatgattcttaagagaccatgcaataacaaaggaaggtgacctagatcgggtaggcagtgggatcagggga

SEQ ID NO: 63528 - DNA, 601 bp, Human
aagggcaagagagtaaattccaggcagaaaaataaaaccagcgtgggggaagcttgacgtaggaactaagagaatacagaaggggagagtggtgaaagatgagtctagataaatcagacgggatcttgcaggtcatggtaagaggtttgttatcctaaagccaatagtaagacatggaaagttaaaagcaagggagataacatgattacttcaacatattttttaaaaatgcttctgctgcaatatgaagaattggtgcagggggccagggaagagacagggattctaattagtaagttaytgacagagggtaggtaagagttggtggttgttaccagattccaacatatgtagacaatgaaatcaacagaaggaatgtggacttttggaacaccaaccaaactcagaaaatttcaaggctttcctccattccctccaaattcaagaagaaggtactcataactaggtcatggctgaagatgccattataatagtcatgctgttactggggttgaagcttttaatgtaagcaacaaagccttgaaatgcttccttctagacaaactgaataatctaactgtgacatgtgccctcctcagct

SEQ ID NO: 63529 - DNA, 601 bp, Human
ggtgagagagtgctgttcttaaaatcggtatgttggcaggatggttctttccatctttgctgaagtttgctatatctccggtcctaacgtttttgagcaaagtttactgcatatctcttgccaggtcagctgaatatgaacttaaagggacctaacaaaacaggcagtatgcatcgatgatttagaattccactgtgcccacgaggacaagtaagagcaagcgccttgggcaaaggacatgggtattacctccataacatgctgtgctaggctgcatattcaggacaggatctctgacagyggagaaataacgactttctgatggactgctagggtgccagcatggattttcctggcttcagtggaataactcatttttccatctgtaaatagagtactgagacattatcttcatatatgcttgatgttagtcaggggcacttcggggtacaattttgaagctctagggaaattttatagcaaaggttaaagtccagagaggaaaagagtctagatagcaattgaaaattgggcacaaatgaagtatagtttgacccccacatctcctgcctacaaactgcagacccagctgcagtaggtg

SEQ ID NO: 63530 - DNA, 601 bp, Human
tgcgaagcagggtcatataagggaatggcggccatgggggctggcttgagccagaaacaactcctgctcctggctgcagagggaactggatggggaggcagccctcacaagtgaccagcacttgtcactaccctgtccttgcctgcttctttcaagggatgcaggttcccacctactcagcctcatccacactcttgaagggtgctgatgtagggcaccagtatccatggccaaggggattttgatctggcttcctttgcatatcttgaatttttttcttttctgaccctacaaaggattaaaaaaggaaatgcctctttcattaaatattatgacacctacctgaattttcctggagggccatccccccgttctcaccatttagtcttcttagaaaaagttctagtgaacaatcaaatgtgattgagaatttgggtacatactttctaccatttcttaaccccattactgcccctgaggcataagataaactatgactagaaagagtggccacggttggggtaggcggggaagttgattggtcctgacccccagggattcaggtgtgacacctgtccacctttgaggatcactattctgg

SEQ ID NO: 63531 - DNA, 601 bp, Human
agttgtgtggtaaaatctcatgccatcctgcttcatcccatctgggacactaatcatccctttgtccagcacatccacaccatctatgtatccagccctttgtcacttagtagccttcttggttattagagctactgtctcggtatcacagtgcttgtgttcaagtcacccttactttacttaaaaatggccataaagctcaagagtagtgatgctggcatattgttataattgttctgttttgttactattaatctcttaccgtgcctaatttatacattaaactttattgtaggcagggatgtatgtatcagaaaaaaaaaacctagtacatatagggttctgtattatccccagttttagacatccattaggagtcttggaacatacaccccacgaataaggtggggggactactatctaccaaagttctactttctgacctcagggctgaacaccaagtgcttgacacagagttggcatttgttaagtgtttgagagatattatatgcttttctggagacatggacattgacagatactcatgttttcaactggcccaagctgtctagtgcttctttcgcatcaattagacagagga

SEQ ID NO: 63532 - DNA, 601 bp, Human
tctgttttgttactattaatctcttaccgtgcctaatttatacattaaactttattgtaggcaggtatgtatgtatcagaaaaaaaaaacctagtacatatagggttctgtattatccccagttttagacatccattaggagtcttggaacatacaccccacgaataaggtggggggactactatctaccaaagttctactttctgacctcagggctgaacaccaagtgcttgacacagagttggcatttgttaagtgtttgagagatattatatgcttttctggagacatggacattgamagatactcatgttttcaactggcccaagctgtctagtgcttctttcgcatcaattagacagaggaaattaggaagaggttcattccattcaacagacaacacactgaaacactgcctgtgttaccatcagaatagtaattccacttttctctccttttttaattatcccaaacacctacatatacattccccatattcgcatctcccatatgccgcaagtacgtggcccaggtaaatgctctataaatattgatgattgaagcctattgatcatttttattaacataggattacagcctc

SEQ ID NO: 63533 - DNA, 601 bp, Human
ctttctgacctcagggctgaacaccaagtgcttgacacagagttggcatttgttaagtgtttgagagatattatatgcttttctggagacatggacattgacagatactcatgttttcaactggcccaagctgtctagtgcttctttcgcatcaattagacagaggaaattaggaagaggttcattccattcaacagacaacacactgaaacactgcctgtgttaccatcagaatagtaattccacttttctctccttttttaattatcccaaacacctacatatacattccccatattckcatctcccatatgccgcaagtacgtggcccaggtaaatgctctataaatattgatgattgaagcctattgatcatttttattaacataggattacagcctcttggaatatgtagaggagttccaaggtagtcagagacgtttgtactgcgtggctccgggaaaaggtaagatatatttttaattcagaagaggataatatcctaaatttatatataaattgctaaccacctaccacacatgtcagaaatgtcattttagggaatgtctcttctgtctttagaaaccagtttccataggag

SEQ ID NO: 63534 - DNA, 601 bp, Human
ctcccacttgtttgtatggctattatcaaaaagacaagaggtaactgttggcaagagtgtagcgaaaagggaacacgtacactgttggtgggagtgtaaattagtacagtcattttggaaaatagtatggaggttactccaaaattaaaaatagaactatcatacgctccagcaatccctcttctgtgtatacacccaaacaaaatgaaatcaataccttgggctgggcacagtggctcatgcctgtaatcccagcactttgggagactgaggtgggcgaatcacctgaggtcaggagttmgagaccagcctggccaacatggtgaaaccccatctctactaaaaatacaaaaattagctgggtatggtggcgggtgcctctagtcccagctactggggaggttgaggcaggagaatcattggaacccgggaggcagaggttgcagtgagctgagaccgcgccattgcactctagcctgggcaacaagagtgagactctgtctcaaaaaaaaaaaaaaaaaagaaaagaaaaagaagaaaagaaagaagtcaataccctgaagagatatctgcatccacacgttcattgcagcattactca

SEQ ID NO: 63535 - DNA, 601 bp, Human
attgatacttaggttttcccctgggggcaaaaggaatgcattcattttgaatagtatattttttaatctttttgcataaactaaagcaatatgtcattttaaaaaagatttccattcttttggcaaggagcttctccatgtgttggttttgttgaacctggatgtaacatctggaattgatgcagccactttgtgccatgagtgaatctagcctgaggacaatttcctaaggcaggaaggggccgccttttacattatccctgttttaagagctaaagtaaaaaagttctttcccagaccscaattccttagaaaagtgaaattctcatggttggcttaagaaaataaagatttccccaccaagagtcttggaatatggaagaagttgaatattcaaatgaatagggtctattagaatggtggaagtgcacaaatggctcttgggtgggcaacaggatctgctctgtggccacattctatgtccaaagcaccagcagcaccaaggctgaccacccacagggactaccaagaggcacctgcccaccaccagcacctaagtcaatgaaatgaaaagactaggagaggtgagagagctttggga

SEQ ID NO: 63536 - DNA, 601 bp, Human
agcttttacatatgtcccactctgcacaactcgtgatatttctcttgggcaaaattacattgaaatatggaatgactcttaaagatttttatgtaaaaagataagtataaaatattttaatatcccagtacatttttttttggtgttaaaaagcttaatttattttgggagagattatattatgaatttcataagtctgaaatacaaattatactttagtgctaggaatctagcttttgaacctgcatggaaatttttgtacctgcatttgaatttacataatttaaaggttcaaaaaacttttttttttttttttaaatagagatggaggcttgctgtgttggccagaatagtcttgctatgttggccagagtgttctcaaactcctggcctcaagcagtcctcccacctcagcctcccaaagtcctgggattacaggcatgagccactgttccctgctgcctttttttttggggggggggggaggtcgagaacgtctaaaatgtgaaaatgtgtataattgtgggtaaagagccagtacatataagagaaacaacttgattgtgttctgtcttaagaataggagcatcattacaatatt

SEQ ID NO: 63537 - DNA, 601 bp, Human
tctcaatttggaagtggaaactttgaaatctgttgaattactggaaattctcttgctagttaaaaaacattccaaggtaattacagtcattattctttaaggcaaatttttttcctgatgtttatttttttctgtggtgacttaaacattaagtaatactttatgggactcttaacttttacacttgttttttttcttatatctctagtgttaaagttctcaaaatgcagctttgacccagacagtattaatccggaagggaacctggtcacttagctcagcttctttctgcatataggtkccccttctgtagtaatcatgccatatgatagtacagctgttacattgccacatatgcattgttctgaaatgcatactaggtagtagactcagaacaaacactaatgggataggatgggatcccatcacacctgtaggactgaactgtcatcccattagcagcagcatcaattaacaccagcaatgttgatgttttaaacccgaatgtcttttcaaatcctttaggccagctaagtaaaagtaagtcttaccatcacaaagagatataaaacaaaagcacaatactttttcttaaactctc

SEQ ID NO: 63538 - DNA, 601 bp, Human
caatgttgatgttttaaacccgaatgtcttttcaaatcctttaggccagctaagtaaaagtaagtcttaccatcacaaagagatataaaacaaaagcacaatactttttcttaaactctcagtctagttggggaaatgaggaacttaacatgaagtggtgtgttctgtcatttgttattgtgtcttggtgccaggtaatagtgaatatagagagtactttgggattttttttttttttttttttttttttgagacagtcttgctctgttgcccaagctagagtgcagtggcatgatcttgsctcaccgcaacctcagcctctcgggttcaagtgattctcctgcgtcaacctcccgagtagctggggctacaggtgctcaccaccatgccaggctaatttttatatttttggtagagatggggtttcgccatgttggccaggccggtcttgaactcctgacttcaagtgatcccacctgccttggcctcccaaagtgctgggattacaggcgtgagccactgtgcccggcttactttgggttttttttaagcaaagaaatagggcagactaggagaaacactatgactgggagcctgtttg

SEQ ID NO: 63539 - DNA, 601 bp, Human
cctagactaaatattactgagtttattatactcagaactggaatagtgtaagacatcagagaaagcaagcacctacactaagagctaagaattaaagcccccactcttcaggtaagcaaattaaccagaagtagtattttaatatgtaatgatttataaggtcctctccaatttttttagtttttttcttttttatatttttttgagtagagatagggtctcgcgatgttgcccagggctggtcttacatactcccaggctcaagtgatcctcctgcctcagcctccgaagtgctgagatwacaggtgtgagccactgcactcggcctcttttccctttttaaagtggttgttttccatctttctcctatttcccttgctcttgaaatacagctaaaaaaccccaaaaaaacaaaactgaaaaagaattctgggctttgtaatgttagtatgaattcctaatattgtgctgtggtgaagagattgaggggtaggtgcctggaaaataaagggaatcaccaccactgatggggaagacttctatatatgttctcagaggtttgtcaattggtgttgtcttattcagaatttgattactttgt

SEQ ID NO: 63540 - DNA, 601 bp, Human
gaataactttgctaaatttgtttgttttatgccgtagagataaagggccagaagtttcattttcatagcttgttagtttactttgatatttgacagtgtaagtggtataataaatcactgatgcaagaaatacatctaaatagaccatatgctaggaggtatgttgtttttagtcttcattactggatttaaaatacttagaattctacaattctaatacttgctgatagttattaattggtacaagaataatagtttggcaaatagtaacttgtttaaacttaagaaaacctatattttstttctttctttcttttttttttttgcatgtgccaccatgcccagctaatttttgtattaatattttttgtagagatgggattttgccatgttgcccaggctagtcttgaactcctgggattaagcgatctgcacacttcggcctcccaaagtgctaggatgacagggatgagccactgcacccagtccaaaaaatctatattttccaatgagattactatagacttcatttaggaagtccttataaattttgtctctgtaaagcataaattttgaatataaaaatcctcactagagatat

SEQ ID NO: 63541 - DNA, 601 bp, Human; identical to SEQ ID NO: 27335

SEQ ID NO: 63542 - DNA, 601 bp, Human; identical to SEQ ID NO: 27336

SEQ ID NO: 63543 - DNA, 601 bp, Human
tcttttcacctgtgtcctccaactcagccacagctggtaagtaacctggactcttacctggagctgggaataggtaagtgtatgtaatgtgttgggtaaagctcatttcatttccagaaatgtaggaagccttgatagctctcctaggaaaaactgttctatggggtagggctcttcctaaatttatggctgattttagtgaatctttaggacccctaccaataaaggactaaatgatgggagcgggggttcctatttttataaattgctattccacaaatattcccccaaagtgatttgrgggtaaatggacagcagcccttttcacgaaatcctgatgtcagcattgtagagaggaggaaggtagttcaaagcaagttctaccgtgtgttgaatctgatcttgaggtaaagtctggagacaaaattcaatgggatcttactttgtactttctgactttattttttttttcaggatattctaagtaattgctcaaattatcatttcctagacataaaaaattttatttgaaccactaagcaggcattgggttaacaaacatgtttgaaaccagatattttagaaatctaaacgtctcgag

SEQ ID NO: 63544 - DNA, 601 bp, Human
tgatatgattaaactttatatcagtgtatacacacacacacgtatactggacagctaacacaagaagaagaaacaattgtaaaattttgacttggcagtgtaaaagcacaactaaccacagttatttatgtaaatcgcttaccacttatgcctaattactatgaagcacaataacaattatgcacagcactaagtgtgtcagattaactttgctaaaggtttgattatagcactaacctctgtgtacatatgctcagtgttcactctgttactcttgtagttgatcatctcctaatgtggcacagtcatctgctcactacactaaaaaattagtgggagcactggcttgccacaggcttcctatatttctcaaaatctttttgcagttctttttctccttacattttctgctgcatctgatggtctatcttttttatttcaaaatccttgtattcaattcacttttataggcacttactatgttcaaagtactagattaggaactggagggtatacagagataattaaggcagcccatacttaagtataaaagaggaaagggaaaccttcatatgaaacagagaaaagttgctgtgaggct

SEQ ID NO: 63545 - DNA, 601 bp, Human
gggtgagcctgaacacacgtttaacttttctggagtctcagatttcctgtctgcaaaatagagataataatgcctgagacagtaaggatttaacaagatcaacatgtaaaataccgagagtagagcataaggaacatagtcaggagttaatgctagttctctcccccacttcatggcagaataatcagcaaccatcactatcaggtatatggtactggaaattttacctggctttaacaatgcaaggaaatgatactacttttattcatgttttttctactaagttttatgtgtgtgtgtktttttttttttttgttttgaaacagaattttgctctgccgcccaggctggagtgcagtggcgcaatctcggctcactgcaacctccacctcccaggttcaagtgattctcatgcctcagcctcctgagtagctgggactacaggcgcctgccaccatgccccgctaatttttgtatttttagcagagacggggtttcactatgtttggccatgctggtctcaaactcccgacctcaagtgatccacctgcttcagcctcccaaagtgctgggaatacaggcatgagccaccccacctggc

SEQ ID NO: 63546 - DNA, 601 bp, Human
gaacacacgtttaacttttctggagtctcagatttcctgtctgcaaaatagagataataatgcctgagacagtaaggatttaacaagatcaacatgtaaaataccgagagtagagcataaggaacatagtcaggagttaatgctagttctctcccccacttcatggcagaataatcagcaaccatcactatcaggtatatggtactggaaattttacctggctttaacaatgcaaggaaatgatactacttttattcatgttttttctactaagttttatgtgtgtgtgtgtttttttttktttgttttgaaacagaattttgctctgccgcccaggctggagtgcagtggcgcaatctcggctcactgcaacctccacctcccaggttcaagtgattctcatgcctcagcctcctgagtagctgggactacaggcgcctgccaccatgccccgctaatttttgtatttttagcagagacggggtttcactatgtttggccatgctggtctcaaactcccgacctcaagtgatccacctgcttcagcctcccaaagtgctgggaatacaggcatgagccaccccacctggctgtaaatcat

SEQ ID NO: 63547 - DNA, 601 bp, Human; identical to SEQ ID NO: 27337

SEQ ID NO: 63548 - DNA, 601 bp, Human
tcgatgcccccaggctcaagcagtcctcccacctcatcatttcaagtagctgggactacaggcacgcaccactgtacccggctattttttttttttcatatttttagtagaggtggtgtttcgccatgctgcccaacttggtctcaaactcctgagctcaagagatccacccaaagtgctgggattacaggcatgacccacagtgaccagcctccctttacatttttgaatggagagttacttccttacaagttaataagcacaggctgcacaaggtggctcacgcctgtaatcccagcaytttgagaggtggaggcggatagattgcctgaacccaggagttcgagaccagcctgggcaacatggcaaaaccttgtctctacaaaaaatacaaaatttgccaggtgccatggctcatgctgtaatcccagctacttgggaagctgaggcaggagaatcatttgaatccgggaggcagaggttgcagtgagcctagatcacgccattgcactccagcctggccaacaagagcaaaaccccaccacacacacacacacaaaattagccgggcatggtggggggtggggctgagatgggagga

SEQ ID NO: 63549 - DNA, 601 bp, Human
cctgatgatcagaggtggaacagcttcatcctgaaactatctggccaccccaaacccccacccccatggaaaaactgtcttccaagaaactagtccctggtgccagaaaggttggggaccactgctttaaaaaaactgtctgaaaacagccgggcgtggtggctcacacctgtaatcccagcaccttgggaggctgaggcgtgcggatcatctgaggtcgggagttcgagaccagcctgaccaacatggagaaaccccgtctctactaaaaatacaaaattagccgggcttggtggtggtrcatgcctgtaatcccagctactcaggaaggctcaggcaggagaatcgcttgaacctgggaggcagaggttgcggtgagccgagattgcgccattgcactctagcctaggccacaagagcgaaactccatctcaaaaaagcaaacaaaaaaaacccaaaactgaaaacatcccacctgcacctggaaattgatacacctagtctgcacctctctgcattttctttctttctttttttttttttgagacaaggtctcactctgtcaccaggctgcgagttcagtggtgcgatcttggcttac

SEQ ID NO: 63550 - DNA, 601 bp, Human
tatgagaattgaatgcctgatgatcagaggtggaacagcttcatcctgaaactatctggccaccccaaacccccacccccatggaaaaactgtcttccaagaaactagtccctggtgccagaaaggttggggaccactgctttaaaaaaactgtctgaaaacagccgggcgtggtggctcacacctgtaatcccagcaccttgggaggctgaggcgtgcggatcatctgaggtcgggagttcgagaccagcctgaccaacatggagaaaccccgtctctactaaaaatacaaaattagccrggcttggtggtggtgcatgcctgtaatcccagctactcaggaaggctcaggcaggagaatcgcttgaacctgggaggcagaggttgcggtgagccgagattgcgccattgcactctagcctaggccacaagagcgaaactccatctcaaaaaagcaaacaaaaaaaacccaaaactgaaaacatcccacctgcacctggaaattgatacacctagtctgcacctctctgcattttctttctttctttttttttttttgagacaaggtctcactctgtcaccaggctgcgagttcagtggt

SEQ ID NO: 63551 - DNA, 601 bp, Human
atcatccaaggcactagattctcataggagtgtgaaccctactgtgaactgcgcatgtgagggatctaggttgggcactccttatgagaattgaatgcctgatgatcagaggtggaacagcttcatcctgaaactatctggccaccccaaacccccacccccatggaaaaactgtcttccaagaaactagtccctggtgccagaaaggttggggaccactgctttaaaaaaactgtctgaaaacagccgggcgtggtggctcacacctgtaatcccagcaccttgggaggctgaggcgtgyggatcatctgaggtcgggagttcgagaccagcctgaccaacatggagaaaccccgtctctactaaaaatacaaaattagccgggcttggtggtggtgcatgcctgtaatcccagctactcaggaaggctcaggcaggagaatcgcttgaacctgggaggcagaggttgcggtgagccgagattgcgccattgcactctagcctaggccacaagagcgaaactccatctcaaaaaagcaaacaaaaaaaacccaaaactgaaaacatcccacctgcacctggaaattgatacacctagtct

SEQ ID NO: 63552 - DNA, 601 bp, Human
cagcctcactccaaaaaaaggcaagctgtgcctgtcaactatccctgcccaagtagttttctcaacttttcaagttaatgcccactttaaaatttcattctgtcctcagctgtgccccccaactcccctccttgtcctccaagattgttatacaggcccctgtgtctactgtgtatctccaactgtcaagaagattttgtgaaactctaaattcctgccgcagaccagttctagtctgtgacctgttaggaaccaggctgcacagcaggaggtgaatggcaggtaagcgagcattattgtstgagctccacctcccatcagatcatccaaggcactagattctcataggagtgtgaaccctactgtgaactgcgcatgtgagggatctaggttgggcactccttatgagaattgaatgcctgatgatcagaggtggaacagcttcatcctgaaactatctggccaccccaaacccccacccccatggaaaaactgtcttccaagaaactagtccctggtgccagaaaggttggggaccactgctttaaaaaaactgtctgaaaacagccgggcgtggtggctcacacctgtaatcccagca

SEQ ID NO: 63553 - DNA, 601 bp, Human
catctcaagtggcagccgctcttcagctccagctgatttttgccctgtgggaatgtgtgcccgaccttcccagatcttcccattttttcagagaagccaaaaatttgggttttgatgggacacctcttgatttttaaatgctggctcacagtttgttaatggggtcaaataaatcccacgtgtaggtcacttgtggataatctctgccgtagacctcactctggtgtgaggtggggtaggagtgtgacaggagccacgggggatgggaacaaggactgtggtggcattcggatcatggttktctcacagcctggcagagcagctggccacagtaagtgctgaataataagtggacacattacgggggcctccgggaagagctgctgcagcatgtggctgcctcggcaggcccagccaaggccttggggaccaaacccactaggagtcctgacactgggatatggtcaatagcagccacatgtccttctttgctttcaactacgaagcctcagtgctcagtttcagcaaaagcctctctctctttcccaccatctttaacctttccctagcagagggggctcaagttactctgaaccattcc

SEQ ID NO: 63554 - DNA, 601 bp, Human
acagagcatggacaggctgtggggagggtgggcttgccagccccatctcaagtggcagccgctcttcagctccagctgatttttgccctgtgggaatgtgtgcccgaccttcccagatcttcccattttttcagagaagccaaaaatttgggttttgatgggacacctcttgatttttaaatgctggctcacagtttgttaatggggtcaaataaatcccacgtgtaggtcacttgtggataatctctgccgtagacctcactctggtgtgaggtggggtaggagtgtgacaggagccacsggggatgggaacaaggactgtggtggcattcggatcatggttgtctcacagcctggcagagcagctggccacagtaagtgctgaataataagtggacacattacgggggcctccgggaagagctgctgcagcatgtggctgcctcggcaggcccagccaaggccttggggaccaaacccactaggagtcctgacactgggatatggtcaatagcagccacatgtccttctttgctttcaactacgaagcctcagtgctcagtttcagcaaaagcctctctctctttcccaccatctttaa

SEQ ID NO: 63555 - DNA, 601 bp, Human
gactttgtgttgggccttactgaaagccatcctgggccacgtgcagcccatgggccaggggttggacaagcttggtgtaaagggactggcctgccagactccagaccctgatggagaattctggttgggcccagagcttttgtggacctaaggggaccgaagaaagaaggcaggccacctacctcaatggtgctgccatcaggcaggtagtactgagctttctctgtctctagcgtctcatccttttgggggtttatggataggtaacaggctctctgcagatccaagcaagacagtcagrctggcaggaaatctggtgcacatccagtcaaaggcccaggggaggaatgtgctgctgcacaaacctgtctaaacgttgtgatggccccaatggtcactatagctgctgcccagaagcaggggcagtgaggtctctgttggccttcactgggtggcatttagcatatgagttcttaaccgctccaccttcctgatgggcaagcttggaaacttggcccctggatcctaggtctgagaccacaacctaagttcagcccaggcccaggcatctttctccttctaccactcatatggttctggt

SEQ ID NO: 63556 - DNA, 601 bp, Human
ctgcctttggtgtgaagagggagaatgagaactcagcctccctgtggctgacctagacctcagggtcagtgtacaggctgggaacctggcgctgcttgtagagccatggctgcttgaagagcttgggcaaagctagagggaagctacgccaggtggcactctgtccatggaagcctagttccacccaggccaggccccaccatgctcctaccctgatcttcacatcttttggagctagtttcttcacttcactcaggagcctgtcaccaaaacctgaatgggcaaagaggagaacttcaaktcaattctcagggtgcctggagccagcaggagctgaacacttccaggggaagggctccaagagaagagacaaacctttgaacagggtagagcctcctgagaggacaatgttagagaaaagcgtgcgccgcaggtccatgtctgacttctgaatggcgaacaccaggacctcgtggatgccttcactctcctctccaatcaaatctggcctgaagagcaactcaggggcccggaatcgggaaggaccaatctgcaggtaggagggccagctgaagaggtcggagctgggaccaaggtcccc

SEQ ID NO: 63557 - DNA, 601 bp, Human
tgccactcatctggggaagcaggtttccagtccccacaggtcccagggaagctgggactattggggggggcagggagaagcagactccatggcaagaactgtactccttcctttaggatccccgctctcctcagacagccaacctccttcacctatcactaaggtgtcagactgtgtgacaggggagccacctgggcagggggcacagcaacagtaagtcagtctcctcttaagattatagtttccctgaaagatcacgcagggggccctctacctagtaccctgcctcatctgggtattrgaactgcctgcctttggtgtgaagagggagaatgagaactcagcctccctgtggctgacctagacctcagggtcagtgtacaggctgggaacctggcgctgcttgtagagccatggctgcttgaagagcttgggcaaagctagagggaagctacgccaggtggcactctgtccatggaagcctagttccacccaggccaggccccaccatgctcctaccctgatcttcacatcttttggagctagtttcttcacttcactcaggagcctgtcaccaaaacctgaatgggcaaagaggaga

SEQ ID NO: 63558 - DNA, 601 bp, Human
ggcagagggattagatttgacagactcagatacaggaagccagtgaagacagggaaacaacatcgcctttcatttaggtagattttaagtttaagaaataactggttataaatttgaccacaatagtatgcttgtctctgtggagctgggaaaaactcctaggatttttaatcttgaaattcagactattgaagtgaagtttactcctctattttctctctctcaccagattgccacggcagtgaagtttctacagaattcccgggtccgccagagcccacttgcaaccaggagagcattyctaaagaagaaaggtacaggttccacagggctgtgcagcacggcctgcagggggactggggctggggcagatggaagccacggtgcaaggcaggtgctgagctgccaggacttcctagagctgcccactcatggggcagtggggctgaggcgaaccccccagtggggcatgcaggtttctttcctgacgatggagcggcaagatgacacgattcgggtaattaagcacggatgacttagtccagtccatcatggcaaaggcagcattcagtagcagagtcggcccattggatgagactgt

SEQ ID NO: 63559 - DNA, 601 bp, Human
ttgcaaccaggagagcatttctaaagaagaaaggtacaggttccacagggctgtgcagcacggcctgcagggggactggggctggggcagatggaagccacggtgcaaggcaggtgctgagctgccaggacttcctagagctgcccactcatggggcagtggggctgaggcgaaccccccagtggggcatgcaggtttctttcctgacgatggagcggcaagatgacacgattcgggtaattaagcacggatgacttagtccagtccatcatggcaaaggcagcattcagtagcagagtcrgcccattggatgagactgtggaggacttctggtttttggtctgctctgtgtcagtgaccctggctgcaggatgactagcttaggttaggagttcagctgcttcaatagagaatgagggagaaagaaatgaagggcgagggaaacgagatgactaacaaggtcaggttaaactcaagcttggggtcagtccgatttacagattgaagcggtaaattagtggttttatggtatttctgtaaacagggataaagtggaccctgacaaattcaatattgtctgaagagacaatctattctggtt

SEQ ID NO: 63560 - DNA, 601 bp, Human
gcaaccaggagagcatttctaaagaagaaaggtacaggttccacagggctgtgcagcacggcctgcagggggactggggctggggcagatggaagccacggtgcaaggcaggtgctgagctgccaggacttcctagagctgcccactcatggggcagtggggctgaggcgaaccccccagtggggcatgcaggtttctttcctgacgatggagcggcaagatgacacgattcgggtaattaagcacggatgacttagtccagtccatcatggcaaaggcagcattcagtagcagagtcggyccattggatgagactgtggaggacttctggtttttggtctgctctgtgtcagtgaccctggctgcaggatgactagcttaggttaggagttcagctgcttcaatagagaatgagggagaaagaaatgaagggcgagggaaacgagatgactaacaaggtcaggttaaactcaagcttggggtcagtccgatttacagattgaagcggtaaattagtggttttatggtatttctgtaaacagggataaagtggaccctgacaaattcaatattgtctgaagagacaatctattctggttct

SEQ ID NO: 63561 - DNA, 601 bp, Human
tcaatagagaatgagggagaaagaaatgaagggcgagggaaacgagatgactaacaaggtcaggttaaactcaagcttggggtcagtccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggargtcatttacacatccttatataccatgaggggcaaaagtaagctttcttcctcccaaagcaaaactctttttccttaaggagctggaatgccagccttgaaattctgagttttgagctttcagtcatttttggctggaataggtgggtgatatttcctaggtctgctctgtgatgtcccgctgaagggatgcagcatgaaccattggtcccttcatgcgatcatgtcccggggctgcactaacagggtttgggcagaagaagcccaaacatttcaccacaggcagctgcttcgcggcagc

SEQ ID NO: 63562 - DNA, 601 bp, Human
agggcgagggaaacgagatgactaacaaggtcaggttaaactcaagcttggggtcagtccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggaagtcatttacacatccttatataccatgakgggcaaaagtaagctttcttcctcccaaagcaaaactctttttccttaaggagctggaatgccagccttgaaattctgagttttgagctttcagtcatttttggctggaataggtgggtgatatttcctaggtctgctctgtgatgtcccgctgaagggatgcagcatgaaccattggtcccttcatgcgatcatgtcccggggctgcactaacagggtttgggcagaagaagcccaaacatttcaccacaggcagctgcttcgcggcagccccaaggctgggtccctgcgacagagttg

SEQ ID NO: 63563 - DNA, 601 bp, Human
ggggctgcactaacagggtttgggcagaagaagcccaaacatttcaccacaggcagctgcttcgcggcagccccaaggctgggtccctgcgacagagttggtaaggagcactgcacggctgctcactggctgcattgtgccagcacccccccccccccccgccatcattaggagattattaaaatttggagtgtgttggctggcctcgccactccgcaagcatcatgccataaaagagtttttccttgaaatatgtgtacctatggggagtaattaatcataaaagcttagggatttcagytctctcatcaaagcattgaagctggggaaagctgagcctaaaagctgagctgattacccggggtaacctgagacaaaatctatggttgccgagagatccttagctccagtatattgtgcaatattataactgcctgatcttctcttccaccgacaatgaccagttagtcctcattttctctcaaacgcagctgggttagaatttcatttgcagaaggtatttagagcaatttagagacaaatgtctctggtgtttgctcggcacttccccaccgcaggctttgctgagcagttttagtat

SEQ ID NO: 63564 - DNA, 601 bp, Human
tcttccaccgacaatgaccagttagtcctcattttctctcaaacgcagctgggttagaatttcatttgcagaaggtatttagagcaatttagagacaaatgtctctggtgtttgctcggcacttccccaccgcaggctttgctgagcagttttagtatcaggagctccatctaatctgtttaattttaataaatccctgactgggagagggagtgaaaaaaaaaagagagagagaaactctggaccaaataatacttcttttgagttacttggctaataattactgtagagagaaaactgttttgtgcaattatgattcgttgctcctttagcaaaaaaaatccaactgatcaattcatccaagagtcattgtgcaccctatgccctgtccctggactcccatcaggaatttagcagagaaccgaacagacaaaatccctgccctcgcagagcttaaattctagtggagggaaggcagacgattaacaaatgggaaaatgaaataggtcggatgtcagatgccgagcgccatggatactgatgaatgaagcagggagccggggtgaggaatgccagagttggtgtgggctggactgtgatc

SEQ ID NO: 63565 - DNA, 601 bp, Human
ctcctgatctcatgattcacctgtctcggcctctcaaagtgctggtattacaggcatgagccaccactcccggcctgctcagttttgacctagccattgagggaggcagtgggcacagagagaaaagagcaggaaggccttcgttagtgaggggaggctcaggcagagacgcatgtgccagtcgctggattggcgtgtgaggaaaaagaagggaagagaattgaggctggtgagataggaagtgagggaggagctggggttaggacccaatattatataacagtattgcctaggctggaaygtaatggcatgatcatagctcactgaagccttgaacttctgggctcaagcgatccttctgccttagcctcccgagtagctgggactacaggcacgtgccaccacacctggtgagtttttttgtagagacagggtctcactgtgtttcccaggctggtctcaaactctcggcctcaggtcatccttctgccttgccttcccaaagcattggaattacagacatgaaccacggcacctggcccatggagcacagagaaactctgtttgaggaagtttactctcggctctgtattgaaactga

SEQ ID NO: 63566 - DNA, 601 bp, Human
tcgctgtgaccctagtatgtagtgggcaggttaatgaatatttgttaaatgaatgaaaacattatttaatgaatctcagagtggctcttttctcccattttacatagatgaagaaattgaggtttagaaaggctaagttgagctaatacatggcagaagtagaactagaatctatgtcttctgaccaagattctttgaactataccacgtactttctggagaggaaggacagaaccacagacatggcagaagaaagagtaagccatgctcaggagggtgtgtgtggcaaagggatgggccraagatgactctcagggttgctttttttgtgttaagcagctttattgaggtgtaattgacatacagtaaactacacatatttaatgtgtggttttaaaaagttatgacatatgtataattgggaaactatcatcacaattaagataatggacatgcccagcatccccaaaagtttcctcctaccccttggtaatcccttcctcctgtggtccccccaacccccatatcctggtttgcaagtatgcattgatctgctatcactatagattagccttttttttttctttttctttttctgaga

SEQ ID NO: 63567 - DNA, 601 bp, Human
tctcaccagtcatgtatgagtgtaccagcattttgagcctggagaataggaagatgaaggtgacaaattttctagtaatgaagccacttgactttggaaatattcttaagagtgactaaataataggtcatgtttggactacttcagctttagaggcaacagtgcataaactatctgggtttgaatcctagcttcaccactctttagctgtgtggtcctgcataaaatacttaacttcgtggtacattggtttctttatctgtaaaatgggattaatgataatatttactgcaaaaaattmttgtaagaattaaatgaaaattggctgggtgcggtggctcaagcctgtaatcccaacactttgggagactgagacagaaggattgctttagatggaagggttgagaccagcctagacaacacagtgagatcctgtctctacaaaaaaaattaaaaattagctgggcgtggtggcgcatgcctgtggttccagctacttgagaggctaaggcaggaggattgcttgagccttggagtttgagcttacagggagctatgattgtgccactgcactgtagcctgggtgacagagcaagacact

SEQ ID NO: 63568 - DNA, 601 bp, Human
ttttgagcagagagggatttaatacaggcagttaggccgggtgcagtggctcaagcctgtaatcccagcactttgggaggcccaggcaggtggatgacttgaggtcaggagtttgagaccagcctgaccaacatggcgaaaccctgtctctactaaaaatacaaaattagccgggtgtggtgacgcttacctgtaaaccaagctactttggaggctgaggcaggagaattgcctgaacctggaggcagaggttgcagtgagctgagattgcgccattgcactccagcctgggtgacagagygagactctgtttcaaaaaaaaaaaaaaaaaaaaaaggctaggtgcggtggctcacgcctataatcccagcactttgggaggccaaggtgggcagatcacaaggtcaggagattgagaccatcctggccaacaccgtgaaaacctgtctctactagaaaaaaaaaaaaaaatcagccgtgcgtggtggtgggcacctatagtccccgctgctcaggaggctgaggcaggagaatggcgtgaacccgggaggcggaggttgcagtgagccgagattgcgccactgcactccagcctgggtga

SEQ ID NO: 63569 - DNA, 601 bp, Human
ggatttaatacaggcagttaggccgggtgcagtggctcaagcctgtaatcccagcactttgggaggcccaggcaggtggatgacttgaggtcaggagtttgagaccagcctgaccaacatggcgaaaccctgtctctactaaaaatacaaaattagccgggtgtggtgacgcttacctgtaaaccaagctactttggaggctgaggcaggagaattgcctgaacctggaggcagaggttgcagtgagctgagattgcgccattgcactccagcctgggtgacagagcgagactctgtttcaaaaaaaaaaaaaaaaaaaaaaggctaggtgcggtggctcacgcctataatcccagcactttgggaggccaaggtgggcagatcacaaggtcaggagattgagaccatcctggccaacaccgtgaaaacctgtctctactagaaaaaaaaaaaaaaatcagccgtgcgtggtggtgggcacctatagtccccgctgctcaggaggctgaggcaggagaatggcgtgaacccgggaggcggaggttgcagtgagccgagattgcgccactgcactccagcctgggtgacagagtgagactcc

SEQ ID NO: 63570 - DNA, 601 bp, Human
ggggaatcaagaggctgtcactggagctgtggagctcaagtgcatgtccttgcagctgtgatccagggaccaagaagttgctgctgcccccactgcaagtgttgtgtgacacctggaaaagcaacgacaggacattggaatgtgggcttggcttctacttctgtgaagattggctcttgacccccatgaagctggagactggacattacaataggaaacctcagtgtttccaatatcctgcctgcccatctgctgatatttgcagcaatcaaaagcagcaagaacagcagtcctctgcctyatttccactttccaaattgtccatgagtgcacctaattggtggtacctaattcccatccagaactctagctgccatggagggaagcattttgtgcaatatggcgcaaattatgggtgcgttagtccccgccttaaccacggaggagacgttccaagacctccagtggatgcctgaaacctcggctagtaccgaactctgtatgtactatgtttttcttatgcttgcatacctttggtaaagtttaatttataagttaggtacactaagagattaacagtgttaactaataataaaattga

SEQ ID NO: 63571 - DNA, 601 bp, Human
gtgatccagggaccaagaagttgctgctgcccccactgcaagtgttgtgtgacacctggaaaagcaacgacaggacattggaatgtgggcttggcttctacttctgtgaagattggctcttgacccccatgaagctggagactggacattacaataggaaacctcagtgtttccaatatcctgcctgcccatctgctgatatttgcagcaatcaaaagcagcaagaacagcagtcctctgccttatttccactttccaaattgtccatgagtgcacctaattggtggtacctaattcccayccagaactctagctgccatggagggaagcattttgtgcaatatggcgcaaattatgggtgcgttagtccccgccttaaccacggaggagacgttccaagacctccagtggatgcctgaaacctcggctagtaccgaactctgtatgtactatgtttttcttatgcttgcatacctttggtaaagtttaatttataagttaggtacactaagagattaacagtgttaactaataataaaattgaacagttaaaacaatatactgtcataaaagtaatgtgaatggactcaccacctctccc

SEQ ID NO: 63572 - DNA, 601 bp, Human
atgtactatgtttttcttatgcttgcatacctttggtaaagtttaatttataagttaggtacactaagagattaacagtgttaactaataataaaattgaacagttaaaacaatatactgtcataaaagtaatgtgaatggactcaccacctctcccaaattatcttattttcaggtaactgagactgcaaaaagcaaaaccacagataaagggagacttctgtgtatatgtgacagaaggatacttttatgcttttttagtctattattatttttttagaagacttgggcctttgttagyaactgtaatgatatacttccagtttgtccaagagataaatattgatgtattctgtatcatcactggctttcgagatgattttaagaaaacttgttggctgggtgcagtggctcacgtctgtaatcccagcactttgggaggctgaggcaggcagatcacctgaggtcaggagttcgtgaccggtctggtcaacatggtgaaaccctgtctctactaaaaataaaaaaaattagccaggcgtggtggcgcatgcctgtcatcccagctacttgggaggctgaggcaggagaatcgcttgaa

SEQ ID NO: 63573 - DNA, 601 bp, Human
ccctgtctctactaaaaataaaaaaaattagccaggcgtggtggcgcatgcctgtcatcccagctacttgggaggctgaggcaggagaatcgcttgaaccctggaggcggaggttgcagtgagctgagatcgcgccactgcactccagcctgggtgacagagtgagactctgtctcaaaacaaacaaacaaaacaaaacaaaaagaaaaatttctttcttatctggcctcacttagggatggaagttcttttaatgagatttatctgctaagggtagacaagagagtttccaccaaagggrctacatgatatgcgggcttattggaactgttggaaaatgttagaagcagggatttttgaaacttaacataaggtataacataaggcaatctctactgaaaaacattttatgttgattggactgtaattagaaagatttaaaaataactttggatagtattcattaatttaccaatccattgttatattcaacactttcgagctgatgtcttttaaaaatctaagtttatctgttggggggtggtgtatgaattagtgtatctgtaattgtatgaatacggagtattcttatctttgtatg

SEQ ID NO: 63574 - DNA, 601 bp, Human
aagtaaaggtaactcactaatggtcctcagtaaacagagtgatggggcaagctgacttatatttcaattgttctgagaattgaacaactctactaatgtttcctttccaacttcaaacatacctgttcagtttcttcaacatcctgataggagctgatctcctcagaactctcccctctcatcagacagaggacttgggcatgctctaatctcttactgttaattattctttttagttttaaagccctttaaagtaatctttctgtaattagattgttgagtagattgtctttagtaatayggtggtcttaaattttgtgtggattttcagattgttaaatggttgcagaggctttcattcatgaagttcaagtttactatatcatggtatgtcaggaaaaaaaaaatcatgaccctctgtgataaattaaatatcacaaccacgtaaatgtcatcttttcaatgaaactgaaagtgcataggaatgggactctttttcagtctgttttggctttaagctgtaagaaaaatattttaacactgacagtagtaaacctatgaagctaaagaacaaagccatactctccccagctttataagt

SEQ ID NO: 63575 - DNA, 601 bp, Human
agtgacattttatagcttccatctggagacaccatggaaaataaaagttctattctcccagtctagaattgtccatgtcagctgtgaccaagttcagctctgttcaccaagcattcctcatctgctgtttgccaagtgctatgctaagtgcactggggacataaatggtccacacccttagagaacttggtgatgaggctgtagaagctactagtaatacagatgttttaatttacaggcaagcctgagatgatacggtacagactgtataatagccactggcatgtgtattttgctttayagcttaaaagcattcacacatacatttgcccatttaattttcatggtaacctaagtcatttcctcaaaaagtgtaaacatgggcttatgagacatatggaagcccacccaatttgaggagcagggtctctgtcatcactgagttgaatttcagggtgtagtctgcgcctgtgctctccccttgaagaatcacattatagaaaatgaaatctagaatgactacagaggttacttagttcgtctataccttttcatatacatttcagtaattattttgctacataggaagtgaatttaattt

SEQ ID NO: 63576 - DNA, 601 bp, Human
ggctgtagaagctactagtaatacagatgttttaatttacaggcaagcctgagatgatacggtacagactgtataatagccactggcatgtgtattttgctttacagcttaaaagcattcacacatacatttgcccatttaattttcatggtaacctaagtcatttcctcaaaaagtgtaaacatgggcttatgagacatatggaagcccacccaatttgaggagcagggtctctgtcatcactgagttgaatttcagggtgtagtctgcgcctgtgctctccccttgaagaatcacattrtagaaaatgaaatctagaatgactacagaggttacttagttcgtctataccttttcatatacatttcagtaattattttgctacataggaagtgaatttaatttggagtttttcctgctgccttccatgagggctttcatcctaagccccattcttgtgtgtgagaagaggaagtcttgggcttgagtgtggctctaaagtaaatgccgttgactttgttgttctgtatggacgcttttatcaggacaataaagggtacatagggtgacctctgctcctgtggagaggtcgaatggttac

SEQ ID NO: 63577 - DNA, 601 bp, Human
tttcgccaaaaatgtgtttataattctgccatacacacatgatattcatgtccttgctgtccatgtggaaatgtccctttttataatgttaaacaaattaaatcgactttctcctgagcttccgtgcctcacctttaagatccattctcaggagtcgaacctccatgaagccgagctcatctccattagcgtggatgtcattacacagcgcgctggaggctggtgcattaggcagctttatcccagcagcacggattcggcttggagattctttagaggtgactccagggcagtaaatgtwtttcacgcatactgcctgaacactaacaaggccttaccataattactctgtttgttttggggaaatggtaggtatttgtttaaaaggattttgtggtgaaccaagaatatacatgtgtagttagttctcgctattcacttgtgaatgatgcattgtagaagttttatcttataccaatttttctttaattttctgcagctctacttcccttccaaccagtttggtatcagggatgcaaactaattttaatgttagcctaacaaaaatacaatcagaaagttatggccaggcacggtggct

SEQ ID NO: 63578 - DNA, 601 bp, Human
ttctttaattttctgcagctctacttcccttccaaccagtttggtatcagggatgcaaactaattttaatgttagcctaacaaaaatacaatcagaaagttatggccaggcacggtggctcatgcctgtttacagtcccagcacttagggaggctgaggcaggtgtggagttcgagaccagcttggccaacatggtgaaaccccgcctctactaaaaatacaaaaattagccgggtgtggtggcaggcacctgtagtcccagctactcaggaggctgaggcaggagaatctcttgaacccrggaggtggaggttgcagtgagctgagatcgtgctgctgcactccagcctgggcgacagaacaagactctgtctcaaaaaaaatataagttatactgcatactgcatacttagatgaaacataaacatttaaaaactatctccgggctgggtgtggtggctcatgccagtaataccagcactttgggaggccgagacgggcaaatcacgaggtcaggagttcaagaccagcctggccaatgtggtgaaactccatctctactaaaaatacaaaaattagctgggcgtggtggcggacgcct

SEQ ID NO: 63579 - DNA, 601 bp, Human
aaatacaatcagaaagttatggccaggcacggtggctcatgcctgtttacagtcccagcacttagggaggctgaggcaggtgtggagttcgagaccagcttggccaacatggtgaaaccccgcctctactaaaaatacaaaaattagccgggtgtggtggcaggcacctgtagtcccagctactcaggaggctgaggcaggagaatctcttgaacccaggaggtggaggttgcagtgagctgagatcgtgctgctgcactccagcctgggcgacagaacaagactctgtctcaaaaaaaawataagttatactgcatactgcatacttagatgaaacataaacatttaaaaactatctccgggctgggtgtggtggctcatgccagtaataccagcactttgggaggccgagacgggcaaatcacgaggtcaggagttcaagaccagcctggccaatgtggtgaaactccatctctactaaaaatacaaaaattagctgggcgtggtggcggacgcctgtaatcccagttactcaggaggctgaggcaggagaatcgtttgaacctgggaggcggagtttacagtgatctgagatcacgcc

SEQ ID NO: 63580 - DNA, 601 bp, Human
gaatctcttgaacccaggaggtggaggttgcagtgagctgagatcgtgctgctgcactccagcctgggcgacagaacaagactctgtctcaaaaaaaatataagttatactgcatactgcatacttagatgaaacataaacatttaaaaactatctccgggctgggtgtggtggctcatgccagtaataccagcactttgggaggccgagacgggcaaatcacgaggtcaggagttcaagaccagcctggccaatgtggtgaaactccatctctactaaaaatacaaaaattagctgggcrtggtggcggacgcctgtaatcccagttactcaggaggctgaggcaggagaatcgtttgaacctgggaggcggagtttacagtgatctgagatcacgccattgtactccagcctgggcaacagggcaagactccgtctcaaaaaaaaaatctgctttttagattcatttactctaagtttgttcatgcctgttatctatatatttatatctatgtttgtatcaattgttggttcccagtttagcacatagaggcagtatgattcactggaaaaatcctctatccatttactaattattaaa

SEQ ID NO: 63581 - DNA, 601 bp, Human
gattcatttactctaagtttgttcatgcctgttatctatatatttatatctatgtttgtatcaattgttggttcccagtttagcacatagaggcagtatgattcactggaaaaatcctctatccatttactaattattaaatatccatttccttcatgtgccaacatttgtgctaaacataaaaatacaaaaataagatttaatatttgtagtttagtggggttccatgatatataaacagatgtggtgtgggtgataaaatattataggtgctataataggtatctgagcggaggcctgsggggagagcgatcagttttgtggtaggggaggagaactagtggcgaagaggttaaaaaggtgcctccattcatggaggaggtcccctttatccgagccctgcaagaggattagttgtttttaaggtctgaagcggattggtgacttttgtccatgcagaggatgtgatggggcatagccactaaggcgagagatcgaggagacagcttggaaaggtgggcaaaggtgggatcagggaagacctggcatgtgttacctcaagagtgtggattttgttatgtggacagtggggaaaccacgg

SEQ ID NO: 63582 - DNA, 601 bp, Human
tcagggaagacctggcatgtgttacctcaagagtgtggattttgttatgtggacagtggggaaaccacggaaaagttgtatgtggaataataagtttcatgctagcgttttagaaagctctctcaaaggtagggcgggcatttaggagaggggaatgatggatgaaccagggcagttattacggggatggagaggatggattagagagtgaggaagcagaatctcctgggaattggtggctgaatggatgcaagagtgaagaagagggaagagtctgggctcactgtccaaatttttggcytagggagctggtgtggaggatagcagatgaaagagtagaccaggagtgagagacgctgtgaagagagaaggcccagagggaggtgcgggggaccctgtcacgtggttagtggttggccagaggcggatgccccacagtcaggcagtggcgctggcttctgcctttcaaagtcgcttctacagggtgaccgttaagcttgttctttgacgccgacattgttaagtggtttcactgaaatttgagactctctgaagaaaggaaagatggcatttatgaagcaagtgttattttatctggaaa

SEQ ID NO: 63583 - DNA, 601 bp, Human
gaagagggaagagtctgggctcactgtccaaatttttggcctagggagctggtgtggaggatagcagatgaaagagtagaccaggagtgagagacgctgtgaagagagaaggcccagagggaggtgcgggggaccctgtcacgtggttagtggttggccagaggcggatgccccacagtcaggcagtggcgctggcttctgcctttcaaagtcgcttctacagggtgaccgttaagcttgttctttgacgccgacattgttaagtggtttcactgaaatttgagactctctgaagaaaggraagatggcatttatgaagcaagtgttattttatctggaaatgatttctcaggggtaagcctgtcactctgcctctggtaaagtctgcttctccctccaagaagagaaggtcccactgatttgggtcatggtcagagtgggccgctactcccaccttccactgaaaactcagcttccagaaagctcctcttcactcctttgtcatctgtttcctcatctgctcttccctgagtttgtccttctctgttatatctgcatgtgtttccactgatctgcttgtgacagtcaacctgtttgctga

SEQ ID NO: 63584 - DNA, 601 bp, Human
ggatgaggggttgggatgacaggagttcacagtgtcctgcctgccccttcagcagcataacctttgtctttctggactcctggctggagctggtgatactgtgaacatgctgcctctctggaagctgctccatgtctccctatatccccagagcatggcagctgtgatcagaattccacagggtggggctgatgaggatccatgcacatccgtccctgtacccctcattagggacttgggttggggggtgcctatctgcacgtgttctttttcctctcatgcactttgtcggtctctgtgmagggtttctattatactaataaggagcactggggacgctggcgacagtgtgataatcgtccccttggagggccagaggcagtcggtgtgcgctgacctcatcctgggggagtgctgatgaaactctggcttggccttactgcctgagcactgcgcctgatgtggagggttagggggcagggttgccgggctgtttcttctacggcttcattgttaccagccatgcttgtctttggggcatttcatcaaaacttctttagttttgcttaaggaactttaaagagctgatgagcctaatgga

SEQ ID NO: 63585 - DNA, 601 bp, Human
tgcctgccccttcagcagcataacctttgtctttctggactcctggctggagctggtgatactgtgaacatgctgcctctctggaagctgctccatgtctccctatatccccagagcatggcagctgtgatcagaattccacagggtggggctgatgaggatccatgcacatccgtccctgtacccctcattagggacttgggttggggggtgcctatctgcacgtgttctttttcctctcatgcactttgtcggtctctgtgcagggtttctattatactaataaggagcactggggacrctggcgacagtgtgataatcgtccccttggagggccagaggcagtcggtgtgcgctgacctcatcctgggggagtgctgatgaaactctggcttggccttactgcctgagcactgcgcctgatgtggagggttagggggcagggttgccgggctgtttcttctacggcttcattgttaccagccatgcttgtctttggggcatttcatcaaaacttctttagttttgcttaaggaactttaaagagctgatgagcctaatggaaacttttcagtaataactcagtacaggaacacacttc

SEQ ID NO: 63586 - DNA, 601 bp, Human
tcctctcatgcactttgtcggtctctgtgcagggtttctattatactaataaggagcactggggacgctggcgacagtgtgataatcgtccccttggagggccagaggcagtcggtgtgcgctgacctcatcctgggggagtgctgatgaaactctggcttggccttactgcctgagcactgcgcctgatgtggagggttagggggcagggttgccgggctgtttcttctacggcttcattgttaccagccatgcttgtctttggggcatttcatcaaaacttctttagttttgcttaaggaactttaaagagctgatgagcctaatggaaacttttcagtaataactcagtacaggaacacacttcacaaataccagctaattaatcctcagagcaccctggggacaggggagagtatggtaatggcactggtgatttttatccccattttatagactgagagactgaggcacctggaagaatctgtgacttgggccagagggagggcacaaatctggaagctgaggttagagtgctttgccttttggcctctcttgggactgttgagtcttaccttaaagtcatttgagtaagtcatta

SEQ ID NO: 63587 - DNA, 601 bp, Human
ctttggggcatttcatcaaaacttctttagttttgcttaaggaactttaaagagctgatgagcctaatggaaacttttcagtaataactcagtacaggaacacacttcacaaataccagctaattaatcctcagagcaccctggggacaggggagagtatggtaatggcactggtgatttttatccccattttatagactgagagactgaggcacctggaagaatctgtgacttgggccagagggagggcacaaatctggaagctgaggttagagtgctttgccttttggcctctcttggractgttgagtcttaccttaaagtcatttgagtaagtcattaagtaaagccagtcaccttagattttgcctcttctctcatctttcttttttttttccctgcttgatactaggtcttggatgtaactggtatccatcaatacagatctctagcatcaattttagtaactgccttgtgttctgctgaaaatatatgccataatttattgtaacccagtccccttgattatcttcatttttcacaattatagcaactcttctttaagtatccttgggaaataggtattacttttgtgattacc

SEQ ID NO: 63588 - DNA, 601 bp, Human
acagagtgagactctgtctcaaaaacaaaaagcaaaaaacctcagagctgctaatcctaggttaaagaaaatggacttgttttcattttaatgtacattgctaacctgtgctttaaaaaggtgatttcagcttacagcctcaacaccagttggccagtgccccgagcacaagtctcaaacttccacattgtcaagttcacagtttcttcctttgtctaagcatggaaaacccttcccccactgcaagggcatagaactatttgcctacctttttttttttttaaatgattttagttttctyttatggaatttgtgttgttgctagttgcgtaacagggaatataactttattttttcctgttgaccaactggatagtctcagcaccatttatagaacgatttatttctttccccactgatttgacatgtcacctttttcatctgctaaattcttaaatatactgatgtgtgatcagggacattctattctcattcattgctgtacttgtctgttgttgtgctaatgctgcaatgtttttattattatagatttgttacacactgtatttgttagtattccgttgtactcttttacaaaaat

SEQ ID NO: 63589 - DNA, 429 bp, Human
cattgtcaagttcacagtttcttcctttgtctaagcatggaaaacccttcccccactgcaagggcatagaactatttgcctacctttttttttttttaaatgattttagttttcttttatggaatttgtgttgttgctagttgcgtaacagggaatataactttattttttcctgttgaccaactggatagtctcagcaccatttatagaacgatttatttctttccccactgatttgacatgtcacctttttcatctgctaaattcttaaatatactgatgtgtgatcagggacattctrttctcattcattgctgtacttgtctgttgttgtgctaatgctgcaatgtttttattattatagatttgttacacactgtatttgttagtattccgttgtactcttttacaaaaatataaaaattttgt

SEQ ID NO: 63590 - DNA, 601 bp, Human
tagaaattactttggaagctggacgctgtggctcatgcctgtaatcccagcactttgggaggccgagacaggtagatcatttgaggttaggagttcaagaccagcctgactaacatagtgaaaccccatctctctactaaaaatacaaaaattagctgggcatggtggtacacacctgtaatcccagctactcaggagcctgaggcaggagaatcacttgagcctgggaggcagagattgtggtgagctgagattgcaccactgcactccagtctgggcgacagaatgagaccctgtctcaaaaaaaaaaaaaaaaaaaagaaagaaagaaattactttggaaagaattggtgtctttgcagtatgcactctttccatccacggatgtggggtatctttcaagtaaaatatgtaatgcccctcactgatggttttgtacagttcttgcatagttcctgcacatttcctttaattctgagtacctgtatttttaattttttattcttgctttaggatatttatttccattatattttctaattgatctttgccaatagttaggaaagctgttgatttctgtgtttttagaattattttatta

SEQ ID NO: 63591 - DNA, 601 bp, Human
tcttttatatttaacagcttcaaatttccagaaaagtggaatagcgtatgaacacccaattaccttttctttctttcttttttggagatggggtctcactctgtcacccaggctggagtgcagtggtgccatctgggaccacaggtgtgcaccaccagacccagctaattttttgtttctttgttttttggtagagatggggtttcgccatgttgcccaggctggtctcaaacttctgacctcaggtgatctgcctgcctcaacctcccaaagtgttgggattacagacatgagccaccaygcccagcctcccagataccttttattcagtttcttagttgttaacattttgcccccttttttttttttttttttgagacggagtcttgctctgtcgcccaggttggagtgcagtggtgcaatcttggctcactgcaacctctgcctcccaggttcaagcaattctcctgccttagcctcccaagtagctgggattataggcgcacaccaccacgcccagctaatttttgtatttttagtagaggcggggtttcaccatattggccaggctggtctcgaactcctgaccttgtgattcgcc

SEQ ID NO: 63592 - DNA, 601 bp, Human
aacattttgcccccttttttttttttttttttgagacggagtcttgctctgtcgcccaggttggagtgcagtggtgcaatcttggctcactgcaacctctgcctcccaggttcaagcaattctcctgccttagcctcccaagtagctgggattataggcgcacaccaccacgcccagctaatttttgtatttttagtagaggcggggtttcaccatattggccaggctggtctcgaactcctgaccttgtgattcgcctgccctcggcctcccaaagtgccgagattacaggggtaagccrctgtgcctggcccattttgccacttttactttgtctcactctctacacacacacatatacacacacacaaaccctaatctgaccatgtaaaaataaattgtagatatcatgacacttcacctgtaattacttcagcatatacctcctcagatacggccattcttccacacataaccacaccatgttaccacatagaagaaaattaacactaattccataagatcatctgctatatatcccatatttacattttcccagttgcccccacatttcttttgtatctcagattcaggggacagt

SEQ ID NO: 63593 - DNA, 601 bp, Human
tgtgcctggcccattttgccacttttactttgtctcactctctacacacacacatatacacacacacaaaccctaatctgaccatgtaaaaataaattgtagatatcatgacacttcacctgtaattacttcagcatatacctcctcagatacggccattcttccacacataaccacaccatgttaccacatagaagaaaattaacactaattccataagatcatctgctatatatcccatatttacattttcccagttgcccccacatttcttttgtatctcagattcaggggacagtcrgggcttgtgctgtgcatttcactgccatgtctctttatctagaactgccctcttgtctcttctcattttacttgtcattaacattttttgaggagttccaatcaattgttttatataatatcacacattctgcatttgtctcattgtttcctcttgataagattaagattaaacatttttggcaagaacagttagtaagtaatgttgtgtgcttattattgcattacaataaaaggtgagaaagatcagattcttccagtattggtgatgctaatttgattggttaatgaggtgactacc

SEQ ID NO: 63594 - DNA, 601 bp, Human
actagatttcatttgtgcatttttggtaagaatacacaggagtggtattgtgtctttccagcatcataaaaggacattgattttgatttgttctgtgatttcactttgatctgttggttgaagtggtatctgccaagtttctccactgcagagttatattttttccctttataattaataagtaccttttgaggagatacttcgatccttcgacactatatgagtagcctgtttttatcagcttcatgaacattgctaatgattcctcactgaatcaattattatgaagattgctgaatcytcatatcagttattatgaggattgctgaatggtgattttctttttttctttctttcttttctttttttttagagacagagtctctctctgtcgcccagggtggagtgcaatggcatgatctcggctcactgcaacctccatctcccgggttcaagcaattctcctgcctcagcctcctgagtagctgggattacaggtgcacaccaccatgcctggctaattttttttttttttttggtagaggcggggtttcaccatgttggtcaggctggtctcgaactcctgaccttgcgatccact

SEQ ID NO: 63595 - DNA, 601 bp, Human
catcataaaaggacattgattttgatttgttctgtgatttcactttgatctgttggttgaagtggtatctgccaagtttctccactgcagagttatattttttccctttataattaataagtaccttttgaggagatacttcgatccttcgacactatatgagtagcctgtttttatcagcttcatgaacattgctaatgattcctcactgaatcaattattatgaagattgctgaatcttcatatcagttattatgaggattgctgaatggtgattttctttttttctttctttcttttytttttttttagagacagagtctctctctgtcgcccagggtggagtgcaatggcatgatctcggctcactgcaacctccatctcccgggttcaagcaattctcctgcctcagcctcctgagtagctgggattacaggtgcacaccaccatgcctggctaattttttttttttttttggtagaggcggggtttcaccatgttggtcaggctggtctcgaactcctgaccttgcgatccactgaccttggcctccccaaagtgctgggattacaggcgtgagccacggcgcctggccgctgaa

SEQ ID NO: 63596 - DNA, 503 bp, Human
atttttgcatttttgtatttgtatgccaggcatgtgctgggcatagtggcacatgcctgtcagctactccggagccggaggccggagaatcccttgaacccgggaggcggaggttgctgtgagccgagatcgtgccattgcactccagcctgggcaacaagagcgaaactccgtctcaaaaaataaaaaagttgggccgggcrcagtggctcacacctgtaatcccagcaccttgggaggccgaggcgggtgtatcacgaggtcaggagattgagaccacggtgaaaccccgtctctactaaaaatgcaaaaaattagccgggcatggtggcgggtgcctgtagttccagctactcgggaggctgaggcaggagaatggcgtgaacccaggaggcggggcttgcagtgagccgacatcacgccactgcactacagcctggcgacagagcaagactcggtctcaaaaaagaaaaaaaaaaaagttatttcattattttctggct

SEQ ID NO: 63597 - DNA, 601 bp, Human
gctgggcatagtggcacatgcctgtcagctactccggagccggaggccggagaatcccttgaacccgggaggcggaggttgctgtgagccgagatcgtgccattgcactccagcctgggcaacaagagcgaaactccgtctcaaaaaataaaaaagttgggccgggcgcagtggctcacacctgtaatcccagcaccttgggaggccgaggcgggtgtatcacgaggtcaggagattgagaccacggtgaaaccccgtctctactaaaaatgcaaaaaattagccgggcatggtggcgggygcctgtagttccagctactcgggaggctgaggcaggagaatggcgtgaacccaggaggcggggcttgcagtgagccgacatcacgccactgcactacagcctggcgacagagcaagactcggtctcaaaaaagaaaaaaaaaaaagttatttcattattttctggcttctattgtcatctttcagtcttgttattgctcctttgaagaaggtgaaacatgtttttatcttctggcagcttttagatttttttctcaatctttggtgtttttttcaaaagtagttttcctatgtgatgttc

SEQ ID NO: 63598 - DNA, 601 bp, Human
aaataaaaaagttgggccgggcgcagtggctcacacctgtaatcccagcaccttgggaggccgaggcgggtgtatcacgaggtcaggagattgagaccacggtgaaaccccgtctctactaaaaatgcaaaaaattagccgggcatggtggcgggtgcctgtagttccagctactcgggaggctgaggcaggagaatggcgtgaacccaggaggcggggcttgcagtgagccgacatcacgccactgcactacagcctggcgacagagcaagactcggtctcaaaaaagaaaaaaaaaaaagttatttcattattttctggcttctattgtcatctttcagtcttgttattgctcctttgaagaaggtgaaacatgtttttatcttctggcagcttttagatttttttctcaatctttggtgtttttttcaaaagtagttttcctatgtgatgttcctgaggtggttttctttgtagttatcctatgtaacatagaatctttgaatattcggcctgattgccttgttagttttacaaaattattaattattctctcttttaatattgttctgtcttgttctcattctcttctttcctggac

SEQ ID NO: 63599 - DNA, 601 bp, Human
ctttactgatctttcagtttactaaccctttcttctgctatatccagtttgctgttaaacctgtctgttgagctcttaatttcaattattgcattttacagttaccttgtttgcatttgatttttttttttttttgagacaaagatttcactgtctcactctcttgcccagactggagtgtggtggcacaatcaaggctcaagccatcctcctaccttagtctcccaagtaactgggactacaggtgtgagcaaccacacctggcctgatttttctttttctttcttttttttttttttttgtagagacagggccttgccatgttgccaaggctggtctcaaattcctgagctcaagtgatgccacctgccttggcctctcaaagtcctgagattataggcatgggccactatgcctaacctgatgccttttaagtttagttttctagtaaacttctctgttttgtcacctgtttcattgaatatattaattagttcttttaaagtctttgataaattttaacactgggctatctatgagtttgggttttttaaattcattttcccccacttggtcctattttttgtatatcttttttttt

SEQ ID NO: 63600 - DNA, 601 bp, Human
aggagttctgctttgtgaactccatttgtttatttatttacatgtctgtctatttacttacatctctctagtccatctgaagatggacaaaagctctgcctcagcatcttatagggtatttgctcacctttctgcagttcccttctcactgagatcttggactctcaagtcttggttgccttggcagctccccagtactttcaatcagtttgtttttcagttgttctcagcagtattgttgaacttttacaagctatttcatcttggttagatgcagaaagcctctcagtgctgttttgakttgaatttctcttttgaacttaagagccatttttatttccgtatctacaaattgactattcaggtattttaccctttcttgggattaggagattaatgttttaaaattgatttataattttatatactaaggaaaatagccccatgtctgggatttgtgttacaaatatatgctattagtttgaaatttgtcttgactttgtttatgatgcttttgtccaggcagaatttttttatttatctatcatttcttttatgacttccttttttttttttgacgtggaatttcactcttgttgcc

SEQ ID NO: 63601 - DNA, 601 bp, Human
tgcaacctccgcctcctgagttcaagggattctcctacctcagcctcccgagtagctaggattacaggcatgtgccatcatgcctggctaatttttttgtttgtttgtttgttttgttttgttttgttttttagtagagacggggtttcttcatgttggtcaggctgatctcaaactcccgacctcaggtgatccgcccgcctcggcctcccaaagtgctgggattacagacgtgagccaccgctcctggccaccagtattattttttaaacctcaagttgtttttttttaagtaatcagsaatttatttcagtgtatagagtataaggattcaagttcagttttttccagctaataaaataatccagcatccattattgcaagggttgacacactttttctgtaaagagccagatagtaaatactttaaggttttgcaatttgtatggtctctgaacactactcatcgccactgtggtagcacaaaagcagccgttgacagtgtataaactaatgagaaataaaactttatttatggacactgaaatttgaatttcatctaattttcatgtatcattaaattctttttttgcctcctaac

SEQ ID NO: 63602 - DNA, 601 bp, Human
agtttttctccattgatttgcaatgaagctttatcctatgttaacttcctgtatatatctggacgtactctgttcacttgaaatgtttctttgtgtccaatgtcacactatcttacatgttttattatctgttaaaattaattttgcctcagcattttttcaattatttggaattttcttggctattcttatttctatataattttcaaaattagcttgcccagtaaaaaatgaaaaataaagatttttttttagacagtcttgctgtgtcacccagattggagggcagtggcatgatctyggctcactgcaccctccacctcaggagactgaagtggttctcctgcctctgcctcccaagtggctgggattacacgcatgcaccaccacgccgggctaatttttgtatttttagtagagacggggtttcgccatgttgaccaggctggtcttgaactcctgacctcaagtgatccgcctgcctcatcctctcaaagtgctgacattacaggtgtgagccactgtacctggcctaattttcttattttttgtagagacggggtctcactatgttgcccaggctggtcgcaaactcctgggc

SEQ ID NO: 63603 - DNA, 601 bp, Human
ttttgaatgttgacacctagctagatacttatattgtttatggtacgttaattcatgtcagtttttccaggtgctatatgtaaataacactctcccctcttcttttccgttgcttatatctattactacttttcttgtccagttgcatcagcaaatacctccagaacagtgataaataaaactgatgattgtgaacgtatgatgtgtttctgattttaaataatatgcttttatatctttttaataaaagatgatgtcagctttggagaatgacacacatatacacaagtagatactcttyccccccccccactcccactaacagataatcatattcaggaagtattcttgtattcttattgtattagagtttttactaagaatggatatcgaattatatctaatgtcctttatcacttacagaaataatcatataattattgtcttttgatctaatatgataaagtatattaatagataacagtgaatcattattatattattaatatgaattccagccagttgtagtgtagtattttttaaatgtgctagattctttgtgccattattttatccagcagttagcagaatagccgtaagt

SEQ ID NO: 63604 - DNA, 601 bp, Human
tgacacctagctagatacttatattgtttatggtacgttaattcatgtcagtttttccaggtgctatatgtaaataacactctcccctcttcttttccgttgcttatatctattactacttttcttgtccagttgcatcagcaaatacctccagaacagtgataaataaaactgatgattgtgaacgtatgatgtgtttctgattttaaataatatgcttttatatctttttaataaaagatgatgtcagctttggagaatgacacacatatacacaagtagatactctttccccccccccactcccactaacagataatcatattcaggaagtattcttgtattcttattgtattagagtttttactaagaatggatatcgaattatatctaatgtcctttatcacttacagaaataatcatataattattgtcttttgatctaatatgataaagtatattaatagataacagtgaatcattattatattattaatatgaattccagccagttgtagtgtagtattttttaaatgtgctagattctttgtgccattattttatccagcagttagcagaatagccgtaagtatgtgttcaa

SEQ ID NO: 63605 - DNA, 601 bp, Human
tattattaatatgaattccagccagttgtagtgtagtattttttaaatgtgctagattctttgtgccattattttatccagcagttagcagaatagccgtaagtatgtgttcaagccctcagagatgatgaatttgttcatgcctttgtgttcatgccctcagacatcatgaatttgaggatatttggaaaaattaaggtagagtgttttttgttttgttttgttttgtttttgagacagagtctcactctgttgccctggctggagtgcagtggcgtgatctcggctcactgcaacctcygcctcctgggttcaagtgattctcatacctcagcctcccaagtagctgggattacagatgcacgtcaccacaccttgctaatttttgtattttttgtagagatggggtttcaccacattggccaggctggtctcgaactcctgacctcaagtgatctgcccaccttggcctcccaaagtgctgggatttacaggcatgagccactgtgcctggctttgaagtagagattgatggagatctagtttattttagtagtattggatgcattaaatataaacagtgctaatattataaatatca

SEQ ID NO: 63606 - DNA, 601 bp, Human
gttgccctggctggagtgcagtggcgtgatctcggctcactgcaacctctgcctcctgggttcaagtgattctcatacctcagcctcccaagtagctgggattacagatgcacgtcaccacaccttgctaatttttgtattttttgtagagatggggtttcaccacattggccaggctggtctcgaactcctgacctcaagtgatctgcccaccttggcctcccaaagtgctgggatttacaggcatgagccactgtgcctggctttgaagtagagattgatggagatctagtttattttmgtagtattggatgcattaaatataaacagtgctaatattataaatatcaaattctaagcattatagtactaaagcaatattcatgctttagtaaaatcatgaatactaattataataaatgtgaaaagtatgtaactattttttacaagtgagccatgaagtatgtgatagttgtgctttctcttttgtaaaatttttttttcatagagttaatggactctatttggggatggggcagattgcttagctgtgtacttatcactgattaatcctcactcagctcaagctgtaaaattcccc

SEQ ID NO: 63607 - DNA, 601 bp, Human
tatgtaactattttttacaagtgagccatgaagtatgtgatagttgtgctttctcttttgtaaaatttttttttcatagagttaatggactctatttggggatggggcagattgcttagctgtgtacttatcactgattaatcctcactcagctcaagctgtaaaattcccctcggcaccatcaaagacatcaggcaacttactgttttcttggtgccatttctggagccctctgcccgccctcccactgcagtctggactgcgctctctagacctgttccccagttgtcagcctttcccratgactctgggaagacccttttctctatcctgtggttgagttcctgtcttccaacttccatgtggtctttcttggattgcttctttgggttggtagaacagatcctccagtagcttcctgagaaggtgtgcatgggaggtaagcagcttttttagatccagtatctgaaaacatctttaatgtgccttcatgatttcatctttaggttggctgggtttagaattctaggttggaaatgattttttattagaatcttgaggacattttccattgttttctaccttcctgtgttgctgctga

SEQ ID NO: 63608 - DNA, 601 bp, Human
atcttcttgtattatttctttaataatttcctctcctttgtgttgtatattgtttttttagaacctcgatagttggatggtagatgtcctggcttgaccctcaagtatttaagaaaatatattttctttcctatcttttatcttttttgccctactttatatgtaatttcttctaatagtttgtcttctaataatttttttttccaatgtttttcctgggtattgaatgattttctgctctcaggtgtttatgagagttctttcttttctgtgtgtgttcccttttttcccccacattccrttcttgtttcattgatgcaacattacttcttttcctctgataattaatttctgtttcttccaagcttttttgtttgtttttggatggctgtttttcattttcttttttgagacgtggtcttgctctgtcgccaggctggagtgcagtggtgcgatcttggctcactgcaatctccacctcccgtgttcaagcgattctcctgcctcagcctcctgagtagctgggactacaggtgcacgccaacacgcccagctaatttttgtatttttagtagagatggggtttcaccatgttggccag

SEQ ID NO: 63609 - DNA, 601 bp, Human
tctcaggtgtttatgagagttctttcttttctgtgtgtgttcccttttttcccccacattccgttcttgtttcattgatgcaacattacttcttttcctctgataattaatttctgtttcttccaagcttttttgtttgtttttggatggctgtttttcattttcttttttgagacgtggtcttgctctgtcgccaggctggagtgcagtggtgcgatcttggctcactgcaatctccacctcccgtgttcaagcgattctcctgcctcagcctcctgagtagctgggactacaggtgcaygccaacacgcccagctaatttttgtatttttagtagagatggggtttcaccatgttggccaggatggtcttcgatctcttgaccttgtgatccgcccgcctcagcctctcaaagtgctgggattacaggcatgagccactgcacctggctctgttttttcattgttaagttttccattttccctcaaatgtctggtgatctttggctatccagtatttatgacagaggccataagtaaactgattggagcatctgtgggcatgagtccttcctaacatgtaagtgtaagatgacaaaaat

SEQ ID NO: 63610 - DNA, 601 bp, Human
tgggcatgagtccttcctaacatgtaagtgtaagatgacaaaaatcaaccagaagtatgtgttcaagctgctatgtctaactggaagtttctttagagaaaatgtcaacagggtttttttttttttttttgagatggtatcttactctgttgcccaggctggagtgcagtggcgtgatcacagctcactgcagtcttgacctccccaggctcaggtaatcctctcaccttagcctcccaaatagttggaagtacaggcacacgccaccacgcctggctagtttttttttttttttttttttgtagagacgggattttgccatgttgcccaggtgggtctcgaacatctgggctcaggcagtcctcccacctcggcctcccaaagtgttaggattacaggtgtgagccactgtgcccggccttcaacagttgttttgacatacacaattttcactttgtacacaactttagaatctaattttcagctaagatgtgattccattttatgttccagatattaacaccagttgcttctggatggtggaaatgtgtgttacttttcacttctggtgcctttaagcttttctgtattaaaaaaaaat

SEQ ID NO: 63611 - DNA, 601 bp, Human
cctcccacctcggcctcccaaagtgttaggattacaggtgtgagccactgtgcccggccttcaacagttgttttgacatacacaattttcactttgtacacaactttagaatctaattttcagctaagatgtgattccattttatgttccagatattaacaccagttgcttctggatggtggaaatgtgtgttacttttcacttctggtgcctttaagcttttctgtattaaaaaaaaatgtgtttctaaagaatgtcatatggtatttaccagggggtgggggtgggatatagggttttsttgtttatgatgggtacagagtttcagttttgcaagatgaagagttctagagatggatggtggtgatggttggaacagtgtgaatgtacttaatattgctgaaccatacattaaaaatggctaagatgggccgggcacagtgcctcatgcctagaatcccagcactttgggaggccgaggcgggcggatcacttgagcttaggagttcgagaccagcctgggcaacaggatgaaaccccatctctactaaaaatacaaaaattagctgggtgtggtggtgggcgcctgtattcccagcta

SEQ ID NO: 63612 - DNA, 601 bp, Human
tgggatatagggttttgttgtttatgatgggtacagagtttcagttttgcaagatgaagagttctagagatggatggtggtgatggttggaacagtgtgaatgtacttaatattgctgaaccatacattaaaaatggctaagatgggccgggcacagtgcctcatgcctagaatcccagcactttgggaggccgaggcgggcggatcacttgagcttaggagttcgagaccagcctgggcaacaggatgaaaccccatctctactaaaaatacaaaaattagctgggtgtggtggtgggcrcctgtattcccagctactcgagaggctgaggcaggagaatcgctggaacctgggaggctgaggttgcagggagccgtgattgtgccactgcactccagcccgggcaacagagtgaggctctgtctcaaaaacaaaacaaaacaaaaaagcagtggctaagatgggacattttatgtgatgtttattttgccataatttaaaaattttcagtttttgaatgttcataatcagaaaaaataaagggagggagttttcataatcttcccttcaaccatcatcagtttgtaggatatctggaaa

SEQ ID NO: 63613 - DNA, 601 bp, Human
gatggtggtgatggttggaacagtgtgaatgtacttaatattgctgaaccatacattaaaaatggctaagatgggccgggcacagtgcctcatgcctagaatcccagcactttgggaggccgaggcgggcggatcacttgagcttaggagttcgagaccagcctgggcaacaggatgaaaccccatctctactaaaaatacaaaaattagctgggtgtggtggtgggcgcctgtattcccagctactcgagaggctgaggcaggagaatcgctggaacctgggaggctgaggttgcagggmgccgtgattgtgccactgcactccagcccgggcaacagagtgaggctctgtctcaaaaacaaaacaaaacaaaaaagcagtggctaagatgggacattttatgtgatgtttattttgccataatttaaaaattttcagtttttgaatgttcataatcagaaaaaataaagggagggagttttcataatcttcccttcaaccatcatcagtttgtaggatatctggaaaaatggaaacagaacacggagcttccagtttatgtagtacaatcagattgccagatactggacacaagttaga

SEQ ID NO: 63614 - DNA, 601 bp, Human
gtggtgatggttggaacagtgtgaatgtacttaatattgctgaaccatacattaaaaatggctaagatgggccgggcacagtgcctcatgcctagaatcccagcactttgggaggccgaggcgggcggatcacttgagcttaggagttcgagaccagcctgggcaacaggatgaaaccccatctctactaaaaatacaaaaattagctgggtgtggtggtgggcgcctgtattcccagctactcgagaggctgaggcaggagaatcgctggaacctgggaggctgaggttgcagggagccrtgattgtgccactgcactccagcccgggcaacagagtgaggctctgtctcaaaaacaaaacaaaacaaaaaagcagtggctaagatgggacattttatgtgatgtttattttgccataatttaaaaattttcagtttttgaatgttcataatcagaaaaaataaagggagggagttttcataatcttcccttcaaccatcatcagtttgtaggatatctggaaaaatggaaacagaacacggagcttccagtttatgtagtacaatcagattgccagatactggacacaagttagagatt

SEQ ID NO: 63615 - DNA, 601 bp, Human
tttaaaaattttcagtttttgaatgttcataatcagaaaaaataaagggagggagttttcataatcttcccttcaaccatcatcagtttgtaggatatctggaaaaatggaaacagaacacggagcttccagtttatgtagtacaatcagattgccagatactggacacaagttagagattttactcagctctttcctcagattgagaatttcctgaaattaaagggctgacagatctaacttgttaaactgcttactagattacatggcaaaagtggtatcttgtttactgacctatctycctgacgtctgacatagtaaggtctcaataattacatgttgatgaataaataaattaacaggatatgccagtactccaaaagattgtgctggagtaatcatacccttaccttaaacttatacaaataaggaggataaatctataaagcacaagaaaaatgcaggaggatgtctccatgagcttggattaggcaaagatttcttaattaggtcacaaagcctactaaccatagaacaaaaaggatgctacatcaaaatcaagcacttctattcatgaaaactgaaagaaggcaaagggaca

SEQ ID NO: 63616 - DNA, 601 bp, Human
taaacttatacaaataaggaggataaatctataaagcacaagaaaaatgcaggaggatgtctccatgagcttggattaggcaaagatttcttaattaggtcacaaagcctactaaccatagaacaaaaaggatgctacatcaaaatcaagcacttctattcatgaaaactgaaagaaggcaaagggacaagccatagagaagatattcataatacagtcatgtgtcactggatgacagagatacgttcttttttatttttattttgagacggagtcttgctgtcacccaggctggagtgcrgtggcgcaatctcagctcactgcaagctctgcctcctgggttcacaccattctcctgtcttagcctcccgagtagctgggactataggcgcccccccaccacgcccagctaattttttgtatttttagtacagatggggtttcactgtgttagccaggatggtctcgatctcctgacctcgtgatccgctctcctcagcctcccagagtgctgggattacaggcgtgagctaccgcgcctggccagagatatgttctaagaaacgtgtcattagacaatttcattgtacaaatgttatag

SEQ ID NO: 63617 - DNA, 601 bp, Human
gagatacgttcttttttatttttattttgagacggagtcttgctgtcacccaggctggagtgcagtggcgcaatctcagctcactgcaagctctgcctcctgggttcacaccattctcctgtcttagcctcccgagtagctgggactataggcgcccccccaccacgcccagctaattttttgtatttttagtacagatggggtttcactgtgttagccaggatggtctcgatctcctgacctcgtgatccgctctcctcagcctcccagagtgctgggattacaggcgtgagctaccgckcctggccagagatatgttctaagaaacgtgtcattagacaatttcattgtacaaatgttatagactgtacctacacagacctggagggtataacctactgcatacttaggctatcaggtatagcctattgctcccagactacaaagctatacagcatgttactgaaaaggatactgtaggcaattgtaacacaatggtacatatttgtgtttctgagcacagaaaaaaggtaatgaattgtgctacaacattatgatggctgtgacagcactaaacaatgggaatttttcagctttacta

SEQ ID NO: 63618 - DNA, 601 bp, Human
gtataacctactgcatacttaggctatcaggtatagcctattgctcccagactacaaagctatacagcatgttactgaaaaggatactgtaggcaattgtaacacaatggtacatatttgtgtttctgagcacagaaaaaaggtaatgaattgtgctacaacattatgatggctgtgacagcactaaacaatgggaatttttcagctttactataatcttatgggactaccatcgcatgtgcagtccatcgttaactgaaatatcatgtggcgcgtaactatatattttattcatctgacrgaggtcttgtatctaatatatagagaactcctacaaatcagtaagaaaaagccacataacctaatttttaaagtgtacaggctttttgaaagtatacaggctgggcgcagtagctcacacctgtaatctcagcactttgggaggccaaagcggaggattgtttgagaccagactgggcagcatagtaagatcccgtctctcttaaaaaagggtgtacaaaagactcaaatatttactttattaaggagcatttccagagcgttaataatcatataaaaagatgcctaatatccttcctca

SEQ ID NO: 63619 - DNA, 601 bp, Human
gcactaaacaatgggaatttttcagctttactataatcttatgggactaccatcgcatgtgcagtccatcgttaactgaaatatcatgtggcgcgtaactatatattttattcatctgacggaggtcttgtatctaatatatagagaactcctacaaatcagtaagaaaaagccacataacctaatttttaaagtgtacaggctttttgaaagtatacaggctgggcgcagtagctcacacctgtaatctcagcactttgggaggccaaagcggaggattgtttgagaccagactgggcarcatagtaagatcccgtctctcttaaaaaagggtgtacaaaagactcaaatatttactttattaaggagcatttccagagcgttaataatcatataaaaagatgcctaatatccttcctcatcagggtaatgtagcttaaaccacagcaagtcaccattatacacacccattagaatggcgaaaatttaaaaggctgagaatagcaaatgttgtcaagaatgtggagcagcagtaaccctcatgcattgatgatgagtgtagctgcctttaaaaagctggcactttctactcaagttaagt

SEQ ID NO: 63620 - DNA, 601 bp, Human
gcgcgtaactatatattttattcatctgacggaggtcttgtatctaatatatagagaactcctacaaatcagtaagaaaaagccacataacctaatttttaaagtgtacaggctttttgaaagtatacaggctgggcgcagtagctcacacctgtaatctcagcactttgggaggccaaagcggaggattgtttgagaccagactgggcagcatagtaagatcccgtctctcttaaaaaagggtgtacaaaagactcaaatatttactttattaaggagcatttccagagcgttaataatmatataaaaagatgcctaatatccttcctcatcagggtaatgtagcttaaaccacagcaagtcaccattatacacacccattagaatggcgaaaatttaaaaggctgagaatagcaaatgttgtcaagaatgtggagcagcagtaaccctcatgcattgatgatgagtgtagctgcctttaaaaagctggcactttctactcaagttaagtacatgcttgttttatgacctagcaattccattattagacataaacccaagagaaatgggtggatctatccataaaaagacatgtagaaga

SEQ ID NO: 63621 - DNA, 601 bp, Human
agcttaaaccacagcaagtcaccattatacacacccattagaatggcgaaaatttaaaaggctgagaatagcaaatgttgtcaagaatgtggagcagcagtaaccctcatgcattgatgatgagtgtagctgcctttaaaaagctggcactttctactcaagttaagtacatgcttgttttatgacctagcaattccattattagacataaacccaagagaaatgggtggatctatccataaaaagacatgtagaagaatgtatataacagctttatttaaaacagccaaggctgggtgcrgtagctcacgcctgtaatcccagcactttgggaggctgaggtgggcagatcacttgagatcaggagttcaagaccagcctggttaacatggtgaaaccccatctctactaaaagtacaaaaattaactgggtgttgtggtgcatacctgtaattccctgctactccggaggctgaggcaggataatcgcttgaacctgggaggtggaggttgcagtgagctgacatcgtgccactgcactccagcctgggtgacagagtgagattccaactctaaataaataaataaatgagccaaaacc

SEQ ID NO: 63622 - DNA, 601 bp, Human
gccaaggctgggtgcggtagctcacgcctgtaatcccagcactttgggaggctgaggtgggcagatcacttgagatcaggagttcaagaccagcctggttaacatggtgaaaccccatctctactaaaagtacaaaaattaactgggtgttgtggtgcatacctgtaattccctgctactccggaggctgaggcaggataatcgcttgaacctgggaggtggaggttgcagtgagctgacatcgtgccactgcactccagcctgggtgacagagtgagattccaactctaaataaataaayaaatgagccaaaacctggggggaagtgtcccatcaacagaaaagtgggtggtttatgaaacacatacaaaaggaaatattacataagaagaaaaaagaatgaattactggtcaatgggtctgcatgaatgagtcttaaagaattctgtcaaagaagccagatataaaagaatacatatatttttatgaagttcaaggacaggcaaaacaaatgctgatgatcagagttgtagtggcccctctggaggagagtgaagatgccttatggagtactgggagatgttctggatctccgagtggt

SEQ ID NO: 63623 - DNA, 601 bp, Human
ggaaagttgaaaataagggatgggctggatacagtgagcaaatgctaatcaaaagaaacagaattggccgggtgtggtggctcacactagtgatcccagagcttagggggctgaggcaggaggatggcttgaggccaggagttcgagaccagcctgggcaacatggtgagacccccatctgaaaaaaattcgtaaaagataaaccaggtatggtggtgtgcacttgtagtcccagctgttcaggaggctgatgcgggagggtagcttgagctgcactcctagacaacagagcaagaacccrtctcttaaataaaaaaaaaaaaggaagaaaagaaaaaaaggaaacagaattgacaatattaatattaggcagattagaaattcaagtttaaaatattaaaaagaatgcattgtcaatttataccattgcaaagttcaatgtacctagaagatgcaataatcatgcaactttatgcactgaaaaacgttctatcaaagtatataaagcgaaagctattagaaatatagaagaatttaaaaacgcatagttgaagatactaacacactttagaagttcataaatcacaggcaaaaagtaaat

SEQ ID NO: 63624 - DNA, 601 bp, Human
ggctggatacagtgagcaaatgctaatcaaaagaaacagaattggccgggtgtggtggctcacactagtgatcccagagcttagggggctgaggcaggaggatggcttgaggccaggagttcgagaccagcctgggcaacatggtgagacccccatctgaaaaaaattcgtaaaagataaaccaggtatggtggtgtgcacttgtagtcccagctgttcaggaggctgatgcgggagggtagcttgagctgcactcctagacaacagagcaagaacccgtctcttaaataaaaaaaaaaaaggaagaaaagaaaaaaaggaaacagaattgacaatattaatattaggcagattagaaattcaagtttaaaatattaaaaagaatgcattgtcaatttataccattgcaaagttcaatgtacctagaagatgcaataatcatgcaactttatgcactgaaaaacgttctatcaaagtatataaagcgaaagctattagaaatatagaagaatttaaaaacgcatagttgaagatactaacacactttagaagttcataaatcacaggcaaaaagtaaatgagaatatgaaatagataacag

SEQ ID NO: 63625 - DNA, 601 bp, Human
aggaggctgatgcgggagggtagcttgagctgcactcctagacaacagagcaagaacccgtctcttaaataaaaaaaaaaaaggaagaaaagaaaaaaaggaaacagaattgacaatattaatattaggcagattagaaattcaagtttaaaatattaaaaagaatgcattgtcaatttataccattgcaaagttcaatgtacctagaagatgcaataatcatgcaactttatgcactgaaaaacgttctatcaaagtatataaagcgaaagctattagaaatatagaagaatttaaaaaygcatagttgaagatactaacacactttagaagttcataaatcacaggcaaaaagtaaatgagaatatgaaatagataacagtaaacttgttatatataaataaatggcattttgtacacataaaatggaatatttaatttttcaacacccatggtacatttataaaaagttgttaattggccacaaagaaaaattccgataaagcccaaaaggcagaaatcacatagcccctgcttctctgaccatatggcaataaagctaaaatttacaataagaagccctgaaaaaaaatttggccac

SEQ ID NO: 63626 - DNA, 601 bp, Human
tttacttattgatttttaaataccctttatatattaagaatattagttcttggccatgtttgcaaacattttccccaccgttccttgccttttatattttttaatatataaaagtgattattttcacataatcagatctaccaatcttctgatatttcctctattatttttatggtaagagattccatccccataattattaaatagtaataattacagtaacagctaacatgtattgagggctgattatgtgtcaggcaataagctaagtcccttatttaatcacaaaaaccctacgagrtatgtattttttattatcttcttacaattgagaaagaaactaaggaaagagatgaaatagtttgtccataaacactgaaccagtgatttaaatattcatccacatttcgttttagtttttatggtttacgtttttatatttaactctttaatcctgaaatttgtgaaatggtgtgaagcgaagctcctttcaaacattagtttttccctgaccttcaaatgaataaatcatttttctccccagttgtttagtatgcttcctctattataaattaaattttaatacataacaaggtctctt

SEQ ID NO: 63627 - DNA, 601 bp, Human
taaataccctttatatattaagaatattagttcttggccatgtttgcaaacattttccccaccgttccttgccttttatattttttaatatataaaagtgattattttcacataatcagatctaccaatcttctgatatttcctctattatttttatggtaagagattccatccccataattattaaatagtaataattacagtaacagctaacatgtattgagggctgattatgtgtcaggcaataagctaagtcccttatttaatcacaaaaaccctacgagatatgtattttttattrtcttcttacaattgagaaagaaactaaggaaagagatgaaatagtttgtccataaacactgaaccagtgatttaaatattcatccacatttcgttttagtttttatggtttacgtttttatatttaactctttaatcctgaaatttgtgaaatggtgtgaagcgaagctcctttcaaacattagtttttccctgaccttcaaatgaataaatcatttttctccccagttgtttagtatgcttcctctattataaattaaattttaatacataacaaggtctctttcagggatatctattc

SEQ ID NO: 63628 - DNA, 601 bp, Human
ataatttataagtttataataatttatattttatttaatttataatttataaatttataataatttataaaataaaaataaaataatttgaaaggctttttcgtttgtctccctttatttctctttgcaacatttctttatactgatctaacattttgtaagactatagtaattttatatttctcatggctattatgaaaggaatttctcttcattttattttttaattattgctggtacataggagtgctactgatttttaattttatgtactatatcttgccatcccactttctcatgtttaaattttataggtatatggtcaattgattattttgtaaacttgtctctagttcatagacattttaattttatttcctgctttattacataggatgaaactccaagaataatgttaaatgttaatgatgacagtgataatgagttttatgataaacagctttttttttttaagaggggaaaaaagggattatcatgaagtactacaaatatatcttacagctattgaaaatctgcaattcatgaagcaccagtgtgctttattcacatttattcacacattgaacaattatttggtgaa

SEQ ID NO: 63629 - DNA, 601 bp, Human
tacaaagccatctatgtttgacaaccagaggagtattgtctagatagtaattgctgtagaaaagtacttctacctagggtgatcacagaggagctttggtgatggaagagataacccggaacaactgacaagctcagagtagggttgggaagaagctactctgatggctggaacatcaggggtggaagactgatgcctgactctctccagagtataaggcatatcaggggctgatgaataaactagtttgctttatttagtacagggtgaatatatggtaacaggcattttgttttgtttkgtttggtttggttttgagatggagtctcactctgtagcccaggctggagtgcaatggcacgatctcagctcactgtgacctccgcctcccggattcaatcaattctgccaccccagcctcctgagtagctgggattacaggcgcctgccaccacacctggctaatttctatatttttattagggacgggggtttcaccatgttggccaggctggtcttgaactccttgacctcaagtgatctgtccctcctcggcctcccaaagtgctgggattacagccatgagccaccatacctggcc

SEQ ID NO: 63630 - DNA, 601 bp, Human
tctgccaccccagcctcctgagtagctgggattacaggcgcctgccaccacacctggctaatttctatatttttattagggacgggggtttcaccatgttggccaggctggtcttgaactccttgacctcaagtgatctgtccctcctcggcctcccaaagtgctgggattacagccatgagccaccatacctggcctggtaacggtttttatacttacctctggggattcttggagattctgaggagatatttcaggggcaaagagggaatcaagaaggtgggactctgatttttctccrtacccctccggacctctcaaaacctgaacattacttttgtctgttttacatattggggtttccgtttatttattctttctacactttttttttttttgagatagagtcttgttttgtcacccaggctggagtgcagtggtgcagtcatggctcactgcagccttgacctcctgggctcaagcagtcctcctgcttcagcctccctagtagctgagactacaaatatacaccattgcacccagctttttttttttttttttttaaaaaggtgaggttgcactatgttgtccaggctggtct

SEQ ID NO: 63631 - DNA, 601 bp, Human
aatatacaccattgcacccagctttttttttttttttttttaaaaaggtgaggttgcactatgttgtccaggctggtcttgaactcctgtactcaagtgatcctcctgcctcagcctcccaaagtgctgagattacaggtattagctaccacgcctggctttttacacatttttattgaatacctactaggtgccagtagaacctaggtgttttaggtactaggaacatagcagtgaataaaataaccccaaatgtaatggtagagtgggagggagaagacagtaaatagaataaaatatwaacataagtcgagtaagagcaatagaggattcttcttaggaatttgctattttaaatgggatggtttggaaaggcccctctaagataacattttgagcaaaaacttgaagaaaacgaggaagcaaaccatgcagatttctgggtagaaagagtttcaggaaaagggaatgaccgatgcagaagcttgaagaggaagttgtgtctggcaaattccaggaacaagaatggtaggccaggtggatagcagtgagacacgaggtcacagcattcacagggagtaaggttgtgtagggcaacagt

SEQ ID NO: 63632 - DNA, 601 bp, Human
tggaaaatcatcagagtgttttaagcaaggagttataccatctgatgtaaggtttaataggatcaccagggtggaagctgggagactagtctagtgttgagatgtgatcagattccctggatatttttttggaagtaaatccaatagaatagcctgatttgtgggatctggatatgaaagagaagtagaaattaaggatgactccaaggtttttggccttgtgtgactacaagtttggagttgtcattaactaggaatggagcagtttggtggggcaagattaggagttcagtgttagacrtattaagtttgagatatcagacatccaagtggaggtatcaggtgggcagagggatattatgaatcaagttcagaggaaagatctgagctacagatataaatgtaacattgttaacttcttgattttgataattattctgtggttatatacaagcatgagcttccccgactcccaccccaaattaagacatgcttactgaaatatttaaggggtagggtgtgatgtctgtaacttagtctcaaacagttcagggaaagtaatcatatagacagatcaatagagaataataaagcgagtgtg

SEQ ID NO: 63633 - DNA, 601 bp, Human
tttgcagtagagaaatccatcagaaaccaccttgactacaaggtaatagagagaaaaactgaattaaaaagaagacaggagagaaaagagagcactaaacaggtcaaaaggaaaacaaattgtaatatgaaagatataaacccccaaagttcagcatttacattaaatataaatggagtaaatactccattaaaagcagttggtcaagattagatttaaaagactcaatgctgcttgcatcagacacacctttagtataaagatatttaaggattaaatgtcaagtgatggaaaaagatayaccatgcaaacactaaccacaagaaactcggtagtaataccagacaaggtggtcttaaaagtagaatcagaaggccaggcgtggtggctcacacctataatcccagcacttcgggaggccgaggtgagcagatcacctgaggtcaggagttcaagaccagcctggccaacatggcgaaaccctgtctctatgcagtggcgcatgcctgtaatcccagctactccggagtctgaggcaggagaattgcttgaatctgggagacaaagattgcggtgagtggagatcacgccactgcactct

SEQ ID NO: 63634 - DNA, 601 bp, Human
ttggtcaagattagatttaaaagactcaatgctgcttgcatcagacacacctttagtataaagatatttaaggattaaatgtcaagtgatggaaaaagatataccatgcaaacactaaccacaagaaactcggtagtaataccagacaaggtggtcttaaaagtagaatcagaaggccaggcgtggtggctcacacctataatcccagcacttcgggaggccgaggtgagcagatcacctgaggtcaggagttcaagaccagcctggccaacatggcgaaaccctgtctctatgcagtggygcatgcctgtaatcccagctactccggagtctgaggcaggagaattgcttgaatctgggagacaaagattgcggtgagtggagatcacgccactgcactctagcctgggcgacagagcgagactccgtctcaaaacaaataaaaaaaagtgagtcagagatagaaaaatttcagaataataaaatggtcaatcaccaacaagatgaacatttcaaaatagttacacacctaacaaacatagcttcaatatacgtaaagcaaaactggacagacctgaaaggaggactagacaaatctatc

SEQ ID NO: 63635 - DNA, 601 bp, Human
ctgcacacatctgagtctattcctagggatatagtttacacatgtacaagtggtatattcaaggtcctttattatggctttgtttgtagcagtaaaggttcagtaggggatgttaaataaattatagtacatccataccaaccatatagccattaaatagaatgagagagctctgtagatactaatatggagtatcctccaagataacctaattaaaaatagcaaggtatagaacagcatgtatagcgtgctatcattgtataaaaatatacggacacacatatgtatacacacatgtgctttttttttttttttttttttttaaaaaaaaaaagagatggagtcttggccaggcacagtggctcatgcctgcaatcctagcactttgggaggccgagcgagtagatcacgaggtcaggagttcaagaccagcctggccaagatagtgaaaccccatctctactaaaaatacgaaaaaattagctgggcgtggtggtgcctgtaatcccagctactcgggaggctgaggtagagaattgcttgaacccaggaggctaaggttgcagtgagccgagattgcaccacagcgctccagcctggg

SEQ ID NO: 63636 - DNA, 601 bp, Human
ctagggatatagtttacacatgtacaagtggtatattcaaggtcctttattatggctttgtttgtagcagtaaaggttcagtaggggatgttaaataaattatagtacatccataccaaccatatagccattaaatagaatgagagagctctgtagatactaatatggagtatcctccaagataacctaattaaaaatagcaaggtatagaacagcatgtatagcgtgctatcattgtataaaaatatacggacacacatatgtatacacacatgtgcttttttttttttttttttttttwaaaaaaaaaaagagatggagtcttggccaggcacagtggctcatgcctgcaatcctagcactttgggaggccgagcgagtagatcacgaggtcaggagttcaagaccagcctggccaagatagtgaaaccccatctctactaaaaatacgaaaaaattagctgggcgtggtggtgcctgtaatcccagctactcgggaggctgaggtagagaattgcttgaacccaggaggctaaggttgcagtgagccgagattgcaccacagcgctccagcctgggtgacagagcgagactccgtctc

SEQ ID NO: 63637 - DNA, 601 bp, Human
tagggatatagtttacacatgtacaagtggtatattcaaggtcctttattatggctttgtttgtagcagtaaaggttcagtaggggatgttaaataaattatagtacatccataccaaccatatagccattaaatagaatgagagagctctgtagatactaatatggagtatcctccaagataacctaattaaaaatagcaaggtatagaacagcatgtatagcgtgctatcattgtataaaaatatacggacacacatatgtatacacacatgtgctttttttttttttttttttttttaaaaaaaaaaagagatggagtcttggccaggcacagtggctcatgcctgcaatcctagcactttgggaggccgagcgagtagatcacgaggtcaggagttcaagaccagcctggccaagatagtgaaaccccatctctactaaaaatacgaaaaaattagctgggcgtggtggtgcctgtaatcccagctactcgggaggctgaggtagagaattgcttgaacccaggaggctaaggttgcagtgagccgagattgcaccacagcgctccagcctgggtgacagagcgagactccgtctca

SEQ ID NO: 63638 - DNA, 601 bp, Human
atgggatttggaatattccacccccgccccatgctgtatagagagtagtgctgaggagcctgggcctggggtccgagcctggccctccaccctgcagcagtgagatctcagataggccggttcatgtctgtgagcctcaggctcttcccctgtaaatggggagaatcaagtgtctacttctggcactgctcggaggtgccacaaaaccgtgagcctgcaaacagaaccgtgagcctgcaaacaaaaccgtgagcctgcaaaccgtgagtcgtgcccctcggcaggcctgcacagggttagygtggagctcaaagagttaaagatgtaaagaactaaaacgctctgctacacgtgggtttaatacacttggctgttattttgagtgaggggtggaaatatgaatgatttcttttttgttttttgtgtgcttttctttattttccatgttttctgcagttgacattttgttatcaatatataatctatattattctatatactatacctattatacattacagatagagaaacagacaaaactcattcaacgtaagaaactggggggtaggggtcctagggaggctcccatttaacaggtagg

SEQ ID NO: 63639 - DNA, 601 bp, Human
ctagcagtaaataagcactcaaatatttatggatttggttgagtgctacatatttatctcaatactaataatgttgacagtagcaaccaataccagattcatttgagctacacagctaggtggtgacaaagtaatttatgtattgacctattaggacatagcatgttttcatgtgttaatatcagattaatgtgaggacttgcaagaacatctgatgcctgcatggcagcttaaatctttaggaagtaagctgaatgccaaataatagaccttctgatcacatatttaagattcaagatgyagaagaaaaccccaaaggaacatttatagcattcagctgggtgactaaagagtgtgccctagtgcaccaaactcttgtgacaagattttcttaaaggaacaaaaaatctccaccttgatttgtgtcttatagtggagttgtttcccaaatcaggctgtttcaaagaacatatgagacggcgtatggctagccctcccatcccaaagcaaatgtttgttttgttgcaatgatggaaacatttccattggtgaagcaaatatttagagctgaaagaaacatttgggcagccaggatgtgtca

SEQ ID NO: 63640 - DNA, 601 bp, Human
tccttttgactagagctagtgggtggagagagtaactgaacgggaatttcttagtgttattctctatcaataatatattttaattgtcagtgctatagactgggtggctgggggttgggagctggtggctcttgaaaatcaccaagtggcagaaaggaagttataggaagaacataaaggcttagtgccagtggtgtcaggtaatgcatattgatacctcaactaaaagaacatttggggctttattaaaattgactaattcttccaaagatagcagctaaaggaggacttagatgaataraggagggaggaggcttgcaggacggtgaagccctttgcttccagctctctgcctgctcagccattgctccgtccctctgcagttagattattccttgcagatagcaatcaactggaaggaagtgtctgtgtctaatttgcatgagattatttaaaacaacaacaaaaaaaaggtctgcattagtcagggtgatggtaaacaacgcaaagagagatgccttttataatatagcctgtgcctcagctttcagagccaaatataattcacttacaattggcagtttcctttattattcctttt

SEQ ID NO: 63641 - DNA, 601 bp, Human
atctaagatcagcagtttgtcttggcagtagtgggaaagatggggctagggcaccgggatgtcctatgttggctccatggcagcactttgaccctgaaggcagggtcatcacagcaccaagagccaatgactgggcagataactagttgtgatctggagacaggtgggtgttcccactcagtctccctaagttccaaatgaatcacctgagtcctgtaaatgcagtcttaaagctggccagttctgcctaaggtggggacattccagaggaagatgacactcaaggaagcctatgacaggyatttggacttgatttcgggttagaatattagaacgagaacaagatgaggacattctacctttttctctctagtattgttcaaaaagttgtccaggcgtcatttacagataggagccaggggttaagttcctgtattgtttcaatgtagccccaaaacaatattcactggctccttcctgtagatgagagtggcggggtagggagaagaaaatgtagtccttctcccaagctctttaacaagtctgaagacctaggacatagtttgagtctgccatttgatgttttgtaactctggtgtag

SEQ ID NO: 63642 - DNA, 601 bp, Human
ttgtcttggcagtagtgggaaagatggggctagggcaccgggatgtcctatgttggctccatggcagcactttgaccctgaaggcagggtcatcacagcaccaagagccaatgactgggcagataactagttgtgatctggagacaggtgggtgttcccactcagtctccctaagttccaaatgaatcacctgagtcctgtaaatgcagtcttaaagctggccagttctgcctaaggtggggacattccagaggaagatgacactcaaggaagcctatgacaggcatttggacttgatttmgggttagaatattagaacgagaacaagatgaggacattctacctttttctctctagtattgttcaaaaagttgtccaggcgtcatttacagataggagccaggggttaagttcctgtattgtttcaatgtagccccaaaacaatattcactggctccttcctgtagatgagagtggcggggtagggagaagaaaatgtagtccttctcccaagctctttaacaagtctgaagacctaggacatagtttgagtctgccatttgatgttttgtaactctggtgtagtggagagtcactgggc

SEQ ID NO: 63643 - DNA, 601 bp, Human
cattttcctttgactagctgtggtagggcatgaaaagtttgaggggtggctgcagtcaactcatatgccagtatggtgcagggcggagctgtgctttaaagcattaatgtgcaccatctattagcccctaggcatggagtatgaggcaccatccttttgaagatgctgatcctcagaacctccttgtacttcatctacccccaggggcaaatataccatgctgtgggcctctaatggagagctgccgaccagatgtggaaaagctctcggctgtagtttaaaagctctgtgttgcggctcrcttggatgttgggattcccggaacagcaagggctggccgagtggtcttttgcagactaacagtgacctcccacctgcttttcccactctcagcagctggagtgcctttgtacacacagctacttcctgagctggccccgtgtgaccgctcctttcatacttgagcgccacatttcattctgttctttgggttggatggggctctcttcctcctcccaagagtcagtgtcccaaattggctcagacccggtggaaatatcccagctgtgtccccactggaaatgcggccttcatgggtttt

SEQ ID NO: 63644 - DNA, 601 bp, Human
gtggtagggcatgaaaagtttgaggggtggctgcagtcaactcatatgccagtatggtgcagggcggagctgtgctttaaagcattaatgtgcaccatctattagcccctaggcatggagtatgaggcaccatccttttgaagatgctgatcctcagaacctccttgtacttcatctacccccaggggcaaatataccatgctgtgggcctctaatggagagctgccgaccagatgtggaaaagctctcggctgtagtttaaaagctctgtgttgcggctcgcttggatgttgggattccyggaacagcaagggctggccgagtggtcttttgcagactaacagtgacctcccacctgcttttcccactctcagcagctggagtgcctttgtacacacagctacttcctgagctggccccgtgtgaccgctcctttcatacttgagcgccacatttcattctgttctttgggttggatggggctctcttcctcctcccaagagtcagtgtcccaaattggctcagacccggtggaaatatcccagctgtgtccccactggaaatgcggccttcatgggttttcatttgccttttattcttc

SEQ ID NO: 63645 - DNA, 601 bp, Human
ctttgctcagtgaagattctgttgcagctatggacactgacaaaaggtactcacctgcaatgatgtcctcttctccccagggctgacagatgaagagattgatatggccttccagcagtcgggcactgctgccgatgagccttcgtccttgggcccagccacacaggtggttcctgtccagccccctcacctcatatctcagccatacagtaagtcacccgctcaaactcctgcttaaccttgattgggattcaggactctggccaaagggcagtgttctgtatctcccagacttagcaawccaggagaaactgggagcagcagaaagctcttgggtttttcccaaggaatgtgacacaccccagtcttctagacaaactttttaaagtatgtgacaaaggtttaagaagagacaagggatcagaataaatgattttattgttgtttcaggtattttggttacatgcagaaaacctgtacaactatttattgattctgttcccatctcctcataccagtgcttttgaatgttactgtttcactaaaaacagcgtgaccatctgactcatgggtgcattcttgtttgctcactgcaataacc

SEQ ID NO: 63646 - DNA, 601 bp, Human
ctgttcccatctcctcataccagtgcttttgaatgttactgtttcactaaaaacagcgtgaccatctgactcatgggtgcattcttgtttgctcactgcaataacctgtctcccacttctatttttttaagttaatatttgtaagtttaggtcagcctccatttccctccctcccttgtcctggctatactttgtacgtttatgtagtagcggtctgttagggaatttcaggttaaaacatgaagttcctttttgaatgtttcttttaattatacgagatcatgacccatgaggggtcttycgttgtcttaaatgaaagctactataggaataaagtttcttcaaacaagttataaatgcatacctccaaaatgcagccagaagccctccttgaaatcacttataaaaagtttaaaaaggctaaaattgactacaaagttatggaaaatagctccattttgtttctttaatgaaactcagcattgggccgggcacgttggctcacgcctctaatccctgcactttgggaggctgaggcgggtggatcacctgaggtcaggagttcgagaccagcccggccaacatgatgaaaccctgtctc

SEQ ID NO: 63647 - DNA, 601 bp, Human
taaccatctactatacggtcagtactatatcatgcgagagatccaaaacctgatctttaagcatcttgctaagctctttgggaaagataagataaactcttaagaaaaggataataatataagatgttgtgatttaatgccaaaattaattatacagacaagaaattctgaaattctgaaatatagaaaagagaagaattaatgtgggctagagtcagggaaggcttttgtgaaagtgataggaggttggcaccaaggggaagcttggtgtcacctggtgtgagcataaaccagtgctctygggggctagaagaaagttggtacagttcaggagaagtcaggctgtgattcgagagaagatttgaaattctccatttctcattttggtttcttgtctggctttacatcgggagtcagtgcatgtgtataggtgcaggcctagcccagtcctgagcagaggtctgataaatgctggttgattgattcacgccaagctgatttgtcttcgtcctcccagagagaccaagaagctttgagatataagcaggaccagtgtaaattttgtaggataataatttcttcttagatttgaacattttcc

SEQ ID NO: 63648 - DNA, 601 bp, Human
cccacctgctgtccagccagcgagagcggggagaaagcgggaaaagggcaggctgccttctaaggacacctcttggaaattgcccatgtcccttccactttctccccattggctggatcttgcatggctatccttgcctgcgagtgaggctgagatgtagtcctgatctcggcagcacatgtcctcagctttccatatcccataggaggtttgagttctgataaatactgggtttaggataatggttgcctctgggctggggaggaacacatggctagcttcagtggtatttggaaagttytagctagtaaattaggcaggtttagaattgctcattgtattcctgttcttataacttaaataaatgttatattcttttgtatgtgtcagatattacagggtatgttttttaaagttgcattagaattctcaggtctggcttcttctcttggtcccagctgcaagctgtgcagagagaaaacttagagcctacaccactgggtagtgttcccaagcactcctgacttcctgtagctcttttttaaaaaaaattctgaatggattttttattttttaaaagtcttattgagatgtaatttac

SEQ ID NO: 63649 - DNA, 601 bp, Human
cccttccactttctccccattggctggatcttgcatggctatccttgcctgcgagtgaggctgagatgtagtcctgatctcggcagcacatgtcctcagctttccatatcccataggaggtttgagttctgataaatactgggtttaggataatggttgcctctgggctggggaggaacacatggctagcttcagtggtatttggaaagttctagctagtaaattaggcaggtttagaattgctcattgtattcctgttcttataacttaaataaatgttatattcttttgtatgtgtcaratattacagggtatgttttttaaagttgcattagaattctcaggtctggcttcttctcttggtcccagctgcaagctgtgcagagagaaaacttagagcctacaccactgggtagtgttcccaagcactcctgacttcctgtagctcttttttaaaaaaaattctgaatggattttttattttttaaaagtcttattgagatgtaatttacgtaaaataaaatacacccattttaattgtacaatttgagttttgataagtgtacatttccatataaccatcactacatgacagaacatt

SEQ ID NO: 63650 - DNA, 601 bp, Human
tatatgtaaatatatgtaatatatatttggaaaatacatataaaaggaatgaactgtttatgtctatatcatgattgtgattcatggtttttgcatcctaagaagcctttgtctaccccaaggttgaagagactttctcctatattgtcttctaggaagttttatagtgttagttttttggagacaccatctcactctgttgcccagagtatatttattatatatttatatatattatacacaaatatatataactttacatatatatatatatacacacacacacacacacacacacacttatatatatacacagagagagagagatatcattctttttcattactgagttgtattccagagatcagtgggctttctttttcgtttttcttttttttttgagatggagtttcactcttgttgcccaggctggagtgcaatggcgtgatcttggctcactgtaacctctgcctcccgggtgggttcaagtgattctcctgcctcagcctcccgagtagctgggattataggcatgcgctaccacgcctggataattttgtattttcagtagagacgaggtttctccatgttggtcaggctg

SEQ ID NO: 63651 - DNA, 601 bp, Human
acgatctgtttctgttgctgctctctgggcctgtctttctgcccactgccagccatccacagccatgtgcttcagggcccaccccgcccccaagctatagccagcccttctcagcccagccaggtccccgtctctctgcacttgtgctctccacctctgtgctgtagcaagcactgatttggtgggctggctttattccaggaccttactgggagtgagcctgtcttgtcatttaattttcagggtggcttctgagcgaagctgatgggctgatgtgagaagctagagacactgctgtatrgagacatggctccaaccctgatgagcctggaggcgacctcaatgggctggccccgtttctaccactgccttgcccatgcttgggctgccagcctccccaaggacgtgagagttctctccctcttgtcagccagcacatcactggagtgcctgttgtctcggcaggatggttccgtgacagctctcagctctgtgttgccgatgaacctttactggattgcaggatttccatggtgtggatcggtctgtgacttgctcaacaaggtttcaggctcaacattgccgtgttgtatgcacaagt

SEQ ID NO: 63652 - DNA, 601 bp, Human
tgctgtagcaagcactgatttggtgggctggctttattccaggaccttactgggagtgagcctgtcttgtcatttaattttcagggtggcttctgagcgaagctgatgggctgatgtgagaagctagagacactgctgtatagagacatggctccaaccctgatgagcctggaggcgacctcaatgggctggccccgtttctaccactgccttgcccatgcttgggctgccagcctccccaaggacgtgagagttctctccctcttgtcagccagcacatcactggagtgcctgttgtctyggcaggatggttccgtgacagctctcagctctgtgttgccgatgaacctttactggattgcaggatttccatggtgtggatcggtctgtgacttgctcaacaaggtttcaggctcaacattgccgtgttgtatgcacaagtcctagtcctgtgcatgtgttcttagttgatgatgtttgttctcacctgttaggtgagaatttggttggtggaggtataaagaaacagagtcatgttggttttgttggtgttcagtgaatagttaggagctgtggggatgcacctctcctgcccccgctc

SEQ ID NO: 63653 - DNA, 601 bp, Human
gtcccagttgaggcagtgggaacaggaggggtggagccggctgctgttgtgatgatcatgtgctgccttcctgcgttggagtgttccacttgcccattgttggaggcgaggagactgtgccactgaggcacctgtgccagcccccacccgaagaaggacgccatgtgcgtcttctaaccctcctcctcttcccgcctgtaggtcccgcaggctcccgatggcgagattacggcgccctggccatcatcatggcaggcattgcatttggctttcaccagctctacaaggtgagtcacccccwgcggctgcaggtgctgtgcccctgccaccctgtggcattcagcaccctttcactggttcccctgcatggaggcactgccgtgctctgccctggagtgtgttggcagtgagaggctgtggtagaggtcggggttcacagctggatccaggcagaccctgccctgctgcggggcttggcaggctctgcccaccttttctccagtgctcagcatataccacccagatctccacttgcaggggcgtcgtgaggtctgtcccttgccagcccatgtcaggcacttacagtagtgcccgcacgggg

SEQ ID NO: 63654 - DNA, 601 bp, Human
ctgaggcacctgtgccagcccccacccgaagaaggacgccatgtgcgtcttctaaccctcctcctcttcccgcctgtaggtcccgcaggctcccgatggcgagattacggcgccctggccatcatcatggcaggcattgcatttggctttcaccagctctacaaggtgagtcacccccagcggctgcaggtgctgtgcccctgccaccctgtggcattcagcaccctttcactggttcccctgcatggaggcactgccgtgctctgccctggagtgtgttggcagtgagaggctgtggtaraggtcggggttcacagctggatccaggcagaccctgccctgctgcggggcttggcaggctctgcccaccttttctccagtgctcagcatataccacccagatctccacttgcaggggcgtcgtgaggtctgtcccttgccagcccatgtcaggcacttacagtagtgcccgcacggggaagccgtgcgagcagttttgagacacagaataacataatggcgaagagcatggacgctgggccagctgctttgctgagccctggctctgcccctcaggagcttggtgatcacaggctctggt

SEQ ID NO: 63655 - DNA, 601 bp, Human
attatgtttttacggaaaggctcccaacctcagaatattaataaggggaataaaatgacagcctttctaagggctgtaaagttcatttttaatttctgcttctatgaggttttcaggggggttttcagtgattttcccccttccctctaagactcgactgtggggtcaagagagtctgtaattactgtggctcccgggaccccagccacctcccctgttatcgactcaacagggctcgcgttcattacccagtgccccagcgatggcccagattagctgggacctgtcgcgccagaggtgkcttctcttctttataaacttgtttactagacggcagctctgaatctaaaaaccagagcaaggccaatgagagagccacctgtcccaggcaggagtctgtgtccctctggagcacgtttgtgaagctcacagaaaccctctgacacgtccatcctgctgccgtttgctcctgcgaggctgacattggtggcaacaaggtcctgaggggtcacgggacaccagggagttgagcaggcagcttgggtcaggtggggagggtgggaaggagcagtgggaaacaggacgtgcggcttgagccact

SEQ ID NO: 63656 - DNA, 601 bp, Human
ctgctcttcctcctgggatggctgtgggtactggtgaccacctccagccactgcaatgcgtgttctccacgggtggccggtccctaaagcaccaggaagcccagcgacagccctgcctgctctcctgggtcaggtcatcttttggatccatgctctgcctgtggccagaagccattccggaaattggaaaactgttttcaggccttacgcctgagattaagaccacatgttgtgtttaagaagcagtgggggcccgggatgtgcttggtggtgagaggggttgggcccctcagagtccctygagctggctttgctgccgctgtccctggcccaccccagccttctctcccgagctgcatggggccactggcttggcatctaaacgcgtatgtgtgaggactttggttaccccataaaccaaagacccagagctgtgttttctcagctgtaatgtaagtttttatatctggcttccaaactcctactggagcactgtaaaaaattaaaaagaagagctttaagtaattaaaaaacctacataaaactgaaggctatgagttttctacaactgttttttaaagaggctggctaaaaagcccca

SEQ ID NO: 63657 - DNA, 601 bp, Human
agggaggaatggggaccctgttctggtcgggcctggaaaggaggactgggagctctggggcatgggaggggcatgacgcccacccccacccccaaggaccccatctgtctgggcgactcaggcactgagtctggggccttttgagcttctctcttcattccccagttgacaccctctccactccagaggtgacggtctgtggcacacaagttttgaaatacagttcccaggcctgtgaagacctggtcagggacagcttgagccaaaaagcagggcccttggagcagaggagaacttcctsgtttggctcctccttcctgagctccaggtgaccactcagtgacagctttgtcccagggaaagcccctgcgggagagtctttgtgttttgtacttggaagggttccacaactgaagacgtgggcagaagcaggccctgccccccggcttcttggttgtccccctgttgtccctctgtagcgacagcacattgtcaccaatgcagcctcagaggtagggtgaccaacttgtcctgctttgcctgggactgtcctggttttatttatttttatttttatttttttttgagatggagtctcgct

SEQ ID NO: 63658 - DNA, 601 bp, Human
gaaaggctgttaactacaaagcagtacatgtagggtctcccgattataacagagcccctctctaatagagaacccccatcccatcctccccacaacacatacacacatcatatagcaatgctagttcctctggttagtgtaagcatgctactttatcaggagtcctttaacagcagcctttcatttagatagcagataagtttgttgttatctcttgggatgcaacattatattgaagttctccattaccctactctcattgaatcattagcttttcttttcttttcttttttttcgtttcttcttttctttcctttgctttccttacctttcttttcttttttttttcctttcttttttttttttttttttttgagatggggtctcactctgtcacccaggctagagtgcaccggcacgatctctgttcactgcaacctctgtgtcccaggttcaagcaattctcctgcctcagcctcctgagtagctgggattacaggcaggtgccagcatacccagctaatctttgtagttttagtagagacagggtttcactatgttggccaggctggtcttgaactcctgacctcaggtgatccac

SEQ ID NO: 63659 - DNA, 601 bp, Human
aaaacactgcggctgacataacggcacttgctcctcaaggcaattttgagattgggtacccaggacaggtattgtcatcctctccattttgatgcaggtgaggaaatggagatgaaagaggttaagatgtggtggaggtcacacatttaatgagggagagaatttgccctagaatccaggattttacccttaccccaagggctcttattagaataatacctgactccactttgtaagaagagaatgtggatgtctttcgacaatggggtaagcaggttgtcctctctgttacttccttggrctagattactggcacctaagagagggttgtgataaaaatattctcttcagaaacttcttgtggctacctacctattctaaataataaagatattggaaattgagaactaaaaagctccatcagtacagaagcaaattatgttcagtgtagaagttgtactactcatctgtatttattatttttaaaagtactaaaatatcatctatttgtttatatgggcattttctagttaagaagtgaatactgcttaatacattttggatgcttaataatttattaatattagttgtgttaattata

SEQ ID NO: 63660 - DNA, 601 bp, Human
gagagatatcttcttcatttttcctgtaacagttccttatggggattttttaaaaatagaaaaccttggtcaagtgaaaatgtcagtattttagtagtacctacctggaattaccaaattggttacttaataattaattttgttgttttatttttggcatggtgatggcagataactatacaataattagctattgtagctcaccctcacccttatccctccaaaaacaaaacaaaaaactacctgaatcagccattgtttcaccctgaggttattaaagaaagaagtcttttgaagacattttttttttttttttgagatggagtcttgctctgttgcccaggctggagtgcagtggcacgatctcggctcactgcaacctctgcctctggtgattctcctgcctcaaccacccaagcagctgggaatacaggcacgtgccaccacgcccggctaattttttgtatttttagtagagatgaggtttcaccgtgttagccaggatgctctcgagctcctgacatcgtgttcacccgcctcagactcccaaagtgctaggattacaggcgtgagccaccgtgcctggcgctataaggtattt

SEQ ID NO: 63661 - DNA, 601 bp, Human
tttttttgagatggagtcttgctctgttgcccaggctggagtgcagtggcacgatctcggctcactgcaacctctgcctctggtgattctcctgcctcaaccacccaagcagctgggaatacaggcacgtgccaccacgcccggctaattttttgtatttttagtagagatgaggtttcaccgtgttagccaggatgctctcgagctcctgacatcgtgttcacccgcctcagactcccaaagtgctaggattacaggcgtgagccaccgtgcctggcgctataaggtatttaagagctgkcatattataatagataaaaccatgatgtcagaaacctgaattttattccaagctctactttaaaaaaaaattatcttgtggctttgtaggattttttagcttttgtaaataatgctgttggggaatcaacaggactaaatctctaatgttgaactggactgggttaattcagttcatagctaagagagccctaagatcccagttacttttgttgatgagattggcagccaaatccaatctcatccttggatctcaatccaatccatctttttgaaggagtcaaggaagaagataggtctt

SEQ ID NO: 63662 - DNA, 601 bp, Human
aaggcttccctttcagtgtctgcttccagaaacaacgttgccctgtaacctgggaggtctattagaaatccctctgccctatggaggcagcctgagctcccagaaagtaactattgttttttatgacagcctacagtagagtctcctctgttgagaaacattcagcatgtgagggttttatttaattaacaattgtaaccccaagtattcacattactgtcacattgtgagtgcctgtcctatcggaagtagcccagcttctttagatacaaggcttgagggaagtgaggaggaggtatgrgtagctccttccttcccaggtactggaaaaatctggatcattatgctctgtccatctaaaatgcccttggaactttgctctctgttgtgtgttcctcagcagctgtttagcagctgctttgctccacctcagcagtgggtgaaacgaccccactgtctgtttattgaagagcagaaagggccccgggatagagtgccctgaataaacatcagatattgtgaatatttttattcaccataatgaagcacattattattagctgagcactgtggcttcccagctgagagctggtgcacttga

SEQ ID NO: 63663 - DNA, 601 bp, Human
ttcatctactctctagaccggtagatttatgtgaaaccctttgattccttttgcttctgttatccagcctgtaagatagtaatagtcgtcatatctttcatctactctagaagaatattttgataattcatctagcaaatacattttgattatgggtatgctttgtgatctagagtttgtcttaaattcatcatctgtgaattcagataccattcatatttaaattcttgataataatcccaatctgttatttttatcattgggacattagatatgtcagggtcagtgtaccatttcacartctataattttgcctcttttcaatgagataaaacaatttattactcctcttgaattttttcacccctgagatcatgttttattcagctctcctacctgcatttttctctgtgttcacaattatggtctttacagtccttggacctctttaaaacgccctggcatcttttttcctcactcccttttagtcaatgtgttttgggttgcatggaatataacatgagaatgccggctagcaaaatgtaactctgggccagtagaattccatagaataagtcaagagaaagtaaaaacgaaggcc

SEQ ID NO: 63664 - DNA, 601 bp, Human
tttatgtgaaaccctttgattccttttgcttctgttatccagcctgtaagatagtaatagtcgtcatatctttcatctactctagaagaatattttgataattcatctagcaaatacattttgattatgggtatgctttgtgatctagagtttgtcttaaattcatcatctgtgaattcagataccattcatatttaaattcttgataataatcccaatctgttatttttatcattgggacattagatatgtcagggtcagtgtaccatttcacagtctataattttgcctcttttcaatsagataaaacaatttattactcctcttgaattttttcacccctgagatcatgttttattcagctctcctacctgcatttttctctgtgttcacaattatggtctttacagtccttggacctctttaaaacgccctggcatcttttttcctcactcccttttagtcaatgtgttttgggttgcatggaatataacatgagaatgccggctagcaaaatgtaactctgggccagtagaattccatagaataagtcaagagaaagtaaaaacgaaggccgttttccccagctgggtatagtaat

SEQ ID NO: 63665 - DNA, 601 bp, Human
aacactcattgtattagctttctattgctgcgtagcagattaccacaaattaagcagcttaaaacaacacaagtttattatcgcacagtttctgttggtcaggggcctgggcatggcttagctggatcctctgccctaatcacagcgaatctgtaatcaagcttataagctgaggctgtgatctcgtctgaggctcagggtctccttccaagctcgttctggttgttggcagaattcatttccttctgattgtacgactgagggcctcagttcctagaggctccctttctcaataggcagktcacagtttggctgcctgctttcttcctgagggccagcaggagaaaccttccattttaaggctttaatcgaatcttccctttcgtttactcaaagtcagctgatgaggaacctaatcatatttactatgccatccacttacagggaaggtgtgtacaccagggtctagagttttggaattctgtccaccacacccctcaactaacctttcggccctttatgccactcaagtcatttcctgtctctcttccttagattgacttaactgtaccacggaagtttaacttaaaaattccacaca

SEQ ID NO: 63666 - DNA, 601 bp, Human
cacactggcactctacttagatttactggcttatctaactgagctcttactatctgcccgatgttatagtagccactggaacatcaaagatgaaaaaagtgcatataaaggtgggtcctaccttcaaagagctcataggacaaatactgttacaactacacagaacaccacatgttacacattcagttcattcatctacctactccacctgaaggaaatgatccagagagagggcctaaaatactgagtttcagaggagcaggatgtttgccaaatagaaggaataatagcaaaataaaayaacagaattctacttcagcaagcattccttgagtgcttactatatgcgtgagacacaagggtctcaaatatgagtgagatctgtcctctgcctttgaggaatttgctgtttagttggggagacgtatgtaaatctgtggcggatgttgtgggagagaaatatgcagggtggtgtgaaaagccacaggagcatgaaagccacgagtctttggggaacgcagaggcatatgatgtggctagatgaaattgttcagagcatgtgtaggattgaggggaaatgaggcactagggataggaaaga

SEQ ID NO: 63667 - DNA, 601 bp, Human
ttatagtagccactggaacatcaaagatgaaaaaagtgcatataaaggtgggtcctaccttcaaagagctcataggacaaatactgttacaactacacagaacaccacatgttacacattcagttcattcatctacctactccacctgaaggaaatgatccagagagagggcctaaaatactgagtttcagaggagcaggatgtttgccaaatagaaggaataatagcaaaataaaataacagaattctacttcagcaagcattccttgagtgcttactatatgcgtgagacacaagggtytcaaatatgagtgagatctgtcctctgcctttgaggaatttgctgtttagttggggagacgtatgtaaatctgtggcggatgttgtgggagagaaatatgcagggtggtgtgaaaagccacaggagcatgaaagccacgagtctttggggaacgcagaggcatatgatgtggctagatgaaattgttcagagcatgtgtaggattgaggggaaatgaggcactagggataggaaagatccactgaaaacccttaactgtaccagtgaagattttgaatttatcctattaaacagcagaaa
